United States Patent 9,890,389 (ISOLATED POLYNUCLEOTIDES AND POLYPEPTIDES, AND METHODS OF USING SAME FOR INCREASING NITROGEN USE EFFICIENCY OF PLANTS) - sequence listing, part 3

SEQ ID NO: 3039 - DNA, 1543 bp, Brachypodium distachyon
atgtcgcaactgtcacaccaagtgtctctgacactggggtccacccgaccagactctctcttcctccctcttctccccagtcccgccggccccaattcaccatttcttcgccgcttcgccaagagaagcccccactccgcgcgaggcgacgggggagactggtctggagagcaggaacgagagaggcgaagccttagacctagcgctcgaccctcctcaccgatggccgtcctcgtcctagtccttgtcctcgccgcctgcgcagcgctcgcgccggtggcttccgccgtgcccttcatcgtcctgcacgggattggggaccagtgcgggaacgacggaatcgcctcgttcactgatgagctcgggaagtggtcggggtccaagggctactgcatggaaattgggagaggatcatgggactcttggataatgccactgcaagagcaggcaaatgcagtttgcaacaaggtaaaggaaatgaaagatctccatgaaggttacaacataattggcctttctcaggggaacttaattggccgtgcagtgattgagtactgcgatgatggaccaccggtaaagaatttcatctcaattgggggtcctcacgctggtactgcttcagtgcctctttgcggttccggcatcctttgtattcttgttgatgctctgattcaattggagatatattcaaactatgtgcaggcacaccttgctcctagtggttacctaaagattcccactgatatggcagaatatttgaagggatgcaaatttcttccaaagcttaataatgagataccaagtgaaagaaacgctacatacaaagaaagattcagcagcttggagaacttggtgttaatcatgttccaggacgatgcagtcttaatacctcgggaaactgcatggtttggttattaccctgatggctcttttaatccagtgctacctcctcagaagacaaaactatatactgaagactggatcggcttgaggactctggacgagaccgggcgcgtcaagtttgtgtcagttccaggaggtcacctccgcatctccaggagcgacatgaagaagtacatcgtgccttacttgaagccgtggtatcaacgcagagtgctcgtcggatcttgttggattgaggatagaaccacgcgtgtatcggtctttgtaagccctgctgcatcaattgctgtaaaaaatacactggtgaaaaggagagaaaacgaaggaaaaaaatcacgaaaagaatacagaaagagttgggattgtaaatgtttacctgcgttgggcaaaatgggggaaatcatacaagtcaaagtgtaatggtttcccttccgatcaccatggagtcaggtttgggcaaacattgaccgatccagtcgagctagatgcttcatttaactagaagtcgtagtctgaacagggtaaaatcgtactccctcctagacattttttaagtatagatatatccatatttgaacaaatttgagttatagtatgggaagtatgggacggaagaaatagaaaatatcagttgtctaaa

SEQ ID NO: 3040 - DNA, 1227 bp, Secale cereale
cgcgcctcccggaccgactccggtccgcgacactccccgccgggcggacgaggtggagtcggagcgggagcgcgcgagagagggcgaagccctaaccctcgatccccgaccggaagccgatggccgtgctttcccccgctgtctccctcctgctggtcctcgtcgtcgccgcctccgcggcgctcgcgccggtggcctccgccgtgcccttcatcgtcctgcacgggatcggggaccagtgcgggaacgacgggatcgcctccttcaccgacgagctcgcggagtggtcgggatccaagggatactgcatggaaattgggagaggatcatgggattcatggttaatgccacttcaagatcaggcaaatgtggtttgcaagaaggtaaaggaaatggaagaacttcgtgaaggttacagcatcattggcctttctcaggggaacttaattgggcgggcagtaattgagtactgcgacggtgggccaccggtaaaaaatttcatctcaattgggggtcctcacgctggtactgcttcagtgccactttgtggttctggtattctttgcgttcttgttgatgtgctgattcaactggagatatattcaaactatgtgcaggcacatcttgcccctagcggttacctaaagattcccactgatatgacagattatttgaagggttgcaaatttcttccgaagcttaataatgagataccaagtgaaagaaacattacatataaagaaagatttagcagcttggacaacttggtactgatcatgtttgaggacgatgcagtcttgatacctcgggaaacagcatggtttggttattatcctgatggcgcctttaatccagtgcttcctcctcaagagacaaaactatataccgaagactggatcggcttgaggactttggatgaggctgggcgtgttaagtttgtgtcggtgcccggaggtcacctccgcatatcaaggagcgacatgaagaagtacatagtgccttatttgacaccgtcatgtggatcatccaagcagagtattcgtcgaatcttgtcataccgaggataggtataccgaggataggtaaaccacgcttgcggctgtaattgcacttgttcttgttctttgtaagcccaacccatgtctatatgcattgttaccttataaatacattggtgaaatagactggaaccataacgttgctgtgttcggggtaaatagactggcg

SEQ ID NO: 3041 - DNA, 6731 bp, Sorghum bicolor
acaagctttggaccatctgtaggactgtgtgaagtgtgaactgcctgcttgaaacatatggccctgcgggtgctggcagtcaaagtggattggagtacttataccccccacccccaccccaaaaaaacaaagagttggattggagtaatgcttttggtagcagaaaaaattggtcatcaatgacgcggctaactgcacctgcaccccaacgatgatcactaatactatctgtaaattattgagatcagatagttgctggcatcaatgaatgggttaaaacacaaaatatgaacttgtgtatgaggaacatgtggactatccgtaaattattatgaaaaagtaaaaaggaaagacaaaaaattgctactatattcttgactaatcgaatgattataagaacacctatttggagacatcacataaaagccgggcagagagtgtgaatcaacttcgaacagagcaaagcagcacaaggccgttctgattcctcccaaaacttatgaattccgtttggatggcaaccaggatcgcagcatatggaagtacaaattcccataccatccgagattaaagaccaaactccagagcaacctcgacaacagctaaaagagtttaacagaactgaagcaaaaaactctacaggactattgcaaaaggaatctaaacagcagacaccgaattaagatcatccatcaacagcttcataactggccgcccacttgccatctggaacatcatggtgtcagccagaaccatctccacgccatcgatctgagatccccagttttctccatgatagctgctcgtttgtcctccgtgtaaagtatactccagttttgctccgtgccagaaatactgtgatagagtatctccatactcttccactccatcctctgaaaacaaagatcattcctcaatttccataagcaccacaaggtagcagaagagaatgcattgatcaccccatttttcttattactaagccaatactttccaactgaatcaacagaactacctagctgaacacctagtacatcagatagcatagcccacatctgactagccaccacacaactaaaagaatattgagcatcatccaagtacaaccgtgaatatagattttcagattctagctacctgtaacacattggcggttcatcttgtggaattagtaacctcattcattctctgagattgcactcaactccgaggacaaacggaaagtaccagttacggaattctgctcatccccacagaagaatggctcgggaggcatctgaagaccatcaacgccagcttcaagcatcccaatgacctcactcatcgttggtcgatcatgtgatttcatctgaatgcaccataacccaacaacacacagcttcctctccacctcatggatatcaaaagcttcgcaaatctcgcctacctcttgccgagttagatgattatacacccaagctgggtagtacatctggcttctcctttctgcatgttggtctaagtttcttcgccccccagccatctccagcaatagcatcccgaagctgtaaacatctgacttgcatgaaacaacaccgaaattacgggatatcatctcgggagctatgtacccgatagttccccatgcagcgctcaccggcacaaagctgttgtccctcgggtacaatttggctagcccgaagtcggcaactttaggagtgaagttattgtctaaaaggatgttgtgtggtttgatgtcaaagtgcagtatctgcatttcacatccttggtgcaagtagttgattcctctggcaatgcctaaagctatttcattgagcttatcccaggaaaatctttgctcagaagaaaagatgtacttatcaagagatccacgaggcatgtactcatagacgagagccctcttcatttcttctgaacaaaatcccacgagacgcactacattgacatggtggatacttccgatggtggacacttcactgataaattcgtctccattgcacaatgaattgcccaacattttgacagcaacattgacatcacctggaagcatgcctttgtacacggatccatagcctccttggccaagcttctctctgaagtgccctgtgattgcagtgatgtcggtataggcataccttgttgggctaagagcttgttgcatttggagaaacttctcaactgcatcaatagatatccttgttttccagtatttgtaggcgaggaaggtcaatacagctaatggtgcaaacacaaacctcgatagcattccaaacactgcagataaaagattgcaggattaagtaagatgcatgcaaggatgcagctataatgatctaaaatgatgaaattctctcattacctatcacgaacttcacaatgtccacagcagatatcatggcgaccacagcccaaaataatttagttcggtatgaataatcatttacacatcttaagaaatgaaggtcgatcccaaaagcggtggcaaaagtctgatccacaatgcttgagttagatattttatcattgtagtaactgcaggttttgtcacagcacatcaaacagaattaattggggtgagcaccggagcacccccaataaaattaaattttgaaaggaaattaaaacacagagaaatcagcagttcacggagctcatactcacccctttgcctctttcaggcataagttaatgatccaatgatatgtccatccactgctataaggaaaatcaacagaaaagccattcctcataaattttacaatatcttcataacttgcattatctggtcgcttgacatgtcgactgcccaaaggaatcatggacaagtatctacatgacggcttgatgtatccaaccattgggaagaatgtggtagtgaagacataaacaaaagaattcttcgtacttcggcaattgacaggcctgtaaataccactacagcaactgctgaacaaggaagtaacatcacttagcatctctgaacaagtgataaaggcagcccaagttactgtatcaggatccagcaaggtgctgccttcggattgcaaaccatttatatagggatgttggttgctcgcaggaatgggacagctgctattatccaaattggcatcaacaacccagaaagtagagtcagtgtaggagatgttagtcacaaagtatcttccactgttgatgtgaattatagccttgctatcaatgcaaaccagctcatactctggaaaaccacaaccttgtggatcaccttgcatacggaaaggagatcgtatgtcttgaagatgcccacaggagaaagaagggcaaaaagcttgcccttcagtgtttgttataagtgtggaaaccatggctaatccatgcagggagagaagaaatgcatgagagctaatcattgaagcttagcaaaggcaagatcagacaagaaagttgaagcaagagtaaaggaggaggttaattatctgtggctcgaccaatacaggagggaagaggaagagaagtcaagcctggcatcctatctgttagtcaagctgatgcacacgatgcaaggaagaaaatttagatttttccacctacgtaatgtgtaaatcgtgtcaatattttatgatcatagaagatttatcaacgactttcttctataattacaagggaactcacttttgcaggcatatatcgtatctttgccttataccttcattcgttgaaaacatgcttcaacctctgctcatctcagttctccttgagtttttcctttttccttcctagatgtaaggaactcatgttgctgaggcaacttacagttatatgagttggccggccgatgctttgggatgagtccttttgcagcccaccaaagctccagctttcaattggcttcctaatttgtctaacatggttgtcttgtcaaataagtagtaaatgtgggataagtacaagtctgacgctttacttatctacacaggtgggtggtagtggtagatagaaaatatcaaggtgtatgagataagtcccaactaggcaaaatagaactatatgttgactaatccattccagtcaatggctgtagcgtggaaaggatgactatagtgcagcactacacaagaaatatccaagaaagcccacttcaccaagacgcaaagctagaattcttccaccacagttgtgggaccatcacgacaaacaattgagggtcattgattccaacaagtttctaaatcttgtaggtgcaaccttgctttgcctgctggctgctggcattcttctgccacacaaatgtctaatttgtttgctgtagctttggtgctctcatctctctactatggaatcaccatggccaccgcaagcagtgatgaaagcttcttccaaaagtgcctagcatccagttgcagcgaaggaggaccagagatccgatttccattccgccttgtaaccagccctctatcatgtggtgcacctggtatggagttagtgtgctcgaaagcagataccatcctggttcacccaaatcttggcttatgcaaggtaattgccatcgagtatagtgtcggtactataatcattgtcccacttgcagaatccaagtgcccttttcagaagatcatctccaccaatctatcaaccgatgtatatagaccttatggggaacgtgcaaccttagtgagttgttcagcagagttcataccaagtgataaggccaacattgccggtcccatcttttgccttaacaatactagccagttcacttacttggtatcttcttttcaatcaatggattttcttccattggactgcatggttctttcaaatagcatttcagtaccttaccgttctataaacatggacttcaacgaaactgtaaaacgaaccattgcatttggtgagacaatgttaagatggtcagttcctaacattaccaatgtttgccaaaactgtgaagatgaaggaaggctctgtggatttaagtcagaaactaggcaagcattctgtaagagtaagaaacaaagttcacatctcaaagtcattgcagtaacgacaccagtagccacacttctggttatttcagcaatggcagctgctgcattatatctcgccctgaaatctaaatatgatgaagagatacacatgaaagtcgaaatgttcctgaaaacctacagcacgtcaaaaccaacaagatacacgttctctgaagttaagaagataacaagacggttcaataacatacttggccaaggtggatttggaagcgtatacaaaggtgagctatccaatggagtgcctgtggcagtcaaaatgttggagaactcaacaggagaaggagaagaattcatcaacgaagttgcaaccattggaacgatccaccatgacaatgtcgttcggcttctaggtttctgctctgaaagatcaaggcgtgctctaatctatgaatttatgcctaatgcatcgctagagaaatatatattctcacaagaatctgacagtagtggccaagaacatttgacacctaataagatgctagaaatagcaacaggaattgccagaggaatcgagtacctgcaccaaggttgcaatcagcgcatactccatttcgacatcaagccttccaacattttactagactacaattttaagccaaagatttcagattttggactcgcgaagctgtgcgcaagggatcagagcattgtcacgctgactgcagcaagaggcacaatgggctacattgcaccagaattatattctcggaactttgggacagtatcatacaagtcagacgtttacagctttggcatggtggtactggaaatgatgagtggaaagaggaggagcatatacccagagaccgagaaccaaaatgatatttacattcccgagtggatatatgagaaaatagtcaccgggcaagaactggaactggtcagggaaatgacacaaggagagaaagatataatgaggaagctggctattgtagcgctgtggtgcattcagtggaacccagcaaatcgcccgtcaatgacaaaagtggtgaacatgctgacagatagcttgcagagcctaaagatgccccctaaaccatttgtttcatcctttggccagcaagcatgaagcaaaaggtagagaccacatcataatcattcagatgtttgtgtctatcagttattcagttatcgacatgtaccagtgatgccttgtgtctatcatatttttcgtattatacctttttttccctgtaaccactggattgcatacattcagattcctggtttaaccatgttaatggatatgtaatgacattagcagaacactgcataaaaatcagtagctggaacggtagaagttacagcttacattgaaatgcagacaggttaatgttcttatgatttatctccaattgtgagcattgagacggattggtggtcctcaacgacgagttcctgcctaatgaacaagctgtcggtagctacccctccttgcacgagaaattcaggcagattaatgttcagggaggctactcacctctaccgaagtaccaatgcccggaggtcgaatgccatggatgcactcggcgttctagaatggccggtgaggacggatggcgtgccatgggcgccagcatgcgagaaatcgcagtggtccgctgggaagccgaagccattgggcagatcgccgccgccgaagtgggcgtagcaccggtggtggtgggaggaaggtgatgcggagacatctcctacctctcagat

SEQ ID NO: 3042 - DNA, 3014 bp, Zea mays
acttatttgaaaagacagccatgttaaacagattaggaagccaattgaaagctggagctttggtgagctgcaaaaggactcatcccaaagcatccgctggccaactcatataactacgacttgcctcagcaacatgagttccttacatctgggcatgagaaaaagaaaaaaaaactcattgagaactgagatgagcagaggttgaagcatgtttgcaacgaatgaaggtagaaggcaaagatacgaagatatgcctgcaaaagtgagtttccttgtattgattgaagaaattcgttgataaatcttctatgatcatcaaatactgacacgattgacacccttgcattgtgtgcatcacagggatctataagtggaagttcatgtcagctttactaacagataggatccgaggcttgagtgcttgacttctcttcctcttccctcctgtatggatcaagccacagataattagccttctcctttactcttgcttcaactttctagtctgactctgatcttgcctttgctgagcttcaatggttagctctcatggatttcttctctccctgcaagcattaaccatggtttccacaattatgacaaacactggagtgatagccactcaagggcaagccttctgtccttcttcctcctgtgggcatcttcaagacatccgatctcctttccgtatgcaaggtgacccacaaggttgtggtttcccagaatacgagctggtttgtattgatagcaaggctataattcacatcaataatggacgatactttgtgactagcatctcctatagcaactctactttctgggtcgttgatgctaatttagataacagcagctgccccattcctgcgagcaaccaacgtccctatgtaaatggtttgccatccgaaggtcgcaccctgctggatcctgacacagtaacttgggcggcctttgtgagttgttcagagatgctaagtgacgtttcttccccgttcctcagttgctgtagtggtatttaccagcctgtcaactgccgaagtacgaagaattcttttgcttatgtcttcactaccacattctttcctatggttggagacatcaagccgtcatgtagatacttgtccatgattccttttggaagtcggcatgtcaagcgaccagataatgcaagctatgatgatattgtaaagtttatgaagaatggctttgctgtaaattttccttatcgcaatggacggtcgtatcatttggtcatcaacacatgcttgaaagatgcaaatggttacttcaacgataaaatatctaactcaagcattgtggaccagacattggctgcggtttttgggatcgaccttcgtttcttaagatgtgtaaatgattactcgtacagaagtaaattgttttgggctatggtcgccatgatatctactgtagtcattgtgaagttcgtgatagtatttggaatactatcgaggtttgtgtttgcaccattaactgtactgaccttcctcgcctacaagtactggaaaacaaggatatccattgacgcagtcgagaagtttctccagatgcaacaagctcttagcccagcaaggtatgcctacactgacatcaccgcaatcacaggacacttcagagagaagctgggccaaggaggctacggatccgtgtacagaggcgtgcttccaggtgacgtcagcgttgctgtcaaaatgctgagcaactcgctgtgcaacggagatgaattcatcagcgaagtgtccaccatcggaagcatccaccatgtcaacgtggtgcgtctggtggggttctgttcggaagaaaccaagagggcgctcatctacgagtacatgcctcgtggatctctcgataagcacatcttctcttccgagcaaagcttttcgtgggataagctcaatggaatagctttaggcatcgccagagggatcaactacttgcaccaaggctgtgagatgcagattctgcactttgacatcaaaccacacaacatccttttggacaacagcttcactcctaaagttgccgactttgggctagccaagctgtacccaagggacaacagctttgtgccggtgagtgccgcgcggggaaccgttgggtacatagctccggagatgatctcccgtaatttcggcgccgtttcgtgcaagtcagacgtttacagcttcgggatgctgttgctggagatggctggtggacggaggaacctagaccagcatgcagagaggagaagccagacgtactacccagcttgggtgtatagccatctaactcggcaggaggtgggcgagatctgcgaagctttcgatgtccacgaggtggagaggaagctgtgcgttgttgggctatggtgcattcagatgaagccacatgatcggccaacgatggctgaggtcgttgggatgcttgaagctggcgctgacggtctgcagatacctccccagccattcttctgtgggggtgagcttactggtagcacttcgtatttctcctcggagttgagcgcaatctcggagaatggatgaggttactggttccacaagatgaactgccaatgtgctacaagtagctagaatctgaaaaaaaatctgttgtacttggacgatgctcaatatttagtcggttgcagtgcactgtaattcgattctatgctgtaatgcgtctgcatcaggcaccagcagcttcttggatcaaagggatgagcatgtactcgtatgatgaattaaaaaatttggtggatttcatatggataatccgtgttgctcgtacacgagttcatcttttgttcttaacacattcattgataccagcaactatttgatcacgacaatttgcggatggtataagtggccatcgttgggggaccagttagccgcgtttcgagatttttttttttggtttttttttctgccaacgcactactccagtccactttgactaccagcacccattcgtcttgtcaaagccaaccattgttgaccaagcatgttcaggaa

SEQ ID NO: 3043 - DNA, 2840 bp, Zea mays
ggcaccgcagcaacccattccatagccacgcgagtgacgcgacgcgacgcacggcctgcctgaggcagcgcatctgcttggcggccgggagcagccgccgcttcgccttcgtgagggtttaagcgacgaagagaaaggggaggaagcgagcccccagggaggtgcagagggagagggtgggagatggctgcaatggttggagcgcgtagggcgctcttggccgctcggttctctcctcgcggcaccatcgcggcgtcggccgcgccagctcccctctaccggcccatggattcgccactcaggcttccagctgaaagagtttgtctacagtcttgggttccacatcgaggggctggtacctttgcatctgaaaggactgatgaagattatcagcgtgagtggggacaaaacaaagcaggtagctacactgactcccgttggaacggctctaatctccaacttcagagagatgtcacttcagctggttccacaacaggtactcacaaaaataagggtgtggatggtgttggtggcagttctgagcaacattacagaagtggtggatcatatggctttcaaaacaatcatcagccatatactggtacaagagcgaataatgagagatacaatgcatcacaaccttatagaggtagtggtccatacagccagcaaggccttgatggacatttttcaaatgatcgtcaacagtacaatggcacagaagctaatagtacatatagctctggatactacacccaaagtaagcagaagatttatgaaggagagggagctaataatgggcagtatggatatggtccttcaggacaaccatgtccgaacccagttggaaatagccagcgagttcagaaacagcaatatgttgatcatagatctgggggaagttatccagatagatctgggcatcatccctctcaatatgtaaatccaactcattcccgtaaggagcatgttgcagggtttcagcaaggcaacaatagtaattttggatataatgcttcgcaggcatatcaaagcccttatttcactaggcaggctgatacacatagtacttctcaaggatattccatgtacctaaatacagatgtgcaacgcctctctcatggagttcatcaagaaaaacattcacatgcacaatctgctggatcatttgggaaccatgtaaatagtgcacctcatgaatatggcaaatatcatcagtcactacaaggcaacccttcaaatgttggatcgccttacgaagtacctagtgaagctggcagcaaacacaaatgtactgttgaagaactggagaagttttgtgatgatggcaatgtaaaagaagctctggaagttttggctatgctaaaggaaaacagaattgtgctacatgctcctcagtacttcagattgatgcaagcatgtggtgatgcaactgccctttcagaagcaagattaatacatagtcaaatatctgaatcatcacttactgttgacacagattttcaaaacaaaattatggagatgtatgctaggtgtggttctatggaagatgcaaagaagattttcagttctatggatcatcataatttgacttcttggaacactatgatctcaggttttgtgcacaatgttcttggtgaagaagcaatagatttttttgaacggtttaagcagacaggggacaagccagatcatggcatgttcagacatgttttcttggcatgtggaattttgggatctgttaatgaaggaatgttgcattttgaatccatgcagaaagattttggcatacatcccactacagagcattatgcaagcattgttactatgcttggacagtctggctacattgtcgaggcttatgaattcgtggaacggatgcctgtggaaccaagcattgaggtatgggaaaatttgatgaacatgtgtcgacttaatggctttttagagcttggagatcgttgtgctcagatcatagagtgcttggattcttctaggctgaatgaacagtctaaaatgggtctgttccctgtcgatgtgtcagatcttgcaaaggaaaaggaaaggaaaaaggcaagtgtcgccgaagctcggagcaaggtccatgaatacagagctggcgaccgatctcaccctgacactcctaagatctatgaagagctgaggtatttgttggctcacatgaaggaagctgggtatattgctgacactcgatttgttcttcacgatgttgatcaagaaaccaaagaggatgctttactggctcacagtgagaggctggctatcagttacggtcttataacaagtgctccccgctcacctattcgggttataaagaatcttcgatcctgtggggattgtcacacggctttcaagataatctcaaaacttgttggacgtcagatcattgcaagggatgcaaagaggttccaccacttcgaaaatggtgtgtgttcttgcaaagactactggtaaacaagatgaaagaaagtccacatcttggtcaatttttattggcacaagaccgctataggttgtttatgtgctgaaggtaggctgatgcctatctaacatttagttagctaatagtttcatgtgagagacatgctgtatgatgtcgtcagtgagaaacagccaaacaggtcctaagcagctctggtgttctattttgcagctcatacgttaagcctgagcttttactttaacaactgttgtctctgatttgttacttgccaccaaaataaaacagtagaatgtaactgggtagtggtcccttggcatgtaaactttgattcagctgattacaaagctttctgactgcattctggatccattgctta

SEQ ID NO: 3044 - DNA, 697 bp, Saccharum officinarum
gcgcctccctctccaacccaacacccggcggcggcgagcggcggcgatgacgacgagcctgaagaagaacaggaagaagcgcggtcacgtgtcggcggggcacggccgcatcggcaagcaccggaagcacccgggaggtcgcggtaacgccggtggcatgcaccaccaccgcatcctcttcgacaagtaccacccgggctacttcggcaaggtcggcatgcgctacttccacaagctccgcaacaagttctactgcccctcggtcaacgtcgagcggctctggtcgatggtgcccgccgacaaggccgccgaggcggccggcggagacaaggccccgctcctggatgtgacgcagtttggctacttcaaggtgctcggcaaagggatgctgccgcccaagcccatcgtcgtcaaggccaagctcatctccaaggtcgccgagaagaagatcaaggctgctggaggcgccgtcctgctcaccgcataggtctttttgcatcttgtttcacctatctgtgctaagaaaatttcaaaaattttcgtcgatcatgtgttgtgagacagtgtcttatgagttatgagaccccgattttgtgcacttggtaacgaatgcgaattcaattccctgaaatatttcagatatattgtcgctccatgtttagttgatactgatatttcgtctgggttatattatata

SEQ ID NO: 3045 - DNA, 954 bp, Panicum virgatum
cggccaatccagactaaaacattcggccagactggatgggccttacacaccaacaagttcggagggaaaaggtccagcccataatataaacaatttcagcccaaggaaaaaccctagcaggaagcaccgtccatggcccatcccatccaactgtcccagatcctccacctcccccatcggacggcggccgcgccacgcaccagccttataagaaagatcacatctcccctaacctaggatttcctcccaccactccccacccccttccaaccccagccccggcggcggcggcgagcggcggcgatgacgacgagcctgaagaagaaccgtaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaagttctactgcccgtcggtcaacgtcgagcggctctggtcgatggtgcccgccgacaaggccgcggaggcggcgggcggcgccgacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttgcatcctgtttcgtctatctgttctaagagaacaccttaatttgttgtggatcctgagttttgagaccccggttttgtgcacttggtaacgaatgcccgttcatttactgaaatgtttccgatttatatcattgcctgagatctgttgctgcaagttgtgatcttaattgattaccgtatatcctccggtggtgttgat

SEQ ID NO: 3046 - DNA, 967 bp, Setaria italica
gcccagcccatcatatagctaatttgtagcccaaggaaaaaccctagcaggaagcaccgtccacggcccacccaatccaactgtcccagatcctccacctccccatccgacggtagccacgccacgcgctcgccttataacatctctcctctcctagggtttcttcccaccactccttcccctccaaccccatcacccggcggcggcggcgagcggcgagcggcggagatgacgacgagcctgaagaagaaccgcaagaagcgcggtcacgtgtctgcggggcacggccgcatcggcaagcaccgaaagcaccctggaggtcgcggtaacgccggtggcatgcaccaccaccggatcctcttcgacaagtaccacccgggctacttcggcaaggtcggcatgcgctacttccacaagctccgcaacaagttctactgcccgtcggtcaacgtcgagcggctctggtcgatggtgcccgctgacaaggccgcggaggccggcggcgacaaggccccgctggtggacgtgacgcagttcggctacttcaaggtgctcggcaaggggatgttgccgcccaagcccatcgtcgtcaaggccaagctcatctccaaggtcgcggagaagaagatcaaggcagccggcggcgccgtcgtgctcaccgcataggtctttttacatcttgtttcatctttttgtctgcgctaagagaacttctaaatttgttgtggatcctgcgttgtgagacagcgtcacatgagttatgaaaccccggttttgtgcacttataacggatgccagttcatttccttgagatgtttgtgatatatcattgcttgagatctcttactgctagccgtgattaatttcagtgtcgtactgctgattgaacgatgttaatcttgtcatttgtttgatacgtctaagtctgtaatattgggtaggcaatgttttgttctgcaaccttgac

SEQ ID NO: 3047 - DNA, 644 bp, Panicum virgatum
cttccaaccccagccccggcggcggcggcgagcggcggcgatgacgacgagcctgaagaagaaccgtaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaagttctactgcccgtcggtcaacgtcgagcggctctggtcgatggtgcccgccgacaaggccgcggaggcggcgggcggcgccgacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttgcatcctgtttcgtctatctgttctaagagaacaccttaatttgttgtggatcctgagttttgagaccccggttttgtgcacttggtaacgaatgcccgttcatttactgaaatgtttccgatttatatcattgcctgagatctgttgctgc

SEQ ID NO: 3048 - DNA, 997 bp, Pennisetum glaucum
ccactcccttccccccaaaccacacccccccggcggcggcggcggcgagcgcgagcggagaggcgatgacgacgagcctgaagaagaaccggaagaagcgcggtcatgtgtccgcggggcacggccgtatcggcaagcaccggaagcaccccggaggtcgcggtaacgccggtggcatgcaccaccaccggatcctcttcgacaagtaccacccgggctacttcggcaaggtcggcatgcgctacttccacaagctccgcaacaggttctactgcccgtcggtcaacgtcgagcggctctggtccatggtgcccgctgacaaggccgcggaggctggaggagacaaggccccgctggtggacgtgacgcagttcggctacttcaaggtgctcggcaaggggatgctgccgcccaagcccatcgtcgtcaaggccaagctcatctccaaggtcgccgagaagaagatcaaggccgccggcggcgccgtcgtgctcactgcataggtgacgaaaccccaaaaggaggaagcacatgctcatcagtaaggatgatggggtccgggatgcaatccaatgcaaggatgtcataaattggcattgtacctgttctccatacttgcatttggcttatgatttgtggacctcatttggcttagtttattgtagttttgaagcctttgtttaagttgagcaatgaggatatggtagtttagcgtgccccctgctaatcacctggtttgttgaagacatcgcaataggtcgtttctgtttagcgaatagcgacggcaggttcttttatgttatacatgcatttggtttcctcgttgtgctacctggctagctatgttacacagatacttggatacaccattttagtgggttttcttttgacagtgggtatctgtgtatctgatatgtactgtatcagttacacgtactcgtgtaacatggctggctattgtagtgctaccgtgtctgatacatgtcggatatgcgga

SEQ ID NO: 3049 - DNA, 678 bp, Panicum virgatum
accgcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgtggattctgagttttgagaaccccccccccctttttgtgcacttggtaacgaatgccagttcatttacatttcagattgcctgagatctgttgctgcaagttatgatccgtataattgattcccgatatatcatccagtgctgtttataattca

SEQ ID NO: 3050 - DNA, 707 bp, Panicum virgatum
cttccaaccccagcacccggcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgtggattctgagttttgagaacccccccccctttttttttgtgcacttggtaacgaatgccagttcatttacctgaaatgtttcagattgcctgagatctgttgctgcaagttatgatccgtataattgattcccgatatatcatccagtgctgtttataattcaaaa

SEQ ID NO: 3051 - DNA, 517 bp, Panicum virgatum
ccaccactcctccccttccaaccccagcacccggcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgtggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtt

SEQ ID NO: 3052 - DNA, 955 bp, Zea mays
gttttgtgtttgtgtggcttttctggttcgaaagacggattagaccaaggtatcaaatttggcttccgctagctgcccatctcgaaacagcatgaaccggcccgatgacgcgcctcaggaggaagacaaatgaaataccataaatccaggctcagcccgaaattaacccaatagcagcccaaagcaaaaccccagcaggaagcaacgtcgacggcccattaactccaacagtcccaggacccccctgcccatccgacggcgatcacgcctcgcgctcgccaggccttatagtacccctatcctagggtttactcgctcccatccactcccaagtcccaacacccgtcggcgtcgagcagcggcagcggcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacgtggagcggctctggtcgatggtgcccgccggcaaggccgcggaggcggccggcgcggaccaggccccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaagaaatattctatctttttttgggtggatttatgagaccctggttttgagcacttggtaacgaatatgagttcgattatatcgatgctgcacacctcttgctgc

SEQ ID NO: 3053 - DNA, 1323 bp, Sorghum bicolor
tggagacggttgaaagcccagatcaagcgatcaccaccaccagatccaggcccagcccaacatcccgtcaaacaccccagagcaaaaccctagagaggcctcatcaacggctcccgctcccccgtccgacatccaacggcggccgcatcagacgcctgccttataagaacacgccattctcagcaactagggtttcctccactccctgccccgcctccacttctcccctcccaggcgctgcccaggtaagtcggcggcgagcggcggcggcgatgacgacgcgcttcaagaagaaccgcaagaagcgcggccacgtgtccgccgggcacggccgtatcggcaagcaccggaagcacccgggaggtcgcggtaacgccggtggcatgcaccaccaccgcatcctcttcgacaagtaccatcctggttacttcggcaaggtcggcatgcgttacttccacaagctccgcaacaagttctactgccccgcggtcaacatcgagcgcctctggtccatggtgcccgccgacaaggcggctgaggccggcggcgacaaggccccgcagatcgatgtcacgcagttcggctacttcaaggtgctcgggaagggggtgctgccgcccaagcccatcgtggtcaaggccaagctcatctccaaggtcgccgagaagaagatcaaggccgccggcggcgccgtcgtgctcaccgcctaggtttcagtccttgttcgcctcttggttttgagatctatatctgaactagtagtgctttcctgtctcagctatttgtgttaagaagacctgtagtttttaaatctgtggctgctgcctgttgggacagtgctttatgaggattttgatgccagttcatatcaaatatttcagatatattaaagctatctgtgctaattgttctactttcaactgtgcaattgatttatgatgcatgtgcaatcttcggtgttgtgaaattcgtaactgtttgcgtcacaagattgttagaaatgatgtgaaattttgtgttgttgaaccttgtgccatagattgttctctgttcattgtaggcttattaactcgatgcaattatctgtgtttcgcgtgctacttatattttcatggcttcaaagtcttagttttagtgatgcttgtagccttaggctttgtaaatgtagtgtgccttgattaatttcacaggtaatatactgttgcatgagatacttttatgcccatatgtatggtagcaagtacaacatcacattttacccttactgtgttgcattttggtaatgctggagattttctctcgtttgtaagtgatgaagcccct

SEQ ID NO: 3054 - DNA, 682 bp, Saccharum officinarum
tccccctcccaaagcgctgcccaggtaagtcggcggcggcggcggcgatgacgacgcgcttcaagaagaaccgcaagaagcgcggccacgtgtccgccggccacggccgtatcggcaagcaccggaagcacccgggaggtcgcggtaacgccggtggcatgcaccaccaccgcatcctcttcgacaagtaccatcctggctacttcggcaaggtcggcatgcgctacttccacaagctccgcaacaagttctactgccccgcggtcaacatcgagcgcctctggtcgatggtgcctgccgacaaggcggcggaggccggcggcgacaaggccccgcagatcgacgtcacgcagttcggctacttcaaggtgctcgggaagggggtgctgccgcccaagcccatcgtcgtcaaggccaagctcatctccaaggtcgccgagaagaagatcaaggccgccggcggcgccgtcgtgctcaccgcctaggtttcagtacttgttcgcctcttggttttgagatctacatctgaactagtagtgctttcctgtctcagctatttgtgttaagaagacttgtagtttttaaatctgtggctgctgcctgttgttacagggcttatgaggattttgatgcaagttcatatcaaatatttcagatatattaaagctatctgtgctaccaa

SEQ ID NO: 3055 - DNA, 671 bp, Saccharum officinarum
tccccctaccaaggcgttgcccaggtaagtcgtcggcggcggcggcggtgatgacgacgcgcttcaagaagaaccgcaagaagcgcggtcacgtgtccgccgggcacggccgtatcggcaagcaccggaagcacccgggaggtcgcggtaacgccggtggcatgcaccaccaccgcatcctcttcgacaagtaccatcctggctacttcggcaaggtcggcatgcgctacttccacaagctccgcaacaagttctactgccccgcggtcaacatcgagcgactctggtcgatggtgcctgccgacaaggcggcggaggccggcggagacaaggccccgcagatcgacgtcacgcagttcggctacttcaaggtgctcgggaagggggtgctgccgcccaagcccatcgtcgtcaaggccaagctcatctccaaggtcgccgagaagaagatcaaggccgccggcggcgccgtcgtgctcaccgcctaggtttcagtacttgttcgcctattggttttgagatctacatctgaactagtagtgctttcctgtctcagctatttgtgttaagaagacttgtagttttaaaatctgtggccgctgcctgttgttacagggcttatgaggattttgatgcaagttcatatcaaatatttcagatatattaaagct

SEQ ID NO: 3056 - DNA, 1026 bp, Setaria italica
agagagaaaaaacactccccaccaaatcctggcccagcccaatagccccttcaccccaccgcaaaaaccctagaaagcccccatcaacggccaccgctcccctatccgacatccaacggcggccgcaccacgctcccgccttataagatcacgccattcccagccgctagggtttcctcctccactccctcccccgcctccactactccccccgtcccaggcgctgcccaggtaagtcggcggcgagcggcggcggcgatgacgacccgcttcaagaagaaccgcaagaagcgcggtcacgtgtccgccgggcacggccgcatcggcaagcaccggaagcacccgggaggtcgcggtaacgccggtggcatgcaccaccaccgcatcctcttcgacaagtaccatcccggttacttcggcaaggtcggtatgcgctacttccacaagctccgcaacaagttctactgcccggcggtcaacgtcgagcgcctctggtcgatggtgcccgccgagaaggcggcggaggccggcggcgacaaggccccgcagatcgacgtcactcagttcggctacttcaaggtgctcggcaaggggaagctgccgtccaagcccatcgtcgtcaaggccaagctcatctccaaggtcgccgagaagaagatcaaggccgccggcggagccgtcgtgctcaccgcctaggtttcagtctttgtctgcctcttggttttgagatctatatctgaactagtagtgctttcctgtctcagctatttgtgttaagaagacttgctagcttttaaattgctgtggctcctgcctggtgggacagtgcttatgaggattttgcaattagtgatgtcagttcatatcaaatatcccagatatatcaatgctatcttttgctaccagttatcgcaatttcatgtgtaatcgattcgtgatgcataacctgtgatctatgatatagtgtaattcgtaactgtgcttgcattgcaatgttttctgtaagcaatgatgtgaaatgcgtgt

SEQ ID NO: 3057 - DNA, 640 bp, Zea mays
agagtttcctcctccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacaaggccccgcagatcgacgtcacgcagttcggctacttcaaggtgctcgggaagggggtgctgccgcccaagcccatcgtcgtcaaggccaagctcatctccaaggtcgccgagaagaagatcaaggccgccggcggcgccgtcgtgctcaccgcctagttttcagtccttattcgcctcttggttttgagatctatatctgaactagcagtgctttcttgtctcacctatttgtgttaagaagacgtagtttttaaatccattgctccttcctgtttggac

SEQ ID NO: 3058 - DNA, 929 bp, Zea mays
tattccatcttttctctaacgtggatcgaattgcagatggagacagttaaaagcccaccaccaccatcagatccaggcccagcccaacagccctttacacctcacagcaaaaccctaggaaagcctcatcaatggctctcgctctcccatccgtcatccaacggcggacgcatgagacacctgccttataagatcacgccattcccatctcctagggttttctccacctccctcacccgcctccactcccccctcccaggtgctgcccaggtaagtcggcggcggcgatgacaacgcgcttcaagaagaaccgcaagaagcgcggccacgtgtccgccgggcacggccgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaggcggcggaggccggcggcgacaaggccccgcagatcgacgtcacgcagttcggctacttcaaggtgctcgggaagggggtgctgccgccaaagcccattgtcgtcaaggccaagctcatctccaaggtcgccgagaagaagatcaaggcagcaggcggcgccgtcgtgctcaccgcctaggtttcagtccttgttcgcctcctggttttgaaatctatatctgaactgatagtgctttcctgtctcggcaatttgtgttaagaaaacctgtagttttaaaatatgtggttcctgcctgtttggcagtgcttatgcggtttttgatgccagttcatatcaaatatttcacatcaattaaatctatcctcgctatcagttgtgcta

SEQ ID NO: 3059 - DNA, 1191 bp, Panicum virgatum
cctgcctacccttggaaacaattcaaagcccatacctcccgaaaacggcccactaaattctggcccagtccaatagcgccttactccgtacaccccaccacaaaaaaccctagaaagccccatcaacggcccccaatccaccattcgacatccgacggcggccgcaccgcgcgcccgccttataagatcactccattcccgtctcctagggtttcctcctccactccctcccccgcctccactactcccatcccaggcgctgcccaggtaagtcggcggcgagcggcggcggcggcggcgatgacgacccgcttcaagaagaaccgcaagaagcgcggtcacgtgtccgccgggcacggccgtatcgggaagcacaggaagcaccccggtggccgcggtaacgccggtggcatgcaccaccaccgaatcctcttcgacaagtaccatccggggtacttcggcaaagtgggtatgcgctacttccacaagctccgcaacaagttctactgcccggctgtcaacgtcgagcgcctctggtcgatggtgcccgccgagaaggaggcggaggccggcgccgataaggccccgcagatcgacgtcacccagttcggctacttcaaggtgctcgggaaggggaagctgccgtccaagcccatcgtcgtcaaggccaagctcatctccaaggtcgccgagaagaagatcaaggccgccggcggcgccgtcgtgctcaccgcttaggtttcagtccttgcttgcctctgttttgagatctatatctgaactagtactgccttcctgtctcagctatttgtgttaagaagacttgctagctttttaaattgccgtggctcctgcctggtggaacagtacttatgaggatttttgcacttagtgatgccagttcatatcaaatatctcagatatatcaacgctatcttttactgccagttatcacaatttcatacgtgtaattgattcgtgatgcattacccgttatctctaatgttgtgtaattcgtaattgtaattgcattacaatattttctgttaggaaggaacggtgtgaaatgtgtgttttatggttgaaaagcctcatgtagaatgttctcttggtataaggcaatgttcaagaaaacgctaggcgctaggctaccgactagcgcctaggaagattaaatgtagattaaacgtg

SEQ ID NO: 3060 - DNA, 1196 bp, Oryza sativa
caacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcgatgacgacgagcctgaggaagaaccgcaagaagcgcggccacgtgtccgccggccacggccgcatcgggaagcaccggaagcacccgggaggccggggcaacgccggaggcatgcaccaccaccgcatcctcttcgacaagtaccacccgggctacttcggcaaggtcggcatgcgctacttccacaggctccgcaacaagttctactccccggcggtgaacgtggagcggctctggtcgatggtgcccgccgagcaggcggcggaggccgccggcgccggcaaggcgcccctgctggacgtgacgcagttcggctacttcaaggtgctcgggaagggtctgctgccggagaagcccatcgtcgtcaaggccaagctcatctccaaggtcgccgagaagaagatcaaggccgccggcggcgccgtcgtgctcaccgcctagggtttggtcctggccctgccttttgttctgcttcttggtttttgagatctattaatctgaagtagtagtcgtttcttgtctcaagctatttgcgttaagaagacttgattagtttgttttctactgtacttcttgcatgttaagacagtacgttatgagaatttttgcactaagcgatgccagttcatgtcagatgcttcagatatatcaatgctattttgtgctgccaattatgattcgttcgatctgacttggcatgcccgcgttatattagatcgtctgatcatgttatgtacttgtctgccaaattatgtggatggtaaggttcacattagttttgatctggcctctgcattatgcttcattacaaatttacaattatctgaaatatgttgagaaatgtatgatgttcctgataagaacccatatttataagttaactgtagacatgtactagtaataagcatgttgaatacttcgggttctgccatgttctggattatcttttagccatatttctgaaaattagatgtaaacctatagcaagcgctgtttgggttctgtgc

SEQ ID NO: 3061 - DNA, 1638 bp, Brachypodium distachyon
atcagcccaccaacgctcggccgcaccaaaccaaaaccctaggagtccccatctaacggcccccacgacccttctcgcgatccgacggtctaaacaccattcacaaccttataagttctcaccattccccacccgctagggtttcctcccacacatccgcccgcctccactccacccgttccccaaaccctccccaggtaagcccgcggcggcggcgaccggcggccatgacgacccgcttcaagaagaaccgcaagaagcgcggccacgtctccgctgggcacgggcgtatcggcaagcaccgcaagcatcctggaggccgcggtaacgcaggtggcatgcaccaccatagaatcctcttcgacaagtaccatcctggttacttcggcaaggtcggtatgcgctacttccacaagctccgcaacaggttttactgcccgtcggtgaacgtggagaggctctggtccatggtgccggccgagaaggcggccgaggccggaggcgacaaggcccccgtggtggacgtctcgcagttcggctacttcaaggtgctgggcaaggggctgctcccggagaagcccatcgtcgtcaaggccaagctcatctccaaggtcgccgagaagaagatcaaggccgccggcggcgccgtcgtgctcgttgcctagggttcctgccttttaaccctgccttgtttttatctcggctcttgagatctgaatctgaactagtagttgtttccagtcctgctattcgtgttaaagaagacttgttagtttctcttatcctggttctgcttggtaaaacatctgcttatgagaatttttgcactatgtgatcagtttatatcagatatatcatcctatctgtattgtttgatctgtgtaatttgtctgtgatgcatggtccgctgtttatggtcaacttagtcttgcgaccctacaccagattttagttaggttgaccatgtgagctgcgattctagtttgcttggcgtgtaatgtttatgtgcaatttggtatgctatgcatgttctattggatgacgaaactaaattgttaatactggttgatggttaggttgctaacgttagtcttaagagttcataccgtagtttacgtgacatagacatgttggcatttactccccctgatcctaaattcttgacttaaatttgcccaaatatggatgtatctattcataaaaagcgtctagatacatgtaatatttcgacaataatttaggatcggtgggagtagttcaacacaatgcataatttttgtattttacctgtggaaattgttacaggctaagttagcaatgtgctttcatttaaaactgttaaatgacatccgtggtttttgtagcttgattttttatgaagccattgtgtcatgtctatttgccgaagttgtaacccagaaccaacatgcagttagtactatgttcctaggacagatagcaacatgttccaagttcgtatctttctcaactacacatgaaattcttgttggattattcattattgcctttcatggctttcttctgttgtttgtggtgcataatagcatgtatggatatgtagtaagtggaaatcttcaacataggacaattttttcgtactgttagacaccagtagat

SEQ ID NO: 3062 - DNA, 767 bp, Pennisetum glaucum
ggcgatgacgacccgcttcaagaagaaccgcaagaagcgcggtcacgtgtccgccgggcacggccgcatcggcaagcaccggaagcaccctggaggtcgcggtaacgccggtggcatgcaccaccaccgcatcctcttcgacaagtaccatcccggttacttcggcaaggtcggtatgcgctacttccacaagctccgcaacaggttccactgcccggccgtcaacgtcgagcgcctctggtcgatggtgcccgccgagaaggcggcggaggccggcggtgacaaggccccgctcatcgacgtcagtcagttcggctacttcaaggtgctcggcaaggggaagctgccggaaaagcccatcgtcgtcaaggccaagctcatctccaaggtcgccgagaagaagatcaaggccgctggcggagccgtcgtgctcaccgcctaggtttcagtccttgtccgcctcttggttttgagatctatatctgagtagtgcgttactgtctcagttatttgtgttaaaaagacttgctagcttttaaattgctgttgctactgcctggtggggcagtgcttatgaggattttgaaagtagtgatgtcagtccatatcaaatatctcggatatatcgatgctatcttttgctatcagctatcgcaatttcttgtgcgtcgattcgtgatgcatcacctgtgatttatgatgtagtttaattcttaactgtggttgcatcacaatgttttctgttagagatgatgtgaaatgagtgt

SEQ ID NO: 3063 - DNA, 1095 bp, Panicum virgatum
cctgggctgatttgcagcgtcaggtgaaccaaagggcctgcctaccgttggaaacaattcgaagcccatacctcccgaaaacggcccaccacattctggcccagtccaatagcgccttacaccccaccacaaaaaaccctagaaagccccatcaacggtccacgttcccccatccgacatccgacggcagccgcaccacgcgcccgccttataagatcactccattccctgctcctagggtttcctcctccactccctcccccgcctccactactcccctcccaggcgctgcccaggtaagtcggcggcgatgacgacccgcttcaagaagaaccgcaagaagcgcggtcacgtgtccgccgggcacggccgtatcgggaagcacaggaagcaccccggtggccgcggtaacgccggtggcatgcaccaccaccgcatcctctttgacaagtaccatccggggtacttcggcaaggtgggcatgcgctacttccacaagctccgcaacaggttcacttgcccggctgtcaacgtcgagcgcctctggtcgatggtgcccgccgagaaggcggcggaggccggcgccgacaaggccccgcagatcgacgtcacccagttcggctacttcaaggtgctcgggaaggggaagctgccgtccaagcccatcgtcgtcaaggccaagctcatctccaaggttgccgagaagaagatcaaggccgccggcggcgccgtcgtgctcactgcctaggtttcagtccttgtctgcctcggttttgagatctatatctgaactagtagtgctttcctgtctcatctatttgtgttaagaagacttgctagcttttaaattgctctggctcctgcctgggagagtgcttatgaggatttttgcacttagtgatgtcagttcatatcaaatatctcagatatatcaacgctatcttttactaccagttatcacgatttcatgtgttatcaattcgtgatgcattacctgttatcttgcttcagtgtaattgtgattgcattacagtattttctgttaggaaccggtttgaagtgcacgttttgtggttgataaggctcatgttgcag

SEQ ID NO: 3064 - DNA, 1179 bp, Brachypodium distachyon
accggacgctataaagtccacgcgatcccgcagctctcctctttcccttctctcatccaccgccgccgaaaccacaagaaagccagagaagaacctcagctccgcccgccgcaatgacgacgcgcttcaagaagaaccgcaagaagcgcggccacgtctccgccgggcacggccgtatcggcaagcaccgcaagcatcccggaggtcgcggtaacgcaggtggcatgcaccaccaccggatcctcttcgacaagtaccatccgggctacttcggcaaggtcggcatgcgctacttccacaagctccgcaacaggttccactgccccaccgtcaacgtcgagcgcctctggtcgatggtgccggctgacaaggccgccgaggccgccggtgcccccaacaaggcgcccgtcgtggacgtgtcgcagtttggctacttcaagatcctcggcaaggggatgctgccgcccaacacgcccatcgtcgtcaaggccaagctcatctccaaggtcgctgagaagaaaattaaagcggccggcggcgctgtcttgctcaccgcctaggtatgtatggttggcagactcgcggagagggatgagaaaggaatgctcttggcctgctcgaatctaaggggctagtttcttaatacttctgttcaaagacttcgatttagttctaccttttgtcatcgatgttactgtatggtatggctacttggatctgtggtgggttatcagatgttttcaattcaatgatcatgctggtttatataagatatttcagataatgtgccttgtttatgttatctacattagtaatagtatactatcgttgcatctgaaactgcaatatggcccattgtgtgcattgagaaccaattttgttttaagttctgattggtagatccggtttactgcttttgggttggatgtgcatttaagattggtttgccccctcagggctggctgaatgtgtatctatgtttggttgttctgccgcattggctggagaaatcgtttcaactttgtaggttgcaagttgtatgtgtactttgagttgtatttgtctattgttgcttggagtatgcacgacaatttgcaatgtgattacctggccatagttttgtttatttgtttggatgttttgtagattacctttgtagttttggctgattggaatgtg

SEQ ID NO: 3065 - DNA, 604 bp, Festuca arundinacea
cggcggccatgacgacgcgcttcaagaagaaccgcaagaagcgcggccacgtgtccgccgggcacgggcgtgtgggcaagcaccgcaagcaccctggaggccgcggtaacgccggaggcatgcaccaccaccgcatcctcttcgacaagtaccatcccggctacttcggcaaggtcggtatgcgctacttccacaagctcagcaacaggttctactgcccgtcggtcaacgtggagaggctctggtcgatggtgccggccgagaaggtggccgaggcgggagccgacaaggcccccgtgctcgacgtctcccagttcggctacttcaaggtgctcggcaagggcctgctccccgacaagcccatcgtcgtcaaggccaagctcatctccaagatcgccgagaagaagatcaaggccgccggcggcgccgtcgtgctcgttgcttagggttctgtgctttattaccctgccttgtctttatcttggttttgagatctaaatctgaactagtagttgtttcctgtcgaagctatttgtgttgaacaagacttgattagttttctatcctgcttcctttgttgaaagacagcgaattatgagagttt

SEQ ID NO: 3066 - DNA, 727 bp, Avena sativa
gagacacctgcccgcctccaccccacccccaaccctctcaggtaagccagcggcggcggcgagcagcggcggccatgacgacgcgcttcaagaagaaccgcaagaagcgcggccacgtgtccgccgggcacgggcgtgtgggcaagcaccgcaagcatcctggaggtcgcggtaacgccggaggcatgcaccaccaccgcatcctcttcgacaagtaccatcccgggtacttcggcaaggtcggtatgcgctacttccacaaactcagcaacaggttctactgcccgtcggtgaacgtggagaggctctggtcgatggtgcccgccgagaaggtggctgaggccggagctgacaaggccccagtgctcgacgtctcgcagttcggctacttcaaggtgctcggcaagggtctgctgcccgacaagcctatcgtcgtcaaggcgaagctcatctccaagatcgccgagaagaagatcaaggccgccggtggcgccgtcgtgctcgttgcctagggttctgtcctgaccctgccttgtcattatcttggttttgagatctatatctgaactagtagttgtttcctgtcgaagctatttgtgttgaacaagacttaattagttctctatcctgcttcctgtgttgaaagacgtcaaattatgagaattttgcagtatgtggttccagactatatcatatatttcagaaatatcatctctatgagttgtgc

SEQ ID NO: 3067 - DNA, 703 bp, Avena sativa
cccacccccaacccctctcaggtaagccagcggcggcgagcagcggcggccatgacgacgcgcttcaagaagaaccgcaagaagcgcggccatgtgtccgccgggcacgggcgtgtgggcaagcaccgcaagcatcctggaggtcgcggtaacgccggaggcatgcaccaccaccgcatcctcttcgacaagtaccatcccgggtacttcggcaaggtcggtatgcgttacttccacaagctcagcaacaggttctactgcccgtcggtgaacgtggagaggctctggtcgatggtacccgccgagaaggtggctgaggccggcgctgacaaggccccggttctcgacgtctctcagttcggctacttcaaggtgctcggcaagggtctgctgcccgacaagcctatcgtcgtcaaggcgaagctcatctccaagatcgccgagaagaagatcaaggccgccggcggcgccgtcgtgctcgttgcctagggttctgtcctgaccctgccttgtcgttatcttggttttgagatctatatctgaactagtagttgtttcctgtcgaagctatttgtgttgaacaagacttaattagttctctgtcctgcttcctgtgttgaaagacagcaaattatgagaattttgcagtatgtggttccagactatatcatatatttcagaaatatcatctctatgcgttgtg

SEQ ID NO: 3068 - DNA, 733 bp, Avena sativa
cacctgcccgcctccaccccacccccaacccctctcaggtaagccagcggcggcgagcagcggcggccatgacgacgcgcttcaagaagaaccgcaagaagcgcggccacgtttcagccgggcacgggcgtgtgggcaagcaccgcaagcatcctggaggtcgcggtaacgccggaggcatgcaccaccaccgcatcctcttcgacaagtaccatcccgggtacttcggcaaggtcggtatgcgttacttccacaagctcagcaacaggttctactgcccgtcggtgaacgtggagaggctctggtcgatggtgcccgccgagaaggtggccgaggccggcgctgacaaggctccggtgcttgacgtctcgcagttcggttacttcaaggtgctcggcaagggtctgctgcccgacaagcctatcgtcgtcaaggcgaagctcatctccaagatcgccgagaagaagatcaaggccgccggcggcgccgtcgtgctcgttgcctagggttctgtcctgaccctgccttgtcattatctttgttttgagatctatatctgaactagtagttgtttcctgtcgaagctatttgtgttgaacaagacttaattagttctctatcctgcttcctgtgttgaaagacagcaacaaattatgagaattttgcagtatgtgttgccagactatgtcatatatgtcagaaatatcatctctatgcgttgtgctaaaaaaaa

SEQ ID NO: 3069 - DNA, 721 bp, Avena sativa
ctgcccgcctccaccccacccccaacccctctcaggtaagccagcagcggcggccatgacgacgcgcttcaagaagaaccgcaagaagcgcggccatgtgtccgccgggcacgggcgtgtgggcaagcaccgcaagcatcctggaggtcgcggtaacgccggaggcatgcaccaccaccgcatcctcttcgacaagtaccatcccgggtacttcggcaaggtcggtatgcgttacttccacaagctcagcaacaggttctactgcccgtcggtgaacgtggagaggctctggtcgatggtacccgccgagaaggtggctgaggccggcgctgacaaggccccggttctcgacgtctcgcagttcggctacttcaaggtgctcggcaagggtctgctgcccgacaagcctatcgtcgtcaaggcgaagctcatctccaagatcgccgagaagaagatcaaggccgccggtggcgccgtcgtgctcgttgcctagggttctgtcctgaccctgccttgtcattatcttggttttgagatctatatctgaactagtagttgtttcctgtcgaagctatttgtgttgaacaagacttaattagttctctatcctgcttcctgtgttgaaagacagcaacaaattatgagaattttgcagtatgtgtttccagactttatcatatatttcagaaatatcatctctatgcgttgtgctaaaaaaaaa

SEQ ID NO: 3070 - DNA, 971 bp, Oryza sativa
cttcgcctcttccctcccaccccgccggcccccgcctccgccgccgcgccgctcgcaactccgccgctgccatgacaacgcgcttcaagaagaaccggaagaagcgcggccacgtgtcggccgggcacgggcgcatcgggaagcaccgcaagcaccccggaggccgcggtaacgccggagggatgcaccaccaccggatcctgttcgacaagtaccacccgggctacttcggcaaggtcggcatgcgctacttccacaagctcagcaacaggttccactgccccgccgtcaacgtcgagcgcctctggtccatggtgcccaccgacaaggccgccgaggccggcgccggcaaggcccccgtcatcgacgtcacccagttcggctacaccaaggtgctcggcaaggggatgcttcccccgcagaggcccatcgtcgtcaaggccaagctcatctccaaggtcgccgagaagaagatcaaggccgccggcggcgccgtcctcctcaccgcctaggtactacatacttgggagttgagttggagggaggagggttcttgatatctaaggcgctagtttctttatccttcaaaagactttgatttagctcttgtgctttttctgttatggatgttactactgtatggtatggctacttgaatctgtggtggcaattcaggagttttgaattacatgattatgccggtctatatcaatatttgcgtctgccgcgtgctaatctgattgctacatgatcttgcagggttatatgataattatttttaatgttgaatcatttgctttattgcattgcgtatctgatgctaattttgcattggtgaaccagatacatggtcatggggagggttaaatctagttttataacatgttaggattttgccttgtttagtgtgttctagggtaactcttatggtgtggctgtattttctaatcttaaaattatcatgcagtaat

SEQ ID NO: 3071 - DNA, 887 bp, Hordeum vulgare
agggattcctcccacacacctccgcctccaccccacccgtcccgacccctctcccccaaggtaagccagcggcggcggcggcgatgacgacccgcctcaagaagaaccgcaagaagcgcggccacgtctccgccgggcacgggcgtgtgggcaagcaccgcaagcatcccggaggccgcggtaacgccggaggcatgcaccaccaccgcatcctcttcgacaagtaccatcccggctacttcggcaaagtcggtatgaggtacttccacaagctcagcaacaggttctacaccccgaccgtcaacgtcgagaggctctggtccatggtgccgtccgacaaggccgcggaggccggcggcgacaaggcccccgtcgtcgacgtctcgcagttcggctacttcaaggtgctcggcaaggggatgctgccggagaagcccatcgtcgtcaaggccaagctcatctccaagatcgccgagaagaagatcaaggccgccggcggcgctgtcgtgctcgtcgcctagggttctgttccccaccgtgctctgagatctatatcttaagtactagtttttctcgtaccagcaatttgtgttgaacaagacatcgttagtttgttattctggttcctgtgtggtaaaccaaactcatgagaattttgcgctatgttatgccaatttatatcagacgagttatcatcatatctgtgctcctatttatgctgagtttgatctttgttaatcgttatcgatctctgttgcatacgtttatttgacatcctgcatctttacggcattctatggctgctagtcgtgtgacatctaacatgtgaactgtatgattttgatgtacactgtcatgccagtttatattagccatgcctcctgttt

SEQ ID NO: 3072 - DNA, 698 bp, Avena sativa
cccaaccaccgccgccgaaaccccaatcaaaggaccgccatgacgacgagcttgaagaagaaccgcaagaagcgaggccacgtctccgccgggcacgggcgtgtcggcaagcaccgcaagcatcccggaggtcgcggtaacgccggtggcatgcaccaccaccgcatcctcttcgacaagtaccatccgggatacttcggcaaggtcggcatgcgctacttccacaagctcagcaacaggttccactgccccaccgtcaacgtcgaccgcctctggtccatggtgccggccgacaaggccgcggaggccgccgcttcccccgacaaggcccccgtcatcgacgtctcgcagttcggctacttcaagatcctcggcaaggggatgctgccgccaaacacgcccatcgtcgtcaaggccaagctcatctccaagatcgccgagaagaagatcaaggccgcgggcggcgctgtcttgctcaccgcctaggtacgtaagggccggccgacgcaggtggagggacgagcgggagcagattggactagtttctttatccttgtgttgaaaactttcgatttagttctaccttttttgtgttaagaacattgctatatggtggtatggctgcttggatctgtggtgtcttgtcagatgttctaaattcagttatcatgccgatttatatcagatatatgcgcctt

SEQ ID NO: 3073 - DNA, 644 bp, Cynodon dactylon
ccgggggcaacctccccgcctcactcccctcctctccaagcgctgcccaggtaagtcggcggccggcggcgagcggcgatgacgacgcgcttcaaaaagaaccgcaagaagcgcggccacgtgtccgccgggcacggtcgcatcggcaagcaccgcaagcacccgggaggtcgcggccccgccggtggcatgcaccaccaccgcatcctcttcgacaagtaccatcccgggtacttcggcaaggtcggtatgcgctacttccacaagctccgcaacaagttctactccccggccgtcaacgtcgagaagctctggtccatggtgccggccgataaggccgcggaggctgccgctggcgccgacaaggccccgctcatcgacgtcacgcagttcggctacttcaaggtgctcgggaagggaaggctgccggacaagcccatcgtcgtcaaggccaagctcttctcctaggtcgccgaaaagaagatcaaggaagccggcggcgccggcgtgctcaccgcttaggttcctgtctcttgagatctttatctgaacgtgtagtgggctatcgtcttatctatttgtgttaaagacttgctagtttcgaatttgttgtgactcctatctggccagtgccttatgaggat

SEQ ID NO: 3074 - DNA, 612 bp, Cenchrus ciliaris
  misc_feature (75)..(75): n is a, c, g, or t
  misc_feature (109)..(109): n is a, c, g, or t
  misc_feature (138)..(138): n is a, c, g, or t
  misc_feature (183)..(183): n is a, c, g, or t
  misc_feature (186)..(186): n is a, c, g, or t
  misc_feature (194)..(194): n is a, c, g, or t
  misc_feature (196)..(196): n is a, c, g, or t
  misc_feature (199)..(199): n is a, c, g, or t
  misc_feature (207)..(207): n is a, c, g, or t
  misc_feature (210)..(210): n is a, c, g, or t
  misc_feature (217)..(217): n is a, c, g, or t
  misc_feature (220)..(220): n is a, c, g, or t
  misc_feature (249)..(249): n is a, c, g, or t
  misc_feature (268)..(268): n is a, c, g, or t
  misc_feature (298)..(298): n is a, c, g, or t
  misc_feature (376)..(376): n is a, c, g, or t
  misc_feature (421)..(421): n is a, c, g, or t
  misc_feature (437)..(437): n is a, c, g, or t
  misc_feature (442)..(442): n is a, c, g, or t
  misc_feature (478)..(478): n is a, c, g, or t
  misc_feature (494)..(494): n is a, c, g, or t
  misc_feature (511)..(511): n is a, c, g, or t
  misc_feature (548)..(548): n is a, c, g, or t
  misc_feature (551)..(551): n is a, c, g, or t
  misc_feature (569)..(569): n is a, c, g, or t
  misc_feature (581)..(581): n is a, c, g, or t
  misc_feature (608)..(608): n is a, c, g, or t
atcccccgggtggcgggccaacccacagcactcggcggcggcggcgagcgcgagcggtgaggcgatgacgacgancctgaagaagaaccggaagaagcgcggtcacgtntccgcggggcacggccgcatcggcaagcnccggaagcaccccggaggtcgcggtaacgccggtggcatgcaccnccnccggatcntnttngacaagtnccncccgggntanttcggcaaggtcggcatgcgctacttccncaagctccgcaacaggttntactgcccgtccgtcaacgtcgagcggctntggtcgatggtgcccgccgacaaggccgcggaggccggtggggacaaggccccgctcgtggacgtgacgcagttcggntacttcaaggtgctcggcaaggggatgctgccgcccaagcccatngtcgtcaaggccaagntcatntccaaggtcgccgagaagaagatcaaggccgccggnggcgccgtcgtgctcnccgcataggtcgttttncattcttgttttatctttctgtcagcggcaagagaanttntaaatttgttatggatgntaagagaacttntaaattttgttatggatcccgttgtgngcca

SEQ ID NO: 3075 - DNA, 652 bp, Secale cereale
cggcgagcgagcggcgcgatgacgaccggcttcaagaagaaccgcaagaagcgcggccacgtgtccgccgggcacgggcgtgtgggcaagcaccgcaagcatcctggaggccgcggtaacgccggaggcatgcaccaccaccgcatcctcttcgacaagtaccatcccggctacttcggcaaggtcggtatgcgctacttccacaagctcagcaacaggttctacaccccgacgatcaacgtcgagaggctctggtccatggtgccggccgacaaggcggcagaggccggcggcgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgcagtcgtgctcgttgcctagggtttctgttcgcgaccgtgcctcgagatctatatctgaaatattagttgtttcccgtatctgaactatttgtgttgaacaagacatcgttagtttgttatcctggttcctgtgtggtaaaccaacatcttatgagaattttgcgctatgtcatggcagtttatatcagacgagttatccatatctgttctcctat

SEQ ID NO: 3076 - DNA, 758 bp, Secale cereale
cctcccgtcccgaccctctcctccagtaagccgcggcggcggcgagcgagcggcggcgatgacgacccgcttcaagaagaaccgcaagaagcgcggccacgtgtccgccggccacgggcgtgtgggcaagcaccgcaagcatcctggaggccgcggtaacgccggaggcatgcaccaccaccgcatcctcttcgacaagtaccatcccggctacttcggcaaggtcggtatgcgctacttccacaagctcagcaacaggttctacaccccgacgatcaacgtcgagaggctctggtccatggtgccggccgacaaggcggcagaggccggcggcgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgcagtcgtgctcgttgcctagggtttctgttcgcgaccgtgcctcgagatctatatctgaagtattagttgtttcccgtatctgaactatttgtgttgaacaagacatcgttagtttgttatcctggttcctgtgtggtaaaccaacatcttatgagaattttgcgctatgtcatggcagtttatatcagacgagttatccatatctgttctcctatttatgctttgtttgatatgtgttacttatttgttatcgatccctaatgcatatactgttgcttgct

SEQ ID NO: 3077 - DNA, 949 bp, Pseudoroegneria spicata
  misc_feature (300)..(300): n is a, c, g, or t
  misc_feature (940)..(940): n is a, c, g, or t
  misc_feature (942)..(942): n is a, c, g, or t
  misc_feature (944)..(945): n is a, c, g, or t
cccctctcctgcaaggtaagcccgcgccggcggcgagcgagcgagcggcggcgatgacgacccgcttcaagaagagccgcaagaagcgaggccacgtgtccgccgggcacgggcgtgtgggcaagcaccgcaagcatcctggaggtcgcggtaacgccggaggcatgcaccaccaccgcatcctcttcgacaagtaccatcccggctacttcggcaaggtcggtatgcgctacttccacaagctcagcaacaggttctacaccccgacgatcaacgtcgagaggctctggtccatggcgncggcggcgagcgagcgagcggcggcgatgacgacccgcttcaagaagaaccgcaagaagcgaggccacgtgtccgccgggcacgggcgtgtgggcaagcaccgcaagcatcctggaggtcgcggtaacgccggaggcatgcaccaccaccgcatcctcttcgacaagtaccatcccggctacttcggcaaggtcggtatgcgctacttccacaagctcagcaacaggttctacaccccgacgatcaacgtcgagaggctctggtccatggtgccggccgacaaggcggcagaggccggcggcgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgcagttgtgctcgttgcctagggttctgtcccgaccgtgccctgtccttaatcttggatttgagatctatatctgaactattagttgtttccagtaccagtattttgtgttgaacaagacatcgttagtttgttatcctggttccagtgtggtaaaccaacatcttatgagaattttgtgctatgttatgccagttnanannaaaa

SEQ ID NO: 3078 - DNA, 942 bp, Triticum aestivum
caacaatagcatgctatagttactttaatgggtagctgcgccttgacaatggtgtggttttctgttaacattactttcatagtattgttccgtcccgctccactccaacaaatccgtttatttcccgccagaccggttatcaccattccggcccggatttttttggatttttttccggggagcacccgggacgagattaaaatcggtatggcctccaccccacccgccccgacccctctcctccaaggtaagcccgcggcggcggcgagcgagcggcggcgatgacgacccgcttcaagaagaaccggaagaagcgcggccacgtgtccgccgggcacgggcgtgtgggcaagcaccgcaagcatcccggaggccgcggtaacgccggaggcatgcaccaccaccgcatcctcttcgacaagtaccatcccggctacttcggcaaggtcggtatgcgctacttccacaagctcagcaacaggttctacacaccgacggtcaacgtcgagaggctctggtccatggttccgtccgagaaggcggcggaggccggcggcgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgctgtcgtgctcgttgcctagggttctgttcgcgaccgtgccttgagatctattatatctgaactattagttgtttcccgtaccagcaatttgtgttgaacaagacatcgttagtttgttatcctggttcctgtgtggtaaaccaacatcttatgagaattttgcgctatgttatgccagtttatatcagacgagttatccatatctgtgctcctatttatgcttcgtttgatctgtgttaatc

SEQ ID NO: 3079 - DNA, 524 bp, Lolium multiflorum
cgccgacaccccaaaccgacgaaaccccaaccccggccgccgccatgacgacgagcatgaagaagaaccgcaagaagcgcggccacgtctcggccgggcacgggcgtgtcggcaagcaccgcaagcatcccggaggtcgcggtaacgccggtggcatgcaccaccaccgcatcctcttcgacaagtaccacccgggctacttcggcaaggtcggcatgcgctacttccacaagctcagcaataggttccactgccccaccgtcaacgtcgaccgcctctggtccatggtgcccgccgacaaggccgccgaggccgccgccacccccggcaaggcccccgtcatcgacgtctcgcagttcggctacttcaagatcctcggcaagggcatgctcccgcccaacacgcccatcgtcgtcaaggccaagctcatctccaagatcgccgagaagaagatcaaggccgcgggcggcgccgtcttgctcaccgcctaggtacgtaagggccggcggacgcagggacagaga

SEQ ID NO: 3080 - DNA, 748 bp, Panicum virgatum
cactccctccccccgcctccactactcccccttccccagccgctgccccaggtaagtcggcggcgagcggcggcgatgacgacccgcttcaaagaagaacccgcaagaaagcgccggtcacgtgtccgcccgggcacggccgtatcgggaagcacaggaagcaccccggtggccgcggtaacgccggtggcatgcaccaccaccgcatcctctttgacaagtaccatccggggtacttcggcaaggtgggcatgcgctacttccacaagctccgcaacaggttcacttgcccggctgtcaacgtcgagcgcctctggtcgatggtgcccgccgagaaggcggcggaggccggcgccgacaaggccccgcagatcgacgtcacccagttcggctacttcaaggtgctcgggaaggggaagctgccgtccaagcccatcgtcgtcaaggccaagctcatctccaaggttgccgagaagaagatcaaggccgccggcggcgccgtcgtgctcactgcctaggtttcagtccttgtctgcctcggttttgagatctatatctgaactagtagtgctttcctgtctcatctatttgtgttaagaagacttgctagcttttaaattgctctggctcctgcctgggagagtgcttatgaggatttttgcacttagtgatgtcagttcatatcaaatatctcagatatatcaacgctatcttttactaccagttatcacgatttcatatgtgttat

SEQ ID NO: 3081 - DNA, 568 bp, Festuca arundinacea
ggcacgaggaagaaccccaaccccggccgccgccatggcgacgagcatgaagaagaaccgcaagaagcgcggccacgtctcggccgggcacgggcgtgtcggcaagcaccgcaagcatcccggaggtcgcggtaacgccggtggcatgcaccaccaccgcatcctcttcgacaagtaccacccgggctacttcggcaaggtcggcatgcgctacttccacaagctgagcaacaggttccactgccccaccgtcaacgtcgaccgcctctggtcgatggtgccagccgacaaggccgcggaggccgccgccacccccggcaaggcccccgtcatcgacgtgtcgcagttcggctacttcaagatcctcggcaaggggatgctcccgcccaacacgcccatcgtcgtcaaggccaagctcatctccaagatcgccgagaagaagatcaaggcagcgggcggcgccgtcttgctcactgcctaggcacaaggctacagaaaactgctgaattggcaaaatttggtgctatcatagtatccgctaagttcacgggctggagataagcggact

SEQ ID NO: 3082 - DNA, 456 bp, Panicum virgatum
cccaccactcctccccttccaaccccagcacccggcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggaga

SEQ ID NO: 3083 - DNA, 771 bp, Oryza sativa
ccccttcttcctccccacccacccgccgccgccgtcgccgcccttcgccgccgccatgacgacgaggttcaagaagaaccggaagaagcgcgggcacgtgtcggccgggcacgggcggatcgggaagcaccggaagcacccgggagggcgcgggaacgccggcgggatgcaccaccaccgcatcctgttcgacaagtaccacccgggctacttcggcaaggtcgggatgcgctacttccacaggctcagcaacaggttccactgccccgccgtcaacgtcgagcgcctctggtccatggtgcccgccgaggccggcgccggcgccggcaaggcccccgtcatcgacgtcacgcagttcggctacaccaaggtgctcggcaaggggatgctccccccagagaggcccatcgtcgtcaaggccaagctcatctccaaggtcgccgagaagaagatcaaggccgccggcggcgccgtcctcctcaccgcctaggtactcgggagctagggttcttggcttcttgctatctatctaaagtgttagcttctttttttatctcttgttgtgttggaagacaaagcaaagaaagactacttttgtgctgttgctgctgttttttgtgttatggaacaaattgatggtatggctactaagatctgtggtggctattcatgagttttgattgaattacatgatcatgtaggtttatgtcaaatatttttgtgccgcatatcattctgattattattcttgatatcgaaatgctattggga

SEQ ID NO: 3084 - DNA, 3231 bp, Oryza sativa
ggaaaaagggaggccgcgtcgcattgcgtcgtcgtcgtcgtcgttgtcgtccgtagcgggagggagggagagagtacgtgcgggcgtccggaggtctcagcgcacgcccgcggccgggccgtcgcgccgatcgcgatggggtcgtggcggcgcaaggcctacggcgccctcaaggactccaccaaggtcggcctcgccaaggtcaacagcgacttcaaggagttggatattgcaattgtgaaggccaccaaccatgtagaatgccctcccaaggacaggcacgttagaaaaatattcgtggcgacctccattaaccgccctcgagcggacgttcaatactgcatctatgccttgtcaaggagattgtccaagacaaagaattggacagttgcattgaagacattgatagtggtacataggctcttgagagaaggtgatcctacattcaaagaagagttcctggcctactcatacaagggaagcgttttgcagagagcaaacttcaaggacgattcaagccaattagcttgggattgctctgcgtgggttcgcgcctacgcgctcttcctagaagaacggctcgagtgtttcaggatcttgaaattcgacatcgaaaccgagcgtctgatgagatctcctgagtgttccagcaaggcacacagtagaactagaaccctgccttgcattgaacttctggagcagttgcctgccttgcagcagctacttttcaggctaattggctgccagcctgaaggtgcagcaggcacgaactaccttatccaatatgcattagccctggttttgaaggagagcttcaagatctactgtgcaatcaatgatggtatcatcaatcttgttgatatgttctttgatatgccaaagtatgatgctatcaaggctcttgttgtctataaacgagctggccagcaggctgaagatctttctgacttctacgattcctgcaaacaacttgagcttgccaggacattccagtttcctactctaaggcagccaccatcatcattcattgcaacaatggaagagtacatccgagaagcaccccgtccctcgattaacagcgtggagaatggtgagaggaagctagtgacctacgaccaagaagctacagaggagtctgaaaaaccagcagaagaggagaaagatgagcctgcagagtctgaacaagaacaagagcctaaacaagaaccaaagccaccagaaaccactggagatctactaaacttggatgcagaggtgagtccattggttgcagaactggaagaaaacaacgcatgggccctagcaattgtgggaacaggtgatcaaactaaggcatcaacttccctggacttgttttctggcaacacatctgggtgggagcttgcactggtcactgctccaagcagcaccagccaaacagttcaaaccaaattggctggaggctttgacaagctgctactcgacagcctctacgaagacgagacgaggcggcggcagatcgccggagtcacctacaccggtagcattggaggaggagcacccaaccctttcgacaccaacgatccatttgctacgtcgagcagcttcttgcccccatccaatgtccagtttgcaatgctgaaccagcagcagcatcagtactaccagtctcaacaccagcaacaatactaccagcctcatcatttccaggatcatcaacatcaccataacatgtattttcagacacattatcaacaaaatcagatataccaacaacagcagcagcagcagcatcagtaccctgcacctcaggctggatcttccaatccgtttggtgaccctttcggtgacctcgtaccaatggcaatggctgtctctcaaaaacatggacattcaagtttgatatgaatttgccatattcatgttgttaatgatcccaggcaattttaacatagatgggttaacttagtcaccttctcacttgacttgagtagagcatcttgtacaacttgatcttcttcgtgctaacttgagaattatgatgctgtatttgccatctcgctctcttgcaatatccacatttactcgaaccattgtagatttgtgatgctaatctagtgttgatcccaaatacaatggtataacctgaataataacaccggtataatcccaacaaattctactattaaaatttgctgctctattaaaaatatattagagtgaactgcatccttatatgtgcattaggttacgccaaaatccaaggcaaatccaaatgcattaggttggcatccgcatctgacaggcaatacagatactacatggcaaatcttgatgcgacaaaccatccattcccaatagcatttcgatatcaagaataataatcagaatgatatgcggcacaaaaatatttgacataaacctacatgatcatgtaattcaatcaaaactcatgaatagccaccacagatcttagtagccataccatcaatttgttccataacacaaaaaacagcagcaacagcacaaaagtagtctttctttgctttgtcttccaacacaacaagagataaaaaaagaagctaacactttagatagatagcaagaagccaagaaccctagctcccgagtacctaggcggtgaggaggacggcgccgccggcggccttgatcttcttctcggcgaccttggagatgagcttggccttgacgacgatgggcctctctggggggagcatccccttgccgagcaccttggtgtagccgaactgcgtgacgtcgatgacgggggccttgccggcgccggcgccggcctcggcgggcaccatggaccagaggcgctcgacgttgacggcggggcagtggaacctgttgctgagcctgtggaagtagcgcatcccgaccttgccgaagtagcccgggtggtacttgtcgaacaggatgcggtggtggtgcatcccgccggcgttcccgcgccctcccgggtgcttccggtgcttcccgatccgcccgtgcccggccgacacgtgcccgcgcttcttccggttcttcttgaacctcgtcgtcatggcggcggcgaagggcggcgacggcggcggcgggtgggtggggaggaagaagggggaggtgggagagtgagtggggtgtttatagtgttcggtgaaggggtatcggccgttggatcgtgaggaggggtgatcttgaccgttggatggatgcgggaggggctcgattagggtttttgagggtgag

SEQ ID NO: 3085 - DNA, 557 bp, Catharanthus roseus
ctcctctgccgctatctcgaataaccctagcagaaatccgccatgacaaccaggttcaagaagaacaggaagaagagaggccatgtcagcgccggccacgggcgtatcggaaaacaccgaaagcatcccggaggaagaggtaatgctgggggtatgcatcaccacagaatcctcttcgacaaataccatcctgggtattttggaaaagttggtatgaggtacttccacaagcttaggaacaaattctattgcccgattgttaacgtcgacaagctctggtcgatggttcctcaggatgtcaaagaaaaggccacaaaggataatgctcctgtgattgacgttactcaatttggatacttcaaggttttgggtaagggtgttcttcctgaaaatcaaccttttgttgttaaagctaagcttatttctaagaccgccgagaagaaaattaaggaggctggtggtgctgttttactcactgcttaggtttttcttgattttctttgctttggtttattatagttactcttgatttacccttaaagtggatgctttgttag

SEQ ID NO: 3086 - DNA, 654 bp, Chelidonium majus
cagaaccgaagagagcaaaaatgacaaccaatctcaagaagaacaggaagaagagaggtcacgtctcagccggacatggacgtatcggaaagcacaggaagcatcccggaggtcgtggtaacgccggaggtatgcatcaccaccgtatcctcttcgacaaataccatccaggttacttcggtaaggtcggtatgcgttacttccataaactcagaaacaagttctactgtccgatcgttaatgtcgacaagctctggtctatgattcctcaagatgtgaaagacaaagctacacctgagaatgctcctttgcttgatgttacccagtttgggtatttcaaggtcttgggtaaaggtgctttgccttcttctcaacctattgttgtcaaagctaagcttatttctaagactgctgagaagaagattaaggaggctggtggtgctgttattcttactgcttagatctagggtttctttttctttcttcaaaacaagttgtttggagcagacccaagtttttaaatcctagttttgattattattagggattaaatggttttgatggtttattgttattatggtttaatttcaactacatccgaatattgtctttcagatatgttaattgagttttgttggattataattttgtttt

SEQ ID NO: 3087 - DNA, 603 bp, Catharanthus roseus
atccaaagaattcggcacgaggtcgaataaccctagcagaaatccgccatgacaaccaggttcaagaagaacaggaagaagagaggccatgtcagcgccggccacgggcgtatcggaaaacaccgaaagcatcccggaggaagaggtaatgctgggggtatgcatcaccacagaatcctcttcgacaaataccatcctgggtattttggaaaagttggtatgaggtacttccacaagcttaggaacaaattctattgcccgattgttaacgtcgacaagctctggtcgatggttcctcaggatgtcaaagaaaaggccacaaaggataatgctcctgtgattgacgttactcaatttggatacttcaaggttttgggtaagggtgttcttcctgaaaatcaaccttttgttgttaaagctaagcttatttctaagaccgccgagaagaaaattaaggaggctggtggtgctgttttactcactgcttaggttttttcttgattttctttgctttggtttattatagttactcttgatttacccttaaagtggatgctttgttagacattttagtaatcccttttgagtattaatgaattcatc

SEQ ID NO: 3088 - DNA, 558 bp, Eragrostis curvula
  misc_feature (558)..(558): n is a, c, g, or t
atcatctcccttcattccaacttccaagtaagcagccggcggcggccatgacgacgagcttgaggaagaaccggaagaagcgcggccacgtgtccgccgggcacggccgtatcggcaagcaccgcaagcatcctggaggtcgcggtaacgccggtggcatgcaccaccaccgcatcctcttcgacaagtaccatcccggctacttcggcaaggtcggtatgcgctacttccacaagctccgcaacaagttctactgcccggccgtcaacgtcgagcagctctggtccatggtgccggccgacaaggccgcggaggccggcgctgacaaggacccgcagatcgacgtgtcgcagttcggctacttcaaggtgctcggcaagggcaggctcccggacaagcccatcatcgtcaaaggccaacctcatctccaaggtcgacgagaacaagatcaaagccggtggcggagacatagtgctcacagaataaggtacagaactgaataattaggaaagtaaagatctgaaatagtattgataatcaaaaacaactaataaaaan

SEQ ID NO: 3089 - DNA, 594 bp, Triticum aestivum
cggcggcggcgatgacgacgcgcttcaagaagaaccgcaagaagcgcggccacgtgtccgccgggcacggccgcatcggcaagcaccggaagcacccgggaggtcgcggtaacgccggtggcatgcaccaccaccgcatcctcttcgacaagtaccatccgggctacttcggcaaggtcggcatgcgttacttccacaagctccgcaacaagttctactgccccgcggtcaacatcgagcgcctctggtcgatggtgcccgccgacaaggcggcggaggccggcggcgacaaggccccgcagatcgacgtcacgcagttcggctacttcaaggtgctcgggaagggggtgctgccgcccaagcccatcgtcgtcaaggcaactcatctccaaggtcgccgagaagaagtcaaagccgccggcggcgccgtcgtgctcaacgcctaggtttcatccttaatcgcctcttggttttgagatctatatctgaactagtagtgctttcctgtctcagctatttgtgttaagaagacctgtagtttttaaatctgtggctgctgcctgttgggacagtgctttatgaggattttgatgc

SEQ ID NO: 3090 - DNA, 712 bp, Elaeis guineensis
agagagagggggaaagagagctagagaagcggcgacagagatgacgacccgcttcaagaagaaccggaagaagcgcggccacgtgagcgccgggcacggccgcatcggcaagcaccggaagcaccccggaggccgcggtaacgccggtggcatgcaccaccaccgcatcctcttcgacaagtatcaccccgggtacttcggcaaggtgggcatgcgctacttccaccgcctccgcaacaagttctactgccccaccgtcaacgtcgaccgcctctggtccctcattcctgacgatgtcaaggagtccgccactgccggcggcggcagctccgctcccctcattgacgtcacccagttcggctacttcaaggtcctcggcaagggcatgctgcccccttccagcccggtcgtcgtcaaggccaagcttgtctccaagatcgctgagaagaagatcaaggccgctggcggcgccgtcctcctcaccgcctgatccgatccaatgtactcttgttcggagatctagggttctgttacttaatcctttggttggtttccgatttaaagttcagattttgagatctgtttcatttggatatgtgttggagacttgattcagatttcttattcaggatcgctgacgtttgtttaagtgatggtatgagtttattaaaactagattttgaaaaagttcagagtgttttatggtgcaaaa

SEQ ID NO: 3091 - DNA, 723 bp, Phalaenopsis aphrodite
ttcaccggccgcaaacctagccgaggtaacgagaagagccatgacgactcgcttcaagaagaatcggaagaagcgtgggcacgtgagcgccggacatggccgtatcggaaagcaccgtaagcatcccggcggtcgcggaaacgccggtggtatgcaccaccatcgaatcctcttcgacaagtaccatcctggttactttggcaaggttggtatgagatatttccatcgcctccgtaacaagttttattgccccactgtcaacatcgatcgcctctggtctctcgtgcctgaagaagttaaggccgctgcagtcgcggcgccaggcggcaaagcgcctttgattgacgtcacacagttcggatatttcaaggtactcggcaaaggaatgcttcctgcgtcgcagcccgttgttgtgaaggctaaactaatctcgaagactgctgagaagaagattaaggctaacgggggagctgtgctactcacggcttgattggatctggagaaatctagcttctctggggagcccggaggtctttgttctgttttatcttttggtttttatgtctaggttatttcctttagttgcttgatgaattgtcagttttatgccttgctcgataagatgactgttaaaagagatttttttctgcttgaggtgcattaagtttaatactccaaaattctatttttctttcaatgttaactattcaatctttccaatgc

SEQ ID NO: 3092 - DNA, 948 bp, Artemisia annua
tactccgacggggaccttttcttttttataacatatatcaggaacaagttttcttgaaaagaaagaaagaaagaaacccagaagaataaaaacacagacacagtaagttttaattcgaagaaaaagaagaaagaatggatccaaaggtaacagaagtgtcacaaacattcgaacgattcaaagcatctttagtccgtaacgatttcgacacatgttccaagcttttgtctcaactcaagctagcgctgattcagttcaaaagccttcccccattgtttgcagatggtccaactgccgttcaagagttaacattagcaagggatatcttcgagcatgctgttgtgcttagtgtgaagatggaagatcaagatgcatttgagagagatttctttcagctgtcactcaccacaggtatcaaaatgacaacaagcctacgcaaaaacaggaagaagagaggccacgtgtcagcaggacacggacgtatcggcaagcaccgaaagcatcccggaggtagaggaaacgcaggaggcatgcaccaccaccgtatcttattcgacaagtaccatcccgggtacttcggtaaagtgggtatgcgttactttcacaaactaaggaacaaattctactgcccgatagtcaacgtggacaagctttggtcaatggtcccacaagaagctaaagagaaggctactggagataaggtgcctgttgttgatgtgacccagcttgggtactttaaggttcttggtaagggaagtgtcccagttaagcatcctatggttgttaaggctaagttgattagtaaagttgctgagaagaagattaaggaggctggtggtgctgttgttcttactgcttaggtttttatgttttattgtttatgttggatgttatatgttatatgtttttggatggttttgatactttatgatatggatattttggtgg

SEQ ID NO: 3093 - DNA, 604 bp, Artemisia annua
caggtaagaaaaatgacaacaagtttaaggaaaaacaggaagaagagaggccacgtgtcagcaggacacggacgtatcggcaagcaccgaaagcatcccggaggtagaggaaacgccggaggcatgcaccaccaccgtatcttattcgacaaataccatcccgggtacttcgggaaagtgggtatgcgttactttcacaagctaaggaacaaattctactgcccgatagttaacgtggacaagctttggtcgatggtcccacaagaagctaaggagaaggctactggagataaggtgcctgttgttgatgtgacccagcttgggtattttaaggttttgggtaagggaagtgtcccagttaagcatcctatggttgtgaaagctaagcttattagtaaagttgctgagaagaagattaaggaggctggtggtgctgttgttcttactgcttaggtttttatgttttattgtttatgttggatgttatattttatatgtttttggatggtactttatgatatggatattttggtggttaatttgaagctgtttctgataagttgtttgatgaaaaatccttttagttgtcggcgccgtctttgtc

SEQ ID NO: 3094 - DNA, 563 bp, Eschscholzia californica
aaaatgacaaccaggttgaagaagaacagaaagaagagaggtcatgtaagtgccggtcatggtcgtatcgggaaacacagaaaacatcccggaggtcgtggtaacgccggaggtatgcatcaccatcgaatcttgtttgataagtaccatcctggttatttcggcaaagtgggtatgcgttattttcacaaacttcgtaacaaattttattgtccaatcgttaatgttgataaactctggtcaatgattcctgaagatgtgaaagcaaaagcttcacctgaaaatgcacctcttcttgatgttactcagtttgggtttttcaaagttttgggtaaaggttcattgccttcttctcaacccattgttgttaaagctaaactgatttctaaaactgctgagaagaagattaaagaagctggtggtgctgttgttcttactgcttagatctagagatccagggttttgttttcgttgttattttgaatgaacatcacaacttttataaatcttattggttttggtttatttaggtttaaatgtttgagatacttgttcgtttaagt

SEQ ID NO: 3095 - DNA, 702 bp, Eschscholzia californica
ctctaactcaatcaaaaccctagcttactcatttttcattcaaccagcaggtaaggaggaggagaagagagaagccaaaatgacaaccaggttgaagaagaacagaaagaagagaggacatgtaagtgccggtcacggtcgtatcgggaaacacagaaaacatcccggaggtcgtggtaacgccggaggtatgcatcaccatcgaatcttgtttgataagtaccatcctggttatttcggcaaagtgggtatgcgttattttcacaaacttcgtaacaaattttattgtccaatcgttaatgttgataaactctggtcaatgattcctgaagatgtgaaagcaaaagcttcacctgaaaatgcacctcttcttgatgttactcagtttgggtttttcaaagttttgggtaaaggttcattgccttcttctcaacccattgttgttaaagctaaactgatttctaaaactgctgagaagaagattaaagaagctggaggtgctgttgttcttactgcttagatctagagatctagggttttgttttcgttgttattttgaatgaacatcacaacttttataaatcttattggtttggtttatttaggtttaaatgtttgagatacttattggtttaagtcgaagaattttagacattttatatcttatttgatgcattctcactttatttggttgccaaaaaa

SEQ ID NO: 3096 - DNA, 510 bp, Flaveria ramosissima
ttagtcttcaaccaagggtttctgccgccttcattcaccgaacatctgcttcacaggcgacaatgacgacgagattgaggaagaaccggaagaagcgcggccacgtcagcgccggtcatggccgtatcggaaagcaccggaagcatcccggcggcagaggtaacgccggaggtatgcaccaccaccggatattgttcgataagtatcatcctggatactttggtaaagttggtatgcggtacttccataagcttcgtaacaagttctattgcccgattgtgaacgttgataagctgtggtcgatggtgcctgaggatgtgaaggagaaggcgaatggtgataaggtgccagtggttgatgtgacgcagtatggttactttaaggtgttggggaaggggactgtgcctgcgtcgcagccgattgtggtgaaggcgaagctgatttcgaagattgctgagaagaagattaaggaagctggtggtgctgttgtgctcactgcttaggtttgtg

SEQ ID NO: 3097 - DNA, 800 bp, Lactuca sativa
tataaatcgagttagggttctatttatgtagctgagatactctgccctagcgtcgtcgctgccgcctgtagccggagttttcctttcagggtagaatgacgaccagactcaggaagaaccgcaagaagcggggtcacgtgagtgccggacatggtcgtatcggaaaacacaggaagcatccaggaggtaggggtaacgccggaggaatgcaccaccaccgtatcctcttcgacaaatatcatccaggttacttcggtaaagtcggaatgaggtacttccacaagcttcgaaacaagttctattgccccatcgtcaacgtggacaagctctggtccatggttcctcaggacgtgcgagagaatgcctccgccgacaagatccctgtagtcgatgtaacacagcacggattcttcaaggttttagggaaaggtatggtgcctccgtcacatccgatggttgttaaggcgaagcttatatcaaagacagcggagaagaagattaaagaggctggtggtgctgttttgcttactgcttaggtttgttttcggttactgtatcttctttttcttataattacatgcatccttttttaggctgttttgttcttttgaacatgaattttgtttctatatgagttattttcggaatacaatagactcattctataaagacatcatctttggttatccgcttatcctagtttaggttttctgttttaatgggatgctagacaactgtggttgtgttaagcattagtcgatatgcgttaatcatttgattatttcatttttctatgtcta

SEQ ID NO: 3098 - DNA, 1508 bp, Plantago ovata
taagaagttaaaataggtagatagtggaattatgaatcaaagaaaaacaaagtgtttagatcaaactactagtgaacaatgttcggagctaacataagtctcactaaatcacaatttatcttgaaacaatttaccaggacagacagaacagacagcaaaccaaaagagcatggcagacgaacagcaacacggtccaaaagatacatactgcttgatggtagggaatgctgcactacgtttgagttaactacatgcagatgtggaaggcaccttgcatccttttcaggagcttagctggatgttgagaaattgaaacacgtgtggaaggcggtggtgtttctggtttcttgctcttattctttcgccttaattgaaagaactctttcattgtatctgcacactctgatgccaatacacctcgcctgattgtaatctttgggtgaaatggatgaactggagcagccggtttatcagattgttccaagctgtttccaccatctccactgggaaaaatccttatccagctgccatcagctccaagaagcttattaggagctccccacacgatggtgtcaatcctagcttgaagtattgctccggcacacataggacatggttcaagtgtcacgtaaagtgtagtttcagaaagcctccatgtacggagtaaatttgatgcctcccgtatgcagatcatttctgcatgggcagtggagtcccgcagctcttctaccaggttgtatccacgagcaattatcttcccattatgcaccaaaacagcccccacaggaacctcccagttgtcaccagctttctgggcttccatcagagcctccctcatgaatatttcatcaagttttcgctgctcagcttcaatcatatacgcttcttcccattcatcaaatctatctcttacaatttggtccttcctcagaagcttaccccttcgtttcactccgccacatcccaaaatgaccactcacttgcgtaagaaccgtaagaagcgcggccacgtgagcgccggccacggccgtatcggaaagcaccgcaagcatccaggaggtcgcggtaacgcgggaggaatgcaccaccacaggatcctgttcgacaagtaccatcctggttacttcggcaaggtcggtatgcgttacttccacaagctccgcaacaaattctactgccctacggtcaacgttgaccggatctggtcaatggttccggcggatgtgaaggagaaggcgagtaaggataacgcgccgatgatcgatgtgacgcagtttggatacttcaaggtgttggggaagggtttggttgagaagcctgtggttgtgaaggcgaagctgatctcgaagactgccgagaggaagattaaggaggctggcggcgctgtcgttttgactgcttaaattaaattaggtttcttattagctctttcaattactttattactgttttagctgtggattgatcatctattgaatttttagatacatgaatgaatgaatggttgg

SEQ ID NO: 3099 - DNA, 834 bp, Musa acuminata
gtttttatttccatttcgctcttcaaaacccaaaccctaaggagcggcggagagtggaggagaggggcggcggcgatgacgacgcgcttcaggaagaaccggaagaagcgagggcacgtgagcgccggccatgggcgcatcggtaagcaccggaaacacccgggtggtcgcggtaacgctggtggcatgcaccaccaccgcatcctcttcgacaagtaccaccccggttactttggaaaggtaggtatgcgctacttccaccgcctccgcaacaagttccactgccccgccgtcaacgtcgaccgcctctggtccctcgtccccgacgccgtcaaggaatccgctgccaaggacggcaccgccgcccccttgattgacgtaacccagttcgggtacttcaaggtgctcggcaaggggatgctgccgccggaccgccccgtcgtcgtgaaggccaagctcatttcgaagatcgccgagaagaagattaaggcagccggtggcgctgtcgtgctcaccgcttgatctgcacgatcgacggtctctttttataccgaagagctttcctttttgaatctgctcgaactcatcaataggaatctgcaatgtttattttgagcccaatctgtttgatcttttgactttgatgttgttgcttggacttgaattattgtcttgagaatatctgcaatttagacaaatgcagttagtaatgccatgtttgattgaaaattcttattttgatctcatagttattggcctccgtgaatgaatctaaaattagtacaatttagtaggcaaacatgggactccataataaaatggacaatgtcaggc

SEQ ID NO: 3100 - DNA, 787 bp, Elaeis guineensis
agaaggctgtccgtatcctctccataaaaggctctcgcactagggtttccgagcttctccgccttgttccgcccatttccaaaaccctaaccttaggagaaagagagcgggacagagcccgaggagcggcggcggcggcggcgatgacgacccgcttcaagaagaaccggaagaagcgtggccatgtgagcgccgggcacggtcgcatcggcaagcaccggaagcaccccggtggccgcggtaacgccggaggcatgcaccaccaccgcattctcttcgacaagtaccatcccgggtactttggcaaggtcggcatgcgctacttccaccgcctccgcaacaagttctactgtcccaccgtcaacgtcgaccgcctctggtccctcgtccccgacgacgtcaaggagtccgccgttgcttgcgacgccaactccgcccccttgatcgatgtcacccagttcggctacttcaaggtcctcggcaagggcatgcttcccccctcccgccccgtcgtcgtcaaggccaagctcgtatccaagattgcggagaagaagatcaaggccgccggcggcgccgtactccttaccgcttgatccgatttgatatactcttgttcggagatctagggttatattacttaatcttttggttagtttctgctttaaagttttgattttgagacttccatttgagtatgtgttggagacttgattcagatttcttattttggattgctgatatatgtttaattgctgtcatgagtctattaaaaatagattttgataaa

SEQ ID NO: 3101 - DNA, 723 bp, Amorphophallus konjac
aagaagaacaggaagaagagggggcacgtcagcgccgggcatggccggatcgggaagcaccggaagcaccccggtgggcgggggaacgccggaggcatgcaccaccaccgcatcctcttcgacaagtaccacccggggtacttcggcaaggtgggcatgcgctacttccacaagctgcgcaacaagttctactgccccgccgtgaacgtcgaccgcctctggtcgctcgtccccgaggacgtcaaggccaacgccgccgcgggcggggccggcgcgccgctcctggacgtgacccagttcgggtactttaaggtgctcggcaagggggcgctcccccggtcccagccgatcgtcgtgaaggcgaagctcgtgtcgaaaattgcggagaagaagattaaggaggccggcggggccgtcgtcctcacggcttgatccgtgaggccgcgggatgccgggcggaagtgaggattatcttctatttgtctgctagagagagaacagggagataagaatcggagtgttaaattattaaggatcattactgtctgctttatttgttagtttcatccttgtttatgggtagaatctcatccaatctgaaccgttgggttttgttggagacagcatatcttattgatcagatctactgttaatgcttgcatttggtgaattttatttgggtgaattttgatatgcctagcacgattaacgtgaaagtttgca

SEQ ID NO: 3102 - DNA, 599 bp, Ocimum basilicum
tctcactccatctccaacatacggaaatgacgacccgcttcaagaagaaccgcaagaagcgtggccacgtgagcgccggccacggtcgtatcggaaaacaccgcaagcatcccggtggtcggggaaacgccggtggtatgcaccaccaccgtatcctcttcgacaagtatcaccctggatacttcggcaaagtcggtatgcgctatttccacaagctccgcaacaagttctactgccccaccgtcaacatcgaccgcctctggtcgctggtgccgcaagaggtgaaggacaaggcctccaaggacaacgcgccgctcctcgacgtcacgcagttcggctacttcaaggttttggggaaaggtttgctgcctgcggacaagcctgtcgtcgtgaaggctaaattggtgtcgaagaatgcggagaagaagatcaaggaggctggtggcgccgtcgtgctcactgcttgattagggtttgttgtttttactgttttttttcccgttgagttttatgcaatcgtgagactgctgatatcgcctgagaggattttgaattaaatgctcattctatactcttataaatgttcttatttgataaga

SEQ ID NO: 3103 - DNA, 729 bp, Cirsium arvense
gttactaacgaaccgacaggtaacgtacgggcgggggggtttggagttatccaactatatccccaatctctgccgcaatttctcaccggagtttccctttcaggagaaatgacgacgagattcaagaagaaccgtaagaagcgcggccacgtaagcgccggtcacggtcgtatcggaaaacaccgaaagcatcctggaggtcgtggtaacgccggaggaatgcaccaccaccggatcctcttcgacaagtaccatcccggttacttcggtaaagtcggtatgagatacttccatcggctccgaaacaagttccattgcccgatcgttaacgtcgataagctctggtcgatggttccacaggatgccaaagagaatgcttcagctgataaggttccaattgtggatgttactcagtttggttacttcaaagttttgggaaaaggtatggttccgccatcgcagccgatggtggttaaggctaagcttatttcgaagactgctgagaagaagattaaggaggctggtggtgctgttcttctcactgcttaggtttgttttcgatttgttaattaatggcagttttgaatattactgttagattagggtttttatggaaatttaagaatgaagatgagtttctttttgttgaaattgaacctgttgcatcatattatgatatgaatttggcttgcaagtttttcgaaaaagaaaaagtaccgactgcgactc

SEQ ID NO: 3104 - DNA, 453 bp, Cirsium arvense
tttcaggagaaatgacgacgagattcaagaagaaccgtaagaagcgcggccacgtgagcgccggtcacggtcgtatcggaaaacaccgaaagcatcccggaggtcgtggtaacgccggaggaatgcaccaccaccgtatcctcttcgataagtaccatcccggttacttcggtaaagtcggtatgagatacttccaccggcttcgcaacaagttccattgcccaatcgttaacgtcgataagctctggtcgatggttccatcggatgccaaagagaacgcttcagctgataaggttccaattgtcgatgttactcagttcggttacttcaaagttttgggaaaaggtatggttccgccatcgcatccgatggtggttaaggccaagcttatttcgaagactgctgagaagaagattaaggaggctggtggtgctgttctactcactgcttagg

SEQ ID NO: 3105 - DNA, 771 bp, Eschscholzia californica
tcgtcttcctagttaggggtaggtaggtagtagtagtacgtcctttcctttagtactagagcgagagaaactagagagagatcaaagatgacaactggactaaagaagaataggaagaagagaggtcacgtcagtgccggacatggacgtatcggaaaacatcgaaagcatcccggaggtcgtggtaacgccggaggtatgcatcatcaccggatcttatttgataagtaccaccctggttactttgggaaagtgggtatgaggtatttccacaaacttcgtaacaaattcttttgcccaattgttaatgttgaaaaactatggtctatgattcctcaagatgtcaaagataaagcaaaccctaataatgtccctgttattgatgttactcaatttgggtattttaaagtattgggtaaaggagttttgcctcaatctcaacctatagttgttaaagctaaacttatttccaaggttgctgagaaaaagattaaggaagctggcggtgccgttgttcttactgcttagggttttcgtatttcaatttggcttggtaattagggtttcaaagtttggatctttaatgttttcatattagaaaaattctgttatgggtttattcatgataatatgaaacttcattttgcttatgtttgatttatattacactatatctgtcttgtttgaattgcttaatgtgatattatcaattgtttttgtgctttatatgagtgcattatgacggtgattatggtctttgtagtagtctag

SEQ ID NO: 3106 - DNA, 572 bp, Eschscholzia californica
caaacagggagaagacgccgaaaccagagagagaaagagatctaattccacagagatgacaactcgattgaagaagaataggaagaagagaggacacgtaagtgctggacacggacgtatcggcaaacatcgaaagcatcccggaggtcgtggtaatgccggaggtatgcatcaccaccgtatcctcttcgacaagtaccatcctggttactttggtaaagtgggtatgaggtatttccacaaacttcgtaacaaattcttttgcccaatcgttaatgtcgaaaagctttggtctatgattcctcaagaaaccaaagataaagcttcacctgaaaatgcccctttgattgatgttactcaatttgggtatttcaaagttttgggtaaaggagttttgcctcaatctcaacctattgttgttaaagctaagttgatttcaaaggttgctgagaagaaaatcaaagaagctggtggtgctgttgttcttactgcttagatttcagctaagttttatcattcttatggtttgtttttaggttaagtttggatcttttgctgtttagttgagtaag

SEQ ID NO: 3107 - DNA, 1019 bp, Eucalyptus grandis
ctcatcctcccctcatctcagagcctcggccgcacgcacttcccccggcaaaccccgccgccgagagagagagagagagagagagctcctgccgccgtccgccagaaaatgacgacccgcttcaagaagaaccgcaagaagcgcggccacgtcagcgccggccacggccgtatcggcaagcaccgcaagcatccgggagggcggggtaacgccggaggcatgcaccaccaccgcatcctcttcgacaagtaccatccggggtacttcggcaaggtcggcatgcggtacttccacaagctccgcaacaagttctactgccccatcgtcaacgtcgagaagctgtggtcgctggtcccccaggacgccaaggacaaggcctccggcgccgccgccgccccggtgctcgacgtcacccagttcgggttcttcaaggtcctcgggaagggcgtcctcccggagaagcagccgatcgtggtgaaggccaagctggtgtcgaagatcgccgagaagaagatcaaggaggccggcggcgccgtcgtgctcaccgcttaggggctccattcgcggtagctttttagggtttccccgtttgcaattatatacaattgatgcgctttccattatgattttgacgcttggttgtaattggatctggatctgtttactttatgcagaccgagagctttaatttttgggtaattctctatgcttattgcttgctcgtgtgcttgttatgatttcgcttcccgcgttgcgatgctattcatttctgggttaatgctctctgtgatattgatggtcgtctgagaactgctttctacgtctgttctgtacgcttcactatctggtcagtgaggattcatttagttcccacatgactcgttcccttgaagcaatagaatccgtgtcgcactcgtgatgaccgtctccctttagctttcttcactgctccgggagcacgcgagggcgactatatttacatatttgtttgtgggttgcttgtgctgcgtctgcgtgac

SEQ ID NO: 3108 - DNA, 631 bp, Fagopyrum esculentum
agcctccttcattttccaatcttcccaagatgaccacccatttgaagaagaacagaaagaagagagggcacgtcagcgccgggcatgggcgtatcggaaagcacagaaagcatcccggaggtcgcggtaatgctggaggtatgcaccaccaccgtatactcttcgacaagtaccatcccggttactttgggaaagttggtatgaggtacttccacaagctccgcaacaagttcttctgtcccaaggtcaacgtcgaaaatctctggtctctacttcctcaggaggtgaaggacaaagcatcaaaggacaacgcccctgtgatcgatgtgacgcagtttggatacttcaaggtgttgggaaagggcgttttgcctccgaatcaacctattgttgtcaaggccaagctcatttctaagatcgctgagaagaagataaaggaagccggcggtgctgtggttcttactgcttaggtttgtttcgtttttcatttccgttttaatcaattttgagttcagttcaattaggatattgacgtatcgatcgaggatttggagcgatttgaatattcatctgttgagactttggttttcaatgctatctatatctgcttatcttacgaatgattgtcgcg

SEQ ID NO: 3109 - DNA, 715 bp, Fagopyrum esculentum
agcctccttcatttccaatctcccagcgagagagagcgacgatgaccacccatttgaagaagaacagaaagaagagaggacacgttagtgctgggcatggacgtatcggaaaacacagaaagcatcccggaggtcgcggtaatgctggaggtatgcaccaccaccgtatcctcttcgacaagtaccatcccggttactttgggaaagttggtatgaggtacttccacaagctccgcaacaagttcttctgccccaaggtcaacgtcgaacatctctggtctcttgttcctcaggaggtgaaggacaaggcaacaaaggacaacgcccctgtgatcgatgtgacgcagtttggatacttcaaggtgttgggaaaggggcttttgcctgcgaatcaacctattgttgttaaggccaagctcatttctaagatcgctgagaagaagataaaggaagccggcggtgctgtggttcttactgcttaggtttgtttcgttttttatttccgtttttaatcaattttgagttcagatctaaaccgttaggataattgatgtatcaatcgaggatttggagccttttgaatattcatctgttgagactttggtttttaatgttatcatatctgcttatcttacgaatgattgtcgcgtaaaaaaaaaagaaaaacaaaaactaactaacgtcgttcgtagtaacctacctacgtctcttcgta

SEQ ID NO: 3110 - DNA, 665 bp, Flaveria ramosissima
caaccgccgttcttcaccggcgtttgcttcaaaggggataaaatgacgacgagattgaggaagaacaggaagaagcgtggtcacgtgagcgctggtcacggtcgtatcggaaagcaccgtaagcatcccggaggtcgtggtaacgctggaggtatgcaccaccacaggatcctctttgacaagtaccatcccggttactttggtaaagttggtatgcggtacttccacaagctccgtaacaagttctactgccctatcgtcaacgtcgacaagctctggtcgatggtgccggcggacgtgaaggagaaagcctccactgacaaggttccagtcattgacgtcactcagcatgggtacttcaaggtgttggggaagggcactgtgtctgcatctcagccgattgtcgttaaggcgaagctgatctcgaagattgctgagaagaagattaaagaagctggtggtgctgttgtgctcactgcttaggtttgttttctcattttaatgtctgttatggttattattgatgttaggtttattcgcggattactttggttttatgaacttggaatcacatttgatataagttttgttttgacgatctttgattgtggttctttgttttgttgtatgcttttgctatctaatatctatggtttgaatctgac

SEQ ID NO: 3111 - DNA, 605 bp, Flaveria ramosissima
cggcgtttgcttcaaaggataaaatgacgacaagattgaggaagaacaggaagaagcgcggtcacgtgagcgctggtcatggccgtatcggaaagcaccgtaagcatcccggaggtcgcggtaacgctggaggtatgcaccaccaccggatcttattcgacaagtaccatcccggctacttcggtaaagtcggtatgcggtacttccacaagctccgtaacaagttctactgccctatcgtcaatgtcgacaagctctggtcgatggtgccacaggacgtgaaggagaaggcctctgccgataaggttccagtgattgacgtcactcagcatgggtacttcaaggtgttgggcaagggcactgtgcctgcatctcagccgattgtcgttaaggcgaagctgatctcgaagactgctgagaagaagattaaagaagctggtggtgctgttgtgctcactgcttaggtttgttttctcatttgaatgtctgttatggttattattgatgttaggtttattcgcggattaccttggttttatgaacttggaatcacatttgatacaagttttgttttgaatatctttgattgtggtctttgttttgtt

SEQ ID NO: 3112 - DNA, 636 bp, Flaveria ramosissima
gtaacacagggtatctacagccgttcttcaccggcgtttgcttcaaaggataaaatgactacaagattgaggaagaacaggaagaagcgcggtcacgtgagcgctggtcacggtcgtatcggaaagcaccgtaagcatcccggaggtcgtggtaacgctggaggtatgcaccaccaccggatcctcttcgacaagtaccatcccggttactttggtaaagtcggtatgcggtacttccacaagctccgtaacaagttctactgccctatcgtcaacgtcgacaagctctggtcgatggtgccagaggacgtgaaggagaaggcctctgccgataaggttccggtgattgacgtcactcagcatgggtacttcaaggtgttggggaagggcactgtgcctgcatctcagccgattgtcgttaaggcgaagctgatctcgaagactgctgagaagaagattaaagaagctggtggtgctgttgtgctcactgcataggtttgttttcttcattttggttatcagttatggttattatcaatgttaggtttatttgcggattactttggtttcatgaacttggattcacatttgatataagttttgttttgaatatctttgattttggccaaaaatatt

SEQ ID NO: 3113 - DNA, 508 bp, Flaveria ramosissima
agggtttctgccgccttccttcaccgaacatctgcttcacaggcgacaatgacgacgagattgaggaagaaccgtaagaagcgcggccacgtcagcgccggtcacggccgtatcggaaagcaccggaagcatcccggcggcagaggtaacgccggaggcatgcaccaccaccggatcctcttcgacaagtatcatcctggatacttcggtaaagtcggtatgcggtacttccacaagctccgtaacaagttctactgccctatcgtcaacgtcgacaagctctggtcgatggtgcctcaggacgtgaaggagaaggcgaccgctgataaggtgccggtggttgatgtgacacagtatgggtactttaaggtgttggggaaggggactgtgcctgcttctcagccgattgtggtgaaggcgaagctgatttcgaagaatgctgagaagaagattaaggaggctggtggtgctgttgtgcttactgcttaggtttgtgtttttaattgtt

SEQ ID NO: 3114 - DNA, 596 bp, Flaveria ramosissima
ccggcgtttgcttcaaaggataaaatgacgacaagattgagaaagaacaggaagaagcgcggtcacgtgagcgctggtcacggtcgtatcggaaagcaccgtaagcatcccggaggtcgtggtaacgctggaggtatgcaccaccaccggatcctctttgacaagtaccatcctggttacttcggtaaagtcggtatgcggtacttccacaagctccgtaacaagttctactgccctatcgtcaatgtcgacaagctctggtcgatggtgccggaggacgtgaaggagaaagcctctgccgacaaggttccggtgattgacgtcactcagcatgggtacttcaaggtgttggggaagggcactgtgcctgcatctcagccgattgtcgttaaggcgaagctgatctcgaagaccgctgagaagaagattaaagaagctggtggtgctgttgtgctcactgcataggtttgttttcttcattttggttatcagttatggttattatcaatgttaggtttatttgcggattactttggtttgatgaacttggattcacatttgatataagttttgttttgaacatctttgattgtggt

SEQ ID NO: 3115 - DNA, 736 bp, Gerbera hybrid cultivar
tttccatcctttccagcggagttactaaaccccaaccaaatctccgccgcagttcttcaccggagtttgattttcaggagaaatgacgaccagattcaggaagaaccgtaagaagcgcggtcacgtgagcgccggccatggccgtatcggaaaacaccgaaagcatcctggaggtcgtggtaacgccggaggaatgcaccaccaccggatcttattcgacaagtaccatcccggttacttcggtaaagtcggtatgaggtacttccaccgccttcgcaacaagttccattgcccaatcgtcaacgtcgacaagctctggtcgatggtgccggaggatgtcaaagagaaggccactgctgataaggtcccggtcgtcgatgttactcagtttggttactttaaagtgttgggaaagggcatggttcctccatcgcagccgatggtggtgaaggcgaagctcatttcgaagactgctgagaagaaaattaaggaagctggtggtgctgttttgctcactgcttaaggtgtgtttgcaattgttctttgttaatgacagttttgattattactgttagtttagggtgtatggataatcattttgatttgttgattttggaattgatgcatccgaagtttggtttcagtgatttgaacttggaagttgatcttattaagttattgttgataatcattcaacaacatgcataattggatgttcaaaaaaaaaaaaaaaaaa

SEQ ID NO: 3116 - DNA, 1001 bp, Vitis vinifera
aaccctagcatccctttcctctttctcttctctccgcagacaaccccagagattcaaaggccttaggcggtacaaggtacaaggatgacaaccaggttcaagaagaacaggaagaagagagggcacgtcagcgccggccatggccggatcggcaagcaccggaagcaccccggtggtcgcggaaatgctggaggtatgcatcaccaccgcatccttttcgacaagtaccaccctggctacttcgggaaggtcggaatgaggtacttccacaagctccgcaacaagttctactgccccatcgtcaacattgacaagctgtggtccatggtgcctcaggatgtgaaggacaaagcctctcctgataacgcccctctcatcgacgtcactcagttcggctacttcaaggttctgggcaagggcgcgttgccttcctcgcagccaatcgtcgtgaaggccaagctcgtctctaagatagccgagaagaagatcaaggaagccggtggtgccgttgttctcaccgcctaggttttgaatctttccttgttccgtcctttcatttattttgtttaccaatggaagttgttagcggttttttgatgaattgaattacaatgaattttgtttgggttgatgcgcaatgttatccttttttatactccatatcggttcaactgtttcgatggatctatttcgattttcggtagcatatatttgtttttcttcaaaccctagatttgattacagcaaaaaattgttgaaagagagtgagtccgatcgatgatatccggaggcatactcgaggagagggaatgcactctttttctatcagttcttcctctggtggaaatgaaatcaatcaatgaagacctcccttcttgactggctttgctttgtagagcagtacaggtaaatgaagctgggtactgagaattaatggcggacacgaatcccttgtgattgggaacttcgattcaattagtttgtggctcttgcgtttttct

SEQ ID NO: 3117 - DNA, 759 bp, Populus trichocarpa
ctctccccgcggtctctctctcaccaattgctgggcagccgctcaacaccctaaacaacagatccctctcctccaaaacccaaaatgactacacgcttcaagaagaacaggaagaagagaggtcacgtgagcgcaggtcatggtcggattggaaagcacaggaagcaccctggaggtcgtggaaatgcaggaggcatgcaccaccacaggatcctcttcgacaaataccatcctggttacttcggtaaggttggtatgcggtacttccacaagctccgcaacaagttctactgtcccatcgtcaacatcgacaagctctggtccatggtcccccaagatgtcaaagacaaggcaaccaaggatactgtgcccatgattgatgtcactcagttcggttacttcaaggtacttggcaagggggttttacctgacaagcaacccattgttgtcaaggccaagcttatttcaaagattgctgagaagaagattaaagaggctggtggtgctgttgtacttacagcctaggttatgttccttttcaagattttgacctttctttaaattaaagagtttagtgatactgctggatcatttcataatttaatgcttttttgtttcatatttttctgttcgtaaattgggattttgcttattacatgacattgtcccgttgctctatttgatgcatccatgtgtttggttagttgaatcgatgatttgatgatagttattatactgtgttgcttggaaatggttcta

SEQ ID NO: 3118 - DNA, 759 bp, Populus trichocarpa
ctctccccgcggtctctctctcaccaattgctgggcagccgctcaacaccctaaacaacagatccctctcctccaaaacccaaaatgactacacgcttcaagaagaacaggaagaagagaggtcacgtgagcgcaggtcatggtcggattggaaagcacaggaagcaccctggaggtcgtggaaatgcaggaggcatgcaccaccacaggatcctcttcgacaaataccatcctggttacttcggtaaggttggtatgcgttacttccacaagctccgcaacaagttctactgtcccatcgtcaacatcgacaagctctggtccatggtcccccaagatgtcaaagacaaggcaaccaaggatactgtgcccatgattgatgtcactcagttcggttacttcaaggtacttggcaagggggttttacctgacaagcaacccattgttgtcaaggccaagcttatttcaaagattgctgagaagaagattaaagaggctggtggtgctgttgtacttacagcctaggttatgttccttttcaagattttgacctttctttaaattaaagagtttagtgatactgctggatcatttcataatttaatgcttttttgtttcatatttttctgttcgtaaattgggattttgcttattacatgacattgtcccgttgctctatttgatgcatccatgtgtttggttagttgaatcgatgatttgatgatagttattatactgtgttgcttggaaatggttcta

SEQ ID NO: 3119 - DNA, 737 bp, Populus trichocarpa
gctctgattcacccgccgccgttcaaacccaaaacaacagatctctaacacccccccccctccacccgccccccgagaaatgacaacccgcttcaagaagaaccggaagaagagagggcacgtcagtgctggccatggacgcatcggcaagcacaggaagcacccaggaggtcgtggtaatgctggaggtatgcaccaccaccggattctcttcgacaagtaccatcccggttactttggtaaagtcggtatgcgttacttccacaagctccgcaacaagttctactgtccgatcgtgaacatcgacaagctatggtccatggtcccacaggatgttaaagacaaggcaaccaaggatactgtgccgatgatcgatgtaactcagttcggttacttcaaggttcttgggaagggggttttacctgagaagcaaccgattgttgtcaaggccaagcttatttcgaagattgctgagaagaaaattaaagaggctggtggagctgttgtgcttactgcctaagttaggattttaagattttgaattgtcttcttttcccttaaaaattcaagcgattagggataccgttgaaccacctatttggattttgcttatcacatggttttgtcgcttgcattgcttcatgcccttttgttatttgaatcgattgcttgatgttgctcttatttgactagttgaatatgaatattagtcatcttgcaatccttgctcttctcaa

SEQ ID NO: 3120 - DNA, 966 bp, Populus trichocarpa
ggaagctgtaggaacccaagaggggagcccatttaccgaaacccacctttaactgccgcgaccacattccaaaactagagggcaaaaccgtcaaccgaaaattcccttcattttctgccgcatatatacacctcccaaaccctaagcgctcgctctgattcacccgccgccgttcaaacccaaaacaacagatctctaacacccccccccctccccccgccccccgagaaatgacaacccgcttcaagaagaaccggaagaagagagggcacgtcagtgctgggcatggacgcatcggcaagcacaggaagcacccaggaggtcgtggtaatgctggaggtatgcaccaccaccggattctcttcgacaagtaccatcccggttactttggtaaagtcggtatgcgttacttccacaagctccgcaacaagttctactgtccgatcgtgaacatcgacaagctatggtccatggtcccacaggatgttaaagacaaggcaaccaaggatactgtgccgatgatcgatgtaactcagttcggttacttcaaggttcttgggaagggggttttacctgagaagcaaccgattgttgtcaaggccaagcttatttcgaagattgctgagaagaaaattaaagaggctggtggagctgttgtgcttactgcctaagttaggattttaagattttgaattgtcttcttttcccttaaaaattcaagcaattagggataccgttgaaccacctatttggattttgcttatcacatggttttgtcgcttgcattgcttcatgccattttgttatttgaattgattgcttgatgttgatcttatttgactggttgaatatgaatattagtcatcttgcaatccttgctcttctcaatgctgacttgtttttgagggttttcttttgcctacattggctagaaattgaagtagccatggatttgaaaatgcctag

SEQ ID NO: 3121 - DNA, 686 bp, Papaver somniferum
ctaaaccagagggatttccaaagagatcaaacagtagagaaatgacaacccatttgaagaagaacaggaagaagaggggtcacgtatcagctggtcatggtcgtgtaggtaagcacaggaagcatcctggaggtcgtggaaatgctggaggtatgcatcaccatcgtatcttgttcgataagtaccatcctggttatttcggtaaggttggtatgaggtattttcataaactcagaaacaagttttattgtccaatcgttaatattgataagttatggtcgatggtacctgaagatgtgaaagctaaagctaaaggtactgacgaagcaccagttattgatgttactcagtatggatactttaaagtattgggtaaaggtgttttgcctgataatcagcctattgttgttaaagctaaattaatttcaaagactgctgagaagaagattaaggatgctggtggtgctgttattcttacagcttaaggaagttgctcttttagtggattaatatttaccttttcttgaatgaatcgtgatgttgatggattattaaagattttggttttttaagtaccgtttaaacagttttgttatgagattttagtatggtttctaaattgtgagaaaaactttagttaaatgcttaaaacttgttattatctttttggaaaaaaaaaaaaaaaa

SEQ ID NO: 3122 - DNA, 588 bp, Utricularia gibba
gatcggaaatgactactcgattgagaaaaaacaaggaagaagcggggccacgtcagtgccggacatgggcgtatcgggaagcacaggaagcatcccggtggtcggggaaacgccggaggaatgcaccaccaccgtatcctattcgataagtatcatcctggttacttcgggaaggtgggtatgcggtacttccacaagctgcgtaacaagttcttctgtccgacggtcaacgtcgacaggctgtggtccatggtgccgaagaatgtgaaggagaaggcgtcgaaggataacgtgcctttgattgacgtcactcaatttgggtatttcaaggttttgggtaagggaacgctgccggaggatcagcctgttgtggtgaaggcgaagcttgtctcgaagaatgctgagaaaaagatcaaggaggctggaggtgccgttttgctcactgcgtgattaaaaatggagtttttattcaatggttatagttttagacctttttatgttactgtgatgtatgtggtctctggtgaagagaatcaaccttctcattctgtttctgaaacatggcttttacctatatttggtacattg

SEQ ID NO: 3123 - DNA, 1109 bp, Prunus mume
atggtggtgagggagaggctgcaatggtggctgtgaagagagtggtgagaaagatgaagagcatagaagaatggtggctggacgccatgggagaaaaagagagaagctttgagatcttggtagaatgttttcttcgtttattgtgttttgcactttgagaatctttctgggtttgatgggtttgttatgttgttagactagtgaagaaagtaacgaactttagcgccaaaatccctttggaggaagacagaaagataatgcttgtaattaaatgatcaagacgagggtattttggggatgttaattgattgggttgggccacttcagtaatcaatcccaagcccagtaaaccagataattgggccgaagccccaaaaccttcatcgtcttcatataaatacccccaaattcgagcgactgaaaccctaggccaaatgacgaccagtttgaagaagaatcggaagaagagaggccacgtcagcgccggccacggccgaatcgggaagcacaggaagcatcccggtggtcgtggaaatgccggaggcatgcaccaccaccggatcttgttcgacaagtaccacccggggtattttggtaaagtcggcatgcgctacttccacaagctccgcaacaagttctactgccccatcgtcaacgtcgacgagctctggtctttggtgccgcaggaggcgaaggacaaggcggcggcgaacaaaggaaacgacgtgccgttgatcgacgtgacgcagtttgggtactttaaggtgttggggaagggggcgttgcctcagaaccagcctgttgtggtgaaggccaagctcatttctaagaccgctgagaagaagattaaggaagctggtggcgccgttgttctcaccgcctaggattttagggtttagatttgaggggtttttgcttattgtctgagaattggggttttggtagattttttcttcgcctttgctgaatacaaacatcatgttattttgtgtcattgagcttcttgaatgctaaaggttgaaacttttgttgcaatgcgttgctttattatcaacattaatatgagaatttgattgctttcagaacttaattgaaaagtttttggttgt

SEQ ID NO: 3124 - DNA, 683 bp, Prunus persica
gccaaaaatgacgaccagtttgaagaagaatcggaagaagagaggtcacgtcagcgccggccacggccgaatcgggaagcacaggaagcatcccggtggtcgtggaaatgccggaggcatgcaccaccaccggatcttgttcgacaagtaccacccggggtattttggtaaagtcggcatgcgctacttccacaagctccgcaacaagttctactgccccatcgtcaacgtcgacaagctctggtctttggtgccgcaggaggcgaaggacaaggcggcggcgaacaaaggaaatgacgtgccgttgatcgacgtgacgcagtttgggtactttaaggtgttggggaagggggcgttgcctcagaaccagcctgttgtggtgaaggccaagctcatttctaagaccgctgagaagaagattaaggaagctggtggcgctgttgttctcaccgcctaggattttagggtttagatttgggggtttttttgcttattttcggagaattggggttttggtagattttttcttcgcctttgcttaatacaaacatcatgttattttgtgttattgagcttcttgaatgctaaaggttgaaacttttgttgcaatgcgttgctttattgtcaacattaatatgagaatttgattgctttcaaaacttaattgaaaagtttttggttgt

SEQ ID NO: 3125 - DNA, 1198 bp, Musa acuminata
cagaagccctagccgtggaggactagagaagccgccgtccaccgccatgacgacccgcttcaagaagaaccggaagaagagggggcacgtgagcgccggacacggacgcatcgggaagcaccggaagcaccccggtggccgcggcaacgccggaggcatgcaccaccaccgcatcctgttcgacaagtaccaccctggttacttcggcaaggtcggtatgcgctacttccaccgcctacgcaacaagttccactgccccgccctcaacgtcgaccgcctctggtccctggtccccgacgccgtcaaggacgctgccgccaaggacgccgccgccgctcccctcatcgacgtaacccagttcggatacttcaaggtcctcggcaaggggatgctgcccccgggccgctccgtcgtcgtgaaggccaagctcatctccaagatcgcagagaagaagataaaggccgcaggcggcgccgtcgtgctcaccgcttgatcctgtcggttagttccgtagcctaagaggtgatctcgacatcaaattctcctgcgttgttcggattttgatctaacgactcgtcttgattaccgtggttgcaaacacttagtaaagttcaatcatttcttgttctttctatgccattgccctcttgtcgacaactgccaagaatcgcaagctgtgggtatgttgcaagttgccatcttttgatgttgctccgtcaccattgtagcacattggcggtggtgcaccgacttcgaggtgaaattgattacaagggaaatccacaaagaagctttggctcaaaaaaggggaaattgaagttgggcagaaaaaaaaagagctttgcggaagaggaaagagagagcaacttgttatggttgcttagttgtttcagtgcctaatctgttttcatcctttcttttcctcgttggattctgaagtttgttttccttttgagtgagtcaaacatcttgtagacaacagaactatgaatgatgtcggggaagagattatgttgtcgatgcaaagaagctcatagtttgctgatgtggcccgagattgtctcacttagattaagtttatggctgttttgggaagatggtgatgtctgggtcgagctgtttatgtgtagtttacatgcaagtgagatgtgtttattgacctaggatgcaagtgagatgtgttatttgaccttggatg

SEQ ID NO: 3126 - DNA, 838 bp, Musa acuminata
cgaaaaccctagccgaggaggacgagagcagccgccaaccgccgccatgacgactcgcttcaagaagcaccgtaagaagcgggggcacgtgagcgccggccacggccggatcgggaagcacaggaagcaccccggaggccgcggtaacgctggcggcatgcaccaccaccgcatcctcttcgacaagtaccaccccggctacttcggcaaggtcggcatgcgctacttccaccgtctccgcaacaagttccactgccccgccgtcaacgtcgaccgcctctggtccctcgtccccgacgccgtcaaggacgccgccaccaaggacgccgccgccgctcccctcatcgacgtcacccagttcggatacttcaaggtcctcggcaaggggatgcttccgtcggatcgccccgtcgttgtcaaggccaagctcatctccaagattgccgaaaagaagatcaaggcagcaggaggcgccgtcgtgctcaccgcttgatcctgtcggttagttgcatagacagagagctgatttggacattacatttccctgctactgtgtttgaatcgttttgatgtgtttacttgaagagttgataaaccatttattgttcttgctaatcttattgtcattgcttctggttattcggatactgatctcatcaagaatttccgagaattgcaaacttcagttgcgatccaagttggcatctttcttcccttgtcaccttccactaaaaaggcaccaactttgagttgggattgattctagtagcaaatctaggaggaaaaaaataaagagtggaggagaatggttcggtgaaaagaaatgaaatgaggcaca

SEQ ID NO: 3127 - DNA, 901 bp, Musa acuminata
ggcaggaggcggcgttgacgatgacgacgcgcttcaggaagaaccggaagaagcgggggcacgtgagctccgggcacgggcgcatcggtaagcaccggaagcaccctggcggccgcggtaacgctggcggcatgcaccaccaccgtatcctcttcgacaagtaccatcccggctacttcggcaaggtcggcatgcgctacttccaccgccttcgcaacaaattctactgccccgccgtcaacgtcgaccgcctctggtccctcgtccccgaagctgtcaaggacgccgccgccgccaaaggcggcgccaccgcccccttggtcgacgttacccagtttgggtactttaaggtgcttggcaagggaattctgccgcctgaccggtccgtcgtggtgaaggccaaactcgtttccaagatcgccgagaagaagatcaaggccgccggtggcgccgtcgtgctcaccgcctgatccgcgcgatctgacggtcgtatcgtactcttctcgttatttccaagccatttttccttcctaatctgctcgaacttaatacttggattttagatcttgaagcgtagtgtagtgtttatgatgtgttcgatcttttgtctttgaaggtggtgcttggtctataattcacatttaggcaaatgcagttggtaatgccattgatgttgattagggttctactcatgtttgattggagcatctgtttctggttcataattattggtcttcataaatgaattaacctaaatatacactggtttgcaatcttacgactctacggagtagcatggtcactctatgtatgtctattcctttttacatgcttattatctccgcatagttatataaatgttactatgaatgattaattgtgttgaaccttccgatgttca

SEQ ID NO: 3128 - DNA, 755 bp, Elaeis guineensis
aggagaagagggcgaggatgacgacgcgcttcaagaagaaccggaagaagcgaggccacgtgagcgccggccacggccggatcggcaagcaccggaagcaccccggtgggcgcggtaacgccggtgggatgcaccaccaccggatcctcttcgacaagtaccaccccggttacttcggcaaggtcggcatgcgttacttccaccgcctccgcaacaagttccactgccccaccgtcaacgtcgaccgcctctggtctctcgtccccgacgacgtcaaggctgccgccgccgccgccggcggaagctccgcccccatgatcgacgtcacccagttcgggtatttcaaggtgctcggcaagggtatgctgcccccaacctgccccgttgtcgtgaaggccaagctcgtctccaagatcgccgagaagaagatcaaggaggctggcggcgccgtcgtgctcacggcctgatggtcatttcggctctgtttttggtcaggtcttggtttttgtctactgcttctctgaactccgatctcgttagtgggttttagatctggaaacccgtttttattggaatctggacgtgtttatatccaaatttcggatctaattatatatatgtttagagtaatgaagtgggtaagcatcgatccatttacttgatgatttaattttgtgtaagatttgaaatctcatgatggttttggcagatcgatcggatgaatatcagggtatctttagaatctgtagtttttt

SEQ ID NO: 3129 - DNA, 848 bp, Ricinus communis
aaaaatcggaaacaaaaaacacccaccattttccaccaccaagcaataaagccaccaaaaccctgagcacaacctaatcatcccgaaccccgccgctcaaaccctaaacacagcacacaaaccccaaaaatgacaacccgtttcaagaagaaccgcaagaagagaggccatgtaagcgcagggcacggccgtatcggaaagcacagaaagcatccaggaggtcgcggaaacgccggaggtatgcaccaccacagaattcttttcgacaagtaccatccggggtattttggtaaagttggtatgcgttacttccataagctgcgtaacaagttctattgtccaattgttaacatagacaagctatggtcaatgatacctgaggatgtgaaggataaagctaacaaagataatgtgcctttgcttgatgttactcagtttgggtactttaaggttttgggtaaaggtgttttgcctgagaatcagcctattgttgttaaggctaaacttgtttctaaaattgctgaaaagaagattaaagaggccggtggtgctgttgttcttactgcctaggtttagggttagggctcatttgtggatgttgttcttaaatttttggagttgttttaagaggttacttttgttataatgtctggatattttaatagtactgatttaatatgttttgcaattctacttctattttgattttgcttgcttattaaatgttctttatgcttagaattcttattttgcgtgctttatgtagaaatgagcaactattatgctctggttgattgaattaatgattcgatatctggcatatgtggaaaattttgcttggttatagc

SEQ ID NO: 3130 - DNA, 673 bp, Amsonia hubrichtii
catttacaccttctcgtcggccgctctctccacaactacacacagtgagacagagggaggcaggaatccaccatgacaaccaggttcaagaagaacaggaagaagagaggccacgtgagtgcaggacatggtcgtattggaaaacaccgaaagcatcccggaggaagaggtaatgctggtggtatgcaccaccacaggatcctcttcgacaaataccatcctgggtattttggaaaagttggtatgcggtacttccacaagctccggaacaagttctactgccccatagtcaacattgacaagctctggtcgatggtccctcaggatgtcaaagataaggccaccaaggacaacgccccagtgattgatgtcacccagtttggatacttcaaggttttgggtaagggagttttgcctgagaatcagcctgttgtcgttaaggctaagcttatctccaagactgctgagaagaagattaaggaggctggtggcgctgttgtgctcacagcttaagttttctgtttttatatggtctgatttattatagttacttgttttttagcactaaagtggatgtttttagacattttagtagtccttttttaatattaatcaatggtgaaatttgagcattatgtttttattggcaagtgtttgatgggatttattactt

SEQ ID NO: 3131 - DNA, 640 bp, Arnica chamissonis
ttcattcaccggcttctgctctagaagggtataatgacgaccggattgaggaagaaccgcaagaagcgcggccacgtcagcgccggtcacggtcgtatcggaaagcaccgaaagcatcctggaggtaggggtaacgccggaggtatgcaccaccatcggatcctcttcgacaagtaccatcccggatacttcggtaaagtcggtatgcggtattttcacaggctccgtaacaaattctactgccctatcgtcaacgtcgacaagctctggtcgctggtgccgcaagacgtgaaggagaagtctaccggcgataaggttccggtcatcgatgtcactcagcacggttacttcaaggtgttggggaagggtaatgtgccggcttctaaaccgttcgtagttaaggcgaagctcatttcgaaaactgctgagaagaagattaaggaagctggaggtgctgttctgcttaccgcctaggtttgttttttgattttcaatgctcagtatggttattactgttagtttcattgtcagaatactctgttttgctgaatttgaactcacatttatcaagttttgttgcaaaatccatcaatggtgttcattgtctaccccatttttttgtgctcagtatgattgaatt

SEQ ID NO: 3132 - DNA, 633 bp, Arnica chamissonis
tgacgccgttcttccccggattttcctttacaggggacaatgacgaccagcttgaggaagaatcgcaagaagcgtggtcacgtgagcgccggacacggtcgtatcggaaagcaccgtaagcatcctggaggtcgtggtaacgccggaggtatgcaccaccaccggatcctcttcgacaagtaccatcccggttacttcggtaaagtcggtatgcggtacttccacaggctccgtaacaagttccattgccctatcgtcaacgtcgacaagctctggtcaatggttccacaggacgtgaaggagaagtcttccgccgataaggttccggtcattgacgtcactcagtttggttacttcaaggtattggggaagggaaccgtgcctgcatctcagccttttgtcgttaaggccaaactcatctcgaagactgctgagaagaagatcaaggaagccggtggtgctgttttgctcactgcttaggtttgtctgttgatttcaattactgattatggttattactgttagtttcatttgcagattactctgttttgctgaaattggattcatatttgatttaagattttgtttcaacaacctttaattgtgttctattttatgttcaatccttttgtc

SEQ ID NO: 3133 - DNA, 1029 bp, Cannabis sativa
caagaagcctaattccttccttgcacccgtctcaatagaacgaaaccccaaaccctaagggcaaaacggtaaactcatatcagtccatgctcctcaaatcccatcttcgcacataaatctctccattacttcatcttctctcagccgccgaaaccctaggagagaagtttcagagagagagttcagaaatgactacccgattcaagaagaacaggaagaagcgtggtcacgtcagtgccggccatggaagagtaggcaagcacagaaagcatcctggaggtcgtggtaacgctggaggtatgcaccaccaccggattctcttcgacaagtaccatcctggttacttcggtaaggtcggtatgagatacttccacaagcttcgcaacaaattctactctccaatcgtcaacatcgacaggctctggtctatggtgcctcaggaggtgaaggataaggcaaccaaggacaacgttcccttgatcgatgtgactcagtttggttacttcaaggttttgggaaagggtgctttgcctgagaatcaacctgttgtagtgaaggccaagctcatttccaagatcgccgagaagaagattaaggctgccggcggcgctgtccttctcactgcttaggtttgcataattatttttctccagagtagtacaagttttgggttttatctgtttttattttatttttttcgttgtaatttttggttttataagacttattttgtctacattttgaattatatcttgaagagcttttaactatggatatttcttgcttatgcaatcgttacaattgatctttttcatcgatgcagtagataacccaattcgtgatatttagttttctttaacaataattattgttcgtctttgaaaatgcagtagataacccaattcgtgatatttggtagaacagagtttttctagtaatatgttcatatgaattaaaatagaatcatttctgttagacagtcatgttatttccaattgaagatttagcaatgctacaagttttacctta

SEQ ID NO: 3134 - DNA, 1372 bp, Ricinus communis
taacaaactcctgaaaccctagaggacaaaaatcggaaacaaaaaacacccaccattttccaccaccaagcaataaagccaccaaaaccctgagcacaacctaatcatcccgaaccccgccgctcaaaccctaaacacagcacacaaaccccaaaaatgacaacccgtttcaagaagaaccgcaagaagagaggccatgtaagcgcagggcacggccgtatcggaaagcacagaaagcatccaggaggtcgcggaaacgccggaggtatgcaccaccacagaattcttttcgacaagtaccatccggggtattttggtaaagttggtatgcgttacttccataagctgcgtaacaagttctattgtccaattgttaacatagacaagctatggtcaatgatacctgaggatgtgaaggataaagctaacaaagataatgtgcctttgcttgatgttactcagtttgggtactttaaggttttgggtaaaggtgttttgcctgagaatcagcctattgttgttaaggctaaacttgtttctaaaattgctgaaaagaagattaaagaggccggtggtgctgttgttcttactgcctaggtttagggttagggctcatttgtggatgttgttcttaaatttttggagttgttttaagaggttacttttgttataatgtctggatattttaatagtactgatttaatatgttttgcaattctacttctattttgattttgcttgcttattaaatgttctttatgcttagaattcttattttgcgtgctttatgtagaaatgagcaactattatgctctggttgattgaattaatgattcgatatctggcatatgtggaaaattttgcttggttatagcttgctgatttcttatttctgttgcaatttttaaatagctgtagcatttcttttagaagatcttagtgttttatgtgtatctgttatgtggaaattcttcttgatgaccattttttttctcatttagttcaactatcgtattttctttactttgtttcaggcatataaatagttacagattatgagttcttagtggttgaggttcttattatgataagtgttttgagtaattgaggtttttgaggatgaggagtgattagttggtttgataatatgtattagtgaatgcttatctccttgagtgattagtatgaagtctgatgcgttgagcattgaggaccaatgattttgaattttcaatttcaatagcattgcggtttacttggtttattggcagttattgttttcttgggatttttctgggtataatgtgaagagatcttgaagaatcttaatatgggttggggggggggtctgtaactgtgatgatgaaatttg

SEQ ID NO: 3135 - DNA, 648 bp, Catharanthus roseus
ccaaacctcagccaccccagtccccgacccacccaaactccgccgggaaaatgacgaccagattcaagaagaataggaagaagagaggtcacgtcagcgccgggcacggtcgtatcggaaagcacaggaagcatcccggaggtcgcggtaatgccggaggtatgcaccaccacaggatcctcttcgacaagtaccatccaggttatttcggtaaggttggtatgaggtatttccacaaactccgcaacaagttctattgtcctattgtcaatgtggacaagctctggtcccttgtgccctctgatgtgaaggagaaggcagatggaagcaatgcgcccgtgattgatgttactcagtatggatacttcaaggtcttgggtaagggtgtgttgccccagaaccaacctgtggttgttaaggctaagctcatctctaaaactgctgagaagaagattaaggaggctggcggcgctgtcgtgcttactgcttagggttctttttcttattttgcatttatctgagtatattttaaattttgagtactctttttaatttagttaatgatgttgaacttggatatgttggggtactgaagttttgttctgagcatgaaatactctactggaatagtactatggttaagtttct

SEQ ID NO: 3136 - DNA, 740 bp, Cleome gynandra
tacctttctgccgcaccaaggtatcttcatttctcatccagagaggcaacaatgacgaccagcttgaagaagacaaggaagaagagaggccacgtctccgccggacatggacgtattggcaagcaccggaagcatcccggaggtcgtggtaacgccggaggtatgcatcaccaccgtatcctctttgacaagtatcaccctggttacttcggtaaagtcggtatgaggtatttccacaagctcagaaacaagttctactgtccgatcgtgaacttggacaagctctggtccatggttcctcaggacgtgaaagacaaagcgagcaaagacaatgtgcccatgatcgatgtgacccagtttgggtacttcaaggttttgggtaagggtatgttaccggagaaccaacctgtcgttgtcaaggccaagcttgtgtcgaaaacggctgagaagaagattaaggaagccggcggcgctgtcgttcttaccgcttagtggtaggattttttggattatctgtttttatgtctttgtttagatcttcaattttgggattcgaacatcattatcttttctttttaatgttcatgtttgataacttaaatcttgttgctgatctacaaaatcaattaagagttgtgtcttaattatctgtttggtgtttgatgggttttatttattttatgattatcactttggaaaaatcgaatctttctttcaagtgttggattggtattatggtg

SEQ ID NO: 3137 - DNA, 701 bp, Cucurbita pepo
ccctgcaaattcttggaacctaattctccatcgttcgcagacgaaatgacgacccgattcaagaagaacaggaagaagcgcggtcacgtgagcgccggccatggtcgtatcggcaagcaccgtaagcatcctggtggtcgtggtaacgctggaggtatgcaccatcacagaatcctgtttgacaaataccatcctggttattttggaaaagttggtatgaggtacttccacaagctccgaaacaaattctattgccccattgtaaacgtcgacaagctctggtccctcgtcccccaggaagtgaaggacaaggcttctaaggataatgcccctttggttgatgttacccagtttgggtatttcaaagttttgggcaaaggggttttgcccgagaaccagcccatcgttgtgaaagccaagctcatctcgaaaattgcagagaagaagatcaaggagaatggtggtgctgttgtcctaacggcttaggtttattgggtaactcttagttctatggttttgtttccaaattaattctgatatttcttgtggggttcttcgaagtattggattaatgttatcaaactctgtgtttcagttttcttcactttgaactcagtcaattttgaatgtttttcttgaattatcattctacttcgatgttatacattgttaatttcgctaatttcatggggtttcatata

SEQ ID NO: 3138 - DNA, 659 bp, Euphorbia peplus
atcttctccagagccgccgagaagacccaaggagccagccaaaatgaccacacgattgaagaaaaacaggaagaagcgtggacacgtcagcgccggtcacggacgtatcggaaagcacaggaagcatcccggaggtcgtggtaacgccggaggtatgcaccatcaccggatcttgttcgacaagtaccatcctggatacttcggaaaggtcggtatgcgatattttcacaagttgagaaacaagttctactgccctatcgtcaacatcgagaagctttggtcaatggttcctcaggaagtcaaagataaggccagcaaggacaatgttcccatgcttgatgtcactcagtttgggttttttaaggtcttaggtaagggtgttcttcccgatggtaaacctatggttgttaaagctaagcttatttccaagattgctgagaaaaagattaaggagaatggtggagctgttgttcttacagcttagcttgttttgtttgagtaaaaacttgagttttgtttttttaaattgttgttggagtatttagagctgagtattttatggttgtcgttgatacttgccgattttaatggagatgagtaattttagtgcttagatctattggtttgtgtttcgatgaaacatgattgtgtttttttct

SEQ ID NO: 3139 - DNA, 531 bp, Flaveria ramosissima
agggtttctgccgccttccttcaccgaacatctgcttcacaggcgaaaatgacgacgagactgaggaagaaccggaagaagcgcggccacgtcagcgccggtcacggccgtatcggaaagcaccggaagcatcccggcggcagaggtaacgctggaggtatgcaccaccaccggatcctgttcgacaagtatcatcctggatacttcggtaaagtcggtatgcggtacttccacaagctccgtaacaagttctattgcccgattgtgaacgtggataagctgtggtcgatggtgcctgaggatgtgaaggagaaggcgtctgctgataaggtgccggtggtcgatgtgacgcagtatgggttctttaaggtgttggggaaggggactgtgcctgcgtcgcagccgattgtggtgaaggcgaagctgatttcgaagaatgctgagaagaagattaaggaagctggtggtgctgttgtgctcactgcttaggtttgtggttttgattcttgttgatgagtattgttgttgctg

SEQ ID NO: 3140 - DNA, 600 bp, Flaveria ramosissima
tgtaactcagggtatctacagccgttctttcaccggcgtttgcttcaaaggataaaatgacgacaagattgagaaagaacaggaagaaacgcggtcacgtgagcgctggtcacggtcgtatcggaaagcaccgtaagcatcccggaggtcgcggtaacgctggaggtatgcaccaccaccggatcctcttcgacaagtaccatcctggttacttcggtaaagtcggtatgcggtacttccacaagctccgtaacaagttctactgccctatcgtcaatgtcgacaagctttggtcgatggtgccagaggacgcgaaggagaaagcctctgccgacaaggttccggtgattgacgttactcagcatgggtacttcaaggtgttggggaagggcaccgtgcctgcatctcagccgattgtcgttaaggcgaagctgatctcgaagactgctgagaagaagatcaaagaagctggtggtgctgttgtgctcactgcttaggtttgttttcttcattttggttatcagttatggatattattaatgttaggtttatttgcggattactttggtttgatgaacttggattcacatttgatataag

SEQ ID NO: 3141 - DNA, 534 bp, Flaveria ramosissima
agggtttctgccgcctttcttcaccgaacatctgcttcacaggcgacaatgacgacgagactgaggaagaaccggaagaagcgcggccacgtcagcgccggtcacggccgtatcggaaagcaccggaagcatcccggcggcagaggtaacgccggaggcatgcaccaccaccggatcctgttcgacaagtatcatcctggatacttcggtaaagtcggtatgcggtactttcacaggctccgaaacaagttccattgcccgattgtgaacgttgataagctgtggtcgatggtgcctgaggatgtgaaggagaaagcgagtggtgataaggtgccggtggttgatgttacgcagtatgggtactttaaggtgttagggaaggggactgtgcctgcgtcgcagccgattgtggtgaaggcgaagctgatttcgaagaatgctgagaagaagattaaggaagctggtggtgctgttgtgctcactgcttaggtttgttggtttctattcttgttgattagtattgttgttgctgtt

SEQ ID NO: 3142 - DNA, 533 bp, Flaveria ramosissima
agggtttctgccgccttccttcaccgaacttctacttcacaggcgacaatgacgacgagactgaggaagaaccggaagaagcgcggccacgtcagcgccggtcacggccgtatcggaaagcaccggaagcatcccggcggaagaggtaacgccggaggtatgcaccaccaccggatcctgttcgacaagtatcatcctggatacttcggtaaagtcggtatgcggtactttcacaggctccgaaacaagttccattgcccgattgtgaacgttgataagctgtggtcgatggtgcctgaggatgtgaaggagaaagcgagtggtgataaggtgcctgtggttgatgttacgcagtatgggtactttaaggtgttggggaaggggactgtgcctgcgtcgcagccgattgtggtgaaggcgaagctgatttcgaagaatgctgagaagaagattaaggaagctggtggtgctgttgtgctcactgcttaggtttgtggttttcatttttgttgattagtattgttgttgctgtt

SEQ ID NO: 3143 - DNA, 805 bp, Carpinus betulus
ccccaaacctacccctcctctcaagacctcgtctctcggccgccgaaaaccctaattcacacacacacacgcagagcgcgagagagatcgagaatgacgactaggttcaagaagagcaggaagaagagagggcacgtgagttgtggacatgggcgtatcggaaagcacaggaagcatccgggaggtcgcggtaacgccggaggcatgcaccaccaccggatcctcttcgacaagtaccatcccgggtatttcggcaaggtaggtatgcggtacttccacaggctccgcaacaagtttttctgccccatcgttaatgtagacaagctatggtccctggtccccaaggatgtgaaggaaaaagcctccaaggacaacgctcccctcattgatgtgacccagttcggctacttcaaggtcctcggaaagggcatgctgccagagaacctgcccatcgttgtcaaggcaaagctcatctccaaaaccgccgagaaaaagatcaaggaggccggtggcgctgttgttctcacagcttaggttccgcttgtgctttttgttattagttttttttttccttgaagttttgttctgtttgggaacttcagttaagacgtttcgtattgttacgattattatctgtttttcactgagatttaaatgatgggattattttatggttgcattatgttttttgcaatggtagaattaatggttttatgcttggtattatgtgatttttgttgtttcgctttagaagaactgtttttttgagttaaaataatgatgagcaattttattttagatgacc

SEQ ID NO: 3144 - DNA, 650 bp, Lippia dulcis
ccgcagcggcgccgaactctccaatcactctccgaaatccagaaatgacgacgagattcaagaagaaccgaaagaagcgcggccacgtgagcgccggccacggccgtatcggaaagcaccgcaagcatcccggaggccgtggtaacgccggaggtatgcaccaccaccgtatcctcttcgataagtaccatcccggttacttcgggaaggtcggtatgcgttacttccacaagctgcgcaacaagttctactgccccaccgtcaacatcgacaagctctggtctatggtgccgcaggaggtgaaggacaaggcttccaaggatagcgcgcctttgatcgatgtcacgcagttcgggtacttcaaggttttgggaaaaggcttgctgccggccgataagcccgtggttgtgaaggcgaagctcgtgtcgaagaatgccgagaagaagattaaggaagctggcggtgcggttgtgctcaccgcttgattaggttaattttgtttagttttactgtttttttttcaattatatgaatcgtgactgtcgctattgctggagagatttttatggaagtactctgatatatttttgccttaaatgttttgatttactctaatgctggaatttgcgttgattgtgatttggtgttta

SEQ ID NO: 3145 - DNA, 646 bp, Plantago ovata
gtattcctcccaaatcgccgtcgcaccacccaaaaaatgaccactcacctaaggaagaaccgtaagaagcgtggccacgtcagcgccggtcatggccgtatcggcaagcacagaaagcatcccggaggtcgcggtaacgccggtggaatgcaccaccacaggatcctgttcgacaagtaccatcccggttacttcggtaaggtcgggatgcgttacttccacaagctccgtaacaagttctactgccctaccgtcaatatcgacaggatctggtcgatggtgccgcaggaggtgaaggacaaggctggaaaggacagtgtgccgttggtcgatgtgacgcagtttggatacttcaaggtgttgggcaagggtttgctgccagaggggaagcctgtggtggttaaggcgaagcttatttcgaagaatgctgagaggaaaatcaaggaggctggcggtgctgttgttttgaccgcttgatttgagtcgactcgatttgattttgttagtgttttcgatggtattaattattaagcaaatgatagactactggattctatatcgagtaatttttggttacattgttcttatatattttaagattttcatttgctgttacatatgttatctgatcattttatgaagttga

SEQ ID NO: 3146 - DNA, 652 bp, Populus trichocarpa
ctaagaccgttcactctggtctctttgccgccgttcagaccctagacaactgatatctacccctctcaccaaaaaatgacgacccgcttcaagaagaaccggaagaagagagggcacgtcagtgctggccatggacgtatcggcaagcacaggaagcacccaggaggtcgtggtaatgctggaggtatgcaccaccaccggattctattcgacaagtaccatcctggttactttggcaaagtcggtatgcgttacttccacaagctccgcaacaagttccactgtccgatcgtgaacatcgacaagctctggtccatggtccctcaggatgttaaggacaaggcaaccaaggatactgtgccgatgatcgatgtcactcagttcgggtacttcaaagttcttgggaagggggttttgcctgagaagcaaccaatcgttgtcaaggccaagcttatttccaagattgccgagaagaagattaaagaggctggtggggctgttgtgcttactgcttaggtgagggtttttaagattttgagctgtccttgattttgttaaattcaagagattagtgatactgttggaccgtttgatattatggatactttatgtttttcttataaatctattggtattggcttatttatggctt

SEQ ID NO: 3147 - DNA, 843 bp, Populus trichocarpa
ctttcgcacatatatatatatatattttccaaaccctaagaccgttcactctggtctctctgccgccgttcaaaccctagacaactgatatctacccctctcaccaaaaaatgacgacccgcttcaagaagaaccggaagaagagagggcacgtcagtgctggccatggacgtatcggcaagcacaggaagcacccaggaggtcgtggtaatgctggaggtatgcaccaccaccggattctattcgacaagtaccatcctggttactttggcaaagtcggtatgcgttacttccacaagctccgcaacaagttccactgtccgatcgtgaacatcgacaagctctggtccatggtccctcaggatgttaaggacaaggcaaccaaggatactgtgccgatgatcgatgtcactcagttcgggtacttcaaagttcttgggaagggggttttgcctgagaagcaaccaatcgttgtcaaggccaagcttatttcgaagattgccgagaagaagattaaagaggctggtggggctgttgtgcttactgcttaggtgagggtttttaagattttgagctgtccttgattttgttaaattcaagagattagtgatactgttggaccgtttgatattatggatactttatgtttttcttataaatctattggtattggcttatttatggctttgtctcttgcattcatggccgggtcgaattgaattgattgtttgatgatgctaatttcactgtggtgctttgtgaatatgaaaccttactcttcctaatgctgacttgtttatgagggttctttttgcatggatataaaaatctttagttgccatt

SEQ ID NO: 3148 - DNA, 942 bp, Papaver somniferum
ttttctgaatctgagaaagggagagacgcagtcgcaaaaatgacaacccatttgaagaagaacaggaagaagagaggtcatgtatcagcaggtcatggacgtgtagggaaacatcgaaagcatcctggtggtcgtggtaatgctggaggtatgcatcaccatagaatcctgttcgataagtatcatcctggttactttggaaaggttggtatgcgttattttcataaactaaggaacaagttccattgtccaatcgtcaacatcgacaagctatggtcaatggtaccacaagaagtgaaagataaagcatcaagtgataaagcacctgttattgatgttactcagtttggatacttcaaggttttagggaaaggtgttctacctgagaatcaacctattgttgttaaggctaagttgatttctaagactgctgaaaagaagattaagcaagctggtggtgctgttgttcttactgcttagagaaacaatttgggatctagggtttccttcttcggaggtgatttttagattgaacccaagtttttcattagatctttatttttagtagtttaatctaaaagatttagattttatttgagagcactattacttttggatattgtgtttcagatattttgattaagtttatgcaagcaacattatatgaatctgtcagttgttttatgtcatgatttgttagctgattgatttgtgtttcttgattgttgtttattattttgtttctactgtttgtttaaatgtttaaatcttgcaagcttaattgttgtttaattaagttgtgcagtggagccctacaccttgaacattacatttgtggtggttggtgtatgtttaggtggtttcatcagtagaatattggtttccctgtagtgtcttaggatgagtttgtagttcttatatatatgtaacaagatgttggag

SEQ ID NO: 3149 - DNA, 755 bp, Sarracenia psittacina
agccgccaagagcgcgagagcgagaaatacagagcaacaatgacgacgcggttcaagaagaacaggaagaagagggggcacgtgagcgccggccacggtcgcatcggtaagcacagaaagcaccctggcgggcgaggaaacgccggagggatgcatcaccaccgcatcctcttcgacaagtaccaccctggttacttcgggaaggtcggcatgaggtacttccacaagctccgcaacaaattctactgccccatcgtcaacatcgacaagctctggtcccttgttccccaagacgtcaaggacaaggcctccccaaccagcgcccccttgatcgacgtcactcagttcggatacttcaaggtcctcggcaagggctttcttcctgcctcacagcctatcgtcgtcaaggccaagctcatttctaagaccgccgagaagaagatcaaggaggccggcggtgccgtcatcctcaccgcttaggtttgatttgctttatttcattagaatttaggcttcacatcttctctacacaaatgggcgtactttagatccgatctagttggacttcatgatgacatgtttttatttatggtgtttacctcttaattttgccgttcattttggtttctagtttcgattctaagcggactcagatctcattttgttgaagtgagtttctcttaattcaaagggagtaatgaactcgccgttagtgttaattgctctaattatcaatgagtgagatcagttagcat

SEQ ID NO: 3150 - DNA, 610 bp, Helianthus annuus
tgccgccttccttcattaccttttgctttacaggggaaaatgacgactagtttgaggaagaacaggaagaagagaggtcacgtgagcgctggtcacggtcgtatcggaaagcaccgaaagcatccaggaggtagaggtaacgctggaggtatgcaccaccacaggatcctattcgacaagtatcatcctggatttttcggtaaagttggtatgaggtacttccacaagctccgcaacaagttctattgccctatcgtcaacgtcgacaggctctggtcgcttgtgccacaagacgtgaaggagaagtctactgccgataaggttccagtcattgatgtgactcagcacgggtacttcaaggtgttggggaagggaaacgtgcctgcttcgcagccgtttgttgttaaggcgaagcttatttcgaaaactgctgagaagaagattaaggaggctggtggtgctgttttgctcactgcttaggtttgtttttttgaatttggatgatgagtattggtgttactgttagttttattgtgagattacgttgttctgatgaatttgaactcacattttatcaaagttttgttgcaaaatcctcaaattgtgttca

SEQ ID NO: 3151 - DNA, 614 bp, Helianthus annuus
ggtttctgccgccttccttcttcgcttttgctttacaggggaaaatgacgactagtttgaggaagaacaggaagaagagaggtcacgtgagtgctggtcacggtcgtatcggaaagcaccgaaagcatccaggaggtagaggtaacgctggaggtatgcaccaccacaggatcctattcgacaagtatcatcctggatttttcggtaaagttggtatgaggtactttcacaagctccgcaacaagttctattgccctatcgtcaacgttgacaggctctggtcgcttgtgccacaagacgtgaaggagaagtctactgccgataaggttccagttattgatgtgactcagcacgggtacttcaaggtgttggggaagggaaacgtgcctgcttcgcagccgtttgttgttaaggcgaagcttatttcgaaaactgctgagaagaagattaaggaagctggtggtgctgttttgctcactgcttaggtttgttttttgaatttggatgacgaatattcgtgttactgttagttttattgtgagattacgttgttctgatgaatttgaactcacattttatcaaagttttgttgcaaaatcctcaaattgtgttca

SEQ ID NO: 3152 - DNA, 679 bp, Tragopogon dubius
cggggagtggagttaacaaactctattcccaatcactgccgctgtttctcgccgggggtttgatttcaaggaggaatgacgacgagattgaggaagaaccgtaagaagcgcggccacgtcagcgccgggcacggtcgtatcggaaagcaccgaaagcatcccggaggtcgtggtaacgccggaggaatgcaccaccaccgtatcctcttcgacaagtaccatccaggttacttcgggaaagtcggtatgagatacttccaccgtctccgcaacaagttccattgcccgattgttaacgtggacaagctctggtctatggtgccacaggatgtcaaagaaaaggcttcagctgataaggttccagttgtggacgttactcaatttggttactttaaagtgttgggaaagggagccgttccgctgtcgcaaccaatggtggttaaggcgaagctcatttcaaagattgctgaaaagaagattaaggaggctggtggtgctgttttgctcaccgcttaggtttgttttcagtttttattatcactgttagattagggttcatggaaatttactctttttgttgcaaatcgaactttatgcatcatattctatttcaatttcaagacattatatatgtttgggttcatggacacctttttaatcccaaaacgctatttaatgt

SEQ ID NO: 3153 - DNA, 655 bp, Utricularia gibba
cggcggccgatccaggatgacgactcgattgaggaagaacaggaagaagcgcggtcacgttagcgccgggcacggccgtatcggtaagcacaggaagcatcccggaggtcggggaaacgcgggaggcatgcatcaccaccgcatcctcttcgacaagtaccatcctgggtactttgggaaagtaggtatgcgatacttccataagcttcgtaacaagttcttctgtccgaccgtcaatgtcgacaagctgtggtcgctggtgccggaggatgtgaaggagaaggcgtctaaggataaagtgcccttgatcgacgtcacgcaatttgggtatttcaaggttttgggtaagggaaccctgccggcggatcagcctgtggtggtgaaggcgaagcttgtctccaagaatgctgagaagaagattaaggaggctggaggtgccgttgtgctcactgcgtgattgaagttcattcaattggtattagtatcagatccctcatgttattgttatcgttcagtttcctgaagcagagatttgatttcgtgattctgtctctgaaacttcgttgcttttaccttcggttcattttcaaatggcttgccttgtgttcatggctttgattggaggaatttctttcattcttccacttagcctttc

SEQ ID NO: 3154 - DNA, 979 bp, Pseudotsuga menziesii
tatatttcaaccccttcgtaccctttcaagggtttaaaggtgttctagggtttctgcagcctcattattagggcaaaccaaattagggtttcgatttagaatcataaagcgccacaagcgcttgaagaaaccctttagaaggaggcagggccagaggcgaggaggaaggcaagtaagagcagagcagaggttggcaggatgactactagattgaagaagaacaggaagaagagagggcacgttagcgcagggcatggacgtatcggcaagcacaggaagcatccaggtggtcggggtaatgctggaggtatgcaccaccaccgtattctctttgacaagtaccatcctggctacttcggtaaggtcggtatgaggcatttccacaagctcaggaatcactatcactgccccatagttaatattgaaaagctgtggtctctggttcctgaggatgttaaggccaaggccaccgccgacagtgccccgctcatagacgttacccagtttgggtactttaaggtcttgggcaagggtgagctgccctcgcagcctatcgtagtcaaggccaagcttgtttccaagctggccgagaagaagatcaaggaggctggaggtgcagtcttgttgaccgcctgatgcgggttttaccattttggagtttaagtatttttaggcgttttaagttttatagcctttgctttcaggatttttatatctcagcgttttggggattaatgacgagttctatgaaaccttatatttttttaatggattatgttatttcttttccggatcattaccaaagagtctgtggtagatccctacttttattgctataatcaattttctatgtcatgaattgcagtaattctgaattggctgggcagaatcttacttggtgttttgaaaatatttatgttaattttcacgaacttaaggctgaatatgtgtttaagaatattgtaagcttgagctgtat

SEQ ID NO: 3155 - DNA, 609 bp, Secale cereale
ccggaagaagcgcggccacgtgtccgccgggcacgggcgtgtgggcaagcaccgcaagcatcccggaggccgcggtaacgccggaggcatgcaccaccaccgcatcctcttcgacaagtaccatcccggctacttcggcaaggtcggtatgcgctacttccacaagctcagcaacaggttctacaccccgacggtcaacgtcgagaggctctggtccatggtgccgtccgagaaggcggccgaggccggcggcgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgcagtcgtgctcgttgcctagggttctgttcgcgaccgtgcctcgagatctatatctgaagtattagttcgtttcccgtatctgaactatttgtgttgaacaagacatcgttagtttgttatcctggttcctgtgtaggtaaaccaacatcttatgagtaattttgcgctatgtcatggctagtttatatcagacgagttatccatatctgtgct

SEQ ID NO: 3156 - DNA, 886 bp, Cedrus atlantica
gcttgccagagcctagcacttcacatcaagatacccgacagtccagattcaataaccatcttatatttctgagtactgtaacttctacaatggcgctgatacaaccaaaataaaaagtaaacaaagacggaaatatttgtaaaagcaccaacgtcctaccaatgcaactgaggattaatgtaccgagggagcggtagaggcgaggaggaaggagaggcagagcaggatgacgaccagactgaagaagaacaggaagaagagagggcatgtgagcgcaggccacgggcgtatcggcaagcacaggaagcatccaggtggtaggggtaacgccggaggtatgcaccatcatcgcattctcttcgacaaataccatcccggttacttcggtaaggttggtatgaggcatttccacaagctcaggaaccactatcactgtcccatcgttaatatcgaaaagctttggtctctggttcccgaggacatcaaggccaaggccacccccgacagtgcacccctcatagatgttacccagtttgggtttttaaggttttgggcaagggtgaacttcccccgcagcccatcgttgtgaaggccaagcttatttctaagctggcggagaagaagatcaaggaggcaggcggggcagtaatgctgaccgcctgatcggggttttagggtttttgccgtcgatttcatatattttactgttgttagtgttttgcgtatcaatggacaaatttagtaaggattatattatttctgtttctcacttggaatccttcttctgaatacttgtgaacaaatactatatttaatttttgtttctaaatggtctgtgattttgagacctactttcaatgctattatcatttttctttggtgactt

SEQ ID NO: 3157 - DNA, 822 bp, Malus domestica
tatatatttcttcctaaaaaaaaccctagctcccaagctcctccatttcactccttggcagccgctccccaaaaaccctaggcggacaacgatgacgacgaggttcaagaagaaccgcaagaagcgcgggcacgtcagcgccggccatgggcgtatcggcaagcaccgcaagcaccccggcggtcgcggtaacgccggaggcatgcaccaccaccggatcctcttcgacaagtaccatccagggtatttcggtaaagtcggtatgaggtacttccacaggctgcgcaacaagttccattgcccgatcgtaaacctcgacaagctgtggtcgcttgtaccccaggaggtgaaggacaaggccgccgccgccaagggaggaagcgaggcgccgttgctcgacgtcactcagttcgggtacttcaaggtgttggggaagggcgtgttgccgtcgcagccgttggtggtgaaggccaagctgatttcaaagaccgccgagaagaagatcaaggaggctggtggcgccgtcgtgctcaccgcttaggtttattaaaccgatttgatatttctgatcgttttcccgagttttcattatctcatataatgtgctactttatttttgagatatggtactaaactttattgcttaattttagatcgtctttgtttttcatgcaaacagagaatgaaattgattttgttgactccatcttttacctgcatttcgaattcgtttcgatttacgggtgtttgattgggtgtgtgattatgtgtttgcttgctggatttaggtatgacttgaaaataaaatgattgatatcttaa

SEQ ID NO: 3158 - DNA, 553 bp, Capsicum annuum
  misc_feature (322)..(322): n is a, c, g, or t
tcagcagccgctccccaaaaaccctaggcggacaacgatgacgacgaggttcaagaagaaccgcaagaagcgcgggcacgtcagcgccggccatgggcgtatcggcaagcaccgcaagcaccccggcggtcgcggtaacgccggaggcatgcaccaccaccggatcctcttcgacaagtaccatccagggtatttcggtaaagtcggtatgaggtacttccacaggctgcgcaacaagttccattgcccgatcgtcaacctcgacaagctgtggtcgcttgtgccccaggaggtgaaggacaaggccgccgccgccaagggnggaagcgaggcgccgttgctcgacgtcactcagttcgggtacttcaaggtgttgggaaagggcgtgttgccgtctcagccgttggtggtgaaggccaagctgatttcaaagaccgccgagaagaagatcaaggaggctggtggcgccgtcgtgctcaccgcttaggttattaaccgatttgatatttctgatcgttttcccgagtttttccattatctcatataatgtgtc

SEQ ID NO: 3159 - DNA, 729 bp, Phaseolus vulgaris
ccctaattctatggtgcggccgctccgtgagatatagacagtgagggagagaagaacagatagagagtaggagaaaatgacgactaggtttaagaagaacaggaagaagagaggtcatgtcagtgccgggcacggccgtatcggaaagcacagaaagcatcccggaggtcgcggtaacgccggaggtatgcatcaccaccgtatcctcttcgacaaataccatccaggttacttcggtaaggtgggtatgcgctacttccacaagctccgcaacaagttctatgcccccattgtcaacatcgacaagctctggtcccttctcccccaggaggccaaggacaaggccaccgccgacaaggcgcccttgctcgatgtcacccagttcggctactttaaggttttgggtaaaggggttttgcctcagaaccagcctatcgttgtgaaggccaaacttatctccaagatcgctgagaagaagatcaaggaggccggtggcgccgttgttctcaccgcttaggttatttttgtttaaaaggattttgagatctgttatttgtcatatgtttttggtttttgtttcaatctctatctgtctggacctgattagtttaaatggtttttatatcctcaatgttctggattatatctcttttgcttcgtgttatttttgtcgaatccgtggtttacactattaaattgaacctcttgattgttcgatcgatgcgtatt

SEQ ID NO: 3160 - DNA, 872 bp, Mimulus guttatus
tccccaaatcttcagcctcaaatacaaaaaccctagtcccatttctccatctctcatcgcctccgttgcgccgccgatccacacacacacacagtaagcagcaatgacgacccgcctgaggaagaacaggaagaagagaggccacgtcagcgccggacacggccgtatcggaaagcaccgcaagcatcccggaggcagaggaaacgccggaggcatgcaccaccaccgcatcctcttcgacaagtaccatcccggatacttcgggaaggtcggtatgcgctacttccacaagctccgaaaccagttccactgccccattgtcaacatcgagaagctctggtcgatgattccacaggatgtcagggacaaggcgacaaaggacaacgcgccgatgatcgacgtcacccagttcggatacttcaaggttctgggcaagggactcctgccggagaacaagccgttggtcgtgaaggcgaagctcgtctccaaggtcgccgagaagaagatcaaggaagccggaggtgctgttgttcttactgcttagaatttcctgcatttctgtttttttcttttttaaaaagatgagatttttagatacagttttatgagttttttttttgtttcccgaacgtgatgctgttatattttaatttcagtttatgcagattttgcttatgcttagattcttttgcatttatgtttttcattctgattgttgctgctatgttttcacaaatgtgcatgctaggtgtttgtgaaattgtctctgtggcagtctgaaaaattcgcataatgcgtaatggtatttggatggcttgttagacatcttgaaataatcgaaagcttctgcactagaaatcgagtaatctgtg

SEQ ID NO: 3161 - DNA, 1087 bp, Mimulus guttatus
taattattcaaacaagaggggggttttcgtaatttgaccatacctcgggtggttgtaatttaccctcaataaaatctcgtacgaaaagcctttaacttatactcgcttatgcgtttttaggcgcaactacgtttctacactacactgatagaaaaagcccaatggcgatacatatatatataacctcctccaaaccctagatttcatttttcatcagcagcgccgatacacaccatttcctccgatctccccccaaatgaccaccgcactgaggaagaaccgcaagaagcgcggccacgtgagcgccgggcacggccgtatcggaaagcaccgcaagcatcccggaggtcggggtaacgccggaggaatgcaccaccaccggatcctgttcgacaagtaccatcccggttacttcggaaaggtcggtatgcggtacttccacaagctccgcaacaagttctactgccccacggtcaacatcgacaccctctggtcaatggtgccgcaggaggtcaaggacaaggccaccaaggacaacgcgccggtgattgacgtcactcagtttgggtacttcaaggttttgggcaagggtttgctgcccgccggtcagcccgtcgtcgtgaaggccaaacttgtatccaagactgctgagaagaagattaaggaagctggtggtgctgttttgctcactgcttagttagttttttttaatttaatttaatgcaatggggatttttatttttattattattattatggttgaaaagattttgattgaagggtggatttttaatattgctatgaatctgacattgacttttttattaagtgatttttggtattacagtagattattgaatttcatggaaatgttttcagggatctctctttgcttcattgccaaatatcgtaaagtatctgttgatttgattgatccttcgaaccgattctttttttgaatcgatatatattgttttgttatttgtgcaatcatagattatttgccaacttactttgacatggttttaagctgtgtgtgtgcaattgtgtatgataagtcggcttttaataaagcttcttctcttca

SEQ ID NO: 3162 - DNA, 1015 bp, Prunus mume
cttgcagtttacgacgccgttcaagataaacccccttccctatataatatacattcttcttccgagaaaccctagcaggcacctccatttcactcattggtagccgctactcagaaaccctaggcggacaaagagacaaagactcatgacgacgaggttcaagaagaatcgcaagaagcgtggccacgtcagcgccgggcatgggcgtatcggcaagcaccgcaagcatccaggcggtcgcggaaacgccggaggtatgcaccaccatcggatcctcttcgacaagtaccatccggggtattttggtaaagtgggtatgaggtatttccacaggctgcgcaacaaattccactgccccatcgtcaacctcgacaagctgtggtcacttgtaccccaggatgtgaaggacaaggccgccaaaggaaacgaggccccattgctcgacgtcacccagttcggctacttcaaggtgttgggtaagggcgtgttgcctagctcgcagccgttggttgtgaaggccaagctgatttctaagaccgccgagaagaagatcaaggaggctggtggagccgtcgtgctcactgcttaggttctcatccgttttgattttctaatcattttaaagcatttccattatcttataattggctacttttattattactgagatatgttattagactctatgcttattagatgtttttgtttccttatgccaacaaaaaactgaaatggattttgtggaccgttgctcatttttatatgtcaatcagttgctcaatttgaatttgttcgttttgattctgtgtttgcttgctgggatttagttataaatgaaaatggaatgattgatagcttcagaaattgggtacattttggcaatgtgttcaatctgaacctggtctgcttaagggactttctatatagctattgtaggagcggctttaacagttgttggtgtctgattggcttgtgcttgctggcaaagcgaggacattgttatactgtagcaaac

SEQ ID NO: 3163 - DNA, 574 bp, Ambrosia trifida
tttctgccgccgttcttcaccgtcttttcttatctacagtaggggaaaatgacaacaagattgaggaagaacaggaagaagcgcggccatgtgagcgcaggacatggtcgtattggtaagcaccgaaagcatcccggaggtcgtggtaatgctggaggtatgcaccaccaccggatccttttcgacaagtaccatcccggtttcttcggtaaagtcggtatgaggtacttccacaagctccgtaacaagttctattgcccaatcgtcaacgtcgacaagctctggtcaatggtgccacaagacgtgaaggagaaggcttctgccgataaggttccagtgatcgacgtcactcagcttggttacttcaaggtgttggggaagggaactgttcctgcatctcagccgtttgtcgtcaaagcgaaactgatatcgaagactgctgagaagaagatcaaggaagctggtggtgctgttgtgcttacagcttaggtttgttattttgtttcatctgcagattatattctgttttactaaaactgggttcacattagttttaaattttgttttggaaacc

SEQ ID NO: 3164 - DNA, 583 bp, Ambrosia trifida
gttcttcaccgtcttttcttatctacagtaggggaaaatgacaacaagattgaggaagaacaggaagaagcgcggtcatgtgagcgcaggacatggtcgtattggtaagcaccgaaagcatcccggaggtcgtggtaacgctggaggtatgcaccaccaccggatcctttttgacaagtaccatcccggtttcttcggtaaagtcggtatgaggtacttccacaagctccgtaacaagttctattgcccaattgtcaacgtcgacaagctctggtcaatggtgccacaagacgtgaaggagaaggcttctgctgataaggttccagtgatcgacgtcactcagcttggttacttcaaggtgttgggtaagggaactgttcctgcatctcagccgtttgtcgtcaaagcgaaactgatatcgaagactgctgagaagaagatcaaggaagctggtggtgctgttgtgcttacagcttaggtttgttatttcgtttcatctgttttgctcaaactcgatttacattagttttaagtattgttttggataccttaaatcgtcttctactttgctgagattttttgt

SEQ ID NO: 3165 - DNA, 541 bp, Ambrosia trifida
acagttcgccgccgctaatcaccggagttctcttttcaggctacaatgacgacccgattgagaaagaaccgtaagaagcgaggccacgtcagcgccggccatggccgtataggcaagcaccgtaagcatcccggaggcagaggtaacgccggaggtatgcaccaccaccgtatcctgttcgacaagtatcatccaggtttcttcggtaaggtaggtatgaggtacttccataggcttagaaacaagttctattgcccgatagtcaacgtagacaagctctggtcaatggttcctcaagaggtgaaagataaggcttcaggtgataaggtgcctgtggttgatgttactcagcttggatactttaaggtgttggggaaggggatggtgcctccgtctcagccaatggttgttaaggctaagcttatttcgaagactgctgagaagaagattaaggaagcaggtggtgctgttgtgctcactgcttaggtttgttttgttttaagtttttttttgtttattgttgtttgaattgttggatgat

SEQ ID NO: 3166 - DNA, 459 bp, Aquilegia formosa
aagaaagaagaagcgaaatgacgactggattgaagaagaacaggaagaagagaggacatgtatcagctggtcatggacgtattggaaaacatcgaaagcatccaggaggaagaggaaatgcaggaggaatgcatcatcatcgtatcttatttgataaatatcatcctggttattttggaaaagttggtatgcgttattttcacaagcttcgtaacaaattttattgtccaatagttaatattgataagttatggtctttggttccacaagaaatcaaagataaagctacacctgaaaatgctcctttgattgatgttactcaattgggttattttaaagttttgggtaaaggtatgttaccaccttctcaacctgttgttgttaaggctaagcttgtttctaaaaatgctgagaagaaaattaaggcagctggtggtgctgttattcttactgcctaga

SEQ ID NO: 3167 - DNA, 760 bp, Brassica juncea
agtacgcgggggctctttcagcaccttatataaaaaccaatctcttcacactccacagaaaaaaaaatccctagcatagatctgaagaaatggcgacggcgttgaagaagaacaggaagaagagaggccacgtcagcgccggtcacggacgtatcgggaagcaccgcaagcatcccggaggtcgcggtaacgcgggaggtatgcaccaccaccgtatcctcttcgacaagtaccatcccggttacttcgggaaggtggggatgaggtacttccacaagctccgcaacaagttctactgccccatcgtcaacctcgacaagctctggtcgctcgtccccgaggacgtcaaggccaaggccggcaaggataaggtgccgatgatcgatgtgacgcagcacgggttcttcaaggttctggggaaagggcatttgcctgagggcaagccgtttgtggtgaaggcgaagcttatttcgaagactgctgagaagaagattaaggaggctggtggtgccgtcgtgcttactgcctaaggtttcgttttgtgtttttgaatttgttatgctttttggatattttggaatgagacatcttttaattaatattaatggattatataatcgttgttttgagtttgattatggtattggtattgttagggactgtgttatgaacgctatgtcttttactttgatctcatttgcatgttagtcttgttcctagcctgcctgtactcttgctctaatatgattggtttaagagt

SEQ ID NO: 3168 - DNA, 693 bp, Brassica juncea
ggccctatcagatctgaccaaaaaatggcgacggggttaaagaagaacaggaagaagagaggccacgtcagcgccggccacgggcgtatcggaaagcaccgaaagcatcctggaggtcgcggaaacgcgggaggcatgcaccaccaccgcatcctcttcgacaagtaccatcccggttacttcggtaaagtgggtatgaggtacttccacaagctccgcaacaagttcttctgccccatcgtcaacctcgacaggctctggtcgctggtccccgaggacgtgaaggccaaggcagggaaggataaggtgccgatgatcgatgtgacgcagcacgggttcttcaaggtgctggggaaagggcatttgcctgagggtaagccgtttgtggtgaaggcgaagcttatttcgaagactgctgagaagaagattaaggaggctggtggtgctgttgtgcttactgcttaagtttgtaggtttggttttctatttttgtgtcttaatttgcttatcttttggaatcgttgttgaactcaaagttcgttgctttttatgtatttttggaatcagagatcttttaatcaatattattggattatattgattttggtgtttgaatatggtgtcgttattcgtgctttttcgaatgtttgctatgtatttattcactggtttcattagagttgttcagatcgg

SEQ ID NO: 3169 - DNA, 754 bp, Brassica juncea
gcaggagggaaaaggttcgagagatcggcgaaaatgacgacgagatttaagaagaacaggaagaagcgtggtcacgtcagcgccggacacggacgtatcggaaagcaccgcaagcatcccggaggtcgtggtaatgcaggaggtatgcaccaccacaggatcctcttcgacaagtaccatcccggttacttcggtaaagtcggtatgcggtacttccacaagcttcgcaacaagttcttctgcccgatcgtgaacctcgacaggctttggtcgttggtccctgaggatgtgaaggcgaaggctaccaaggataaggttccgttgatcgacgtgacgcagcacgggttcttcaaggtgttggggaaaggacatttgcctgagaacaagccttttgtggtgaaggcgaagttgatctcgaagactgctgagaagaagatcaaggaagctggtggtgccgtggtgctcactgcttaggtttatcacaagtttttattttctcatttttgctttttattgttgaatcttcactaaaacttatcctgttttggagtttggaacatggttgttatgacattgagattctggaatttttgccttgccattttctcttgtgtttgtggtttgcgtaattttggtagatttagaattgagttcattatgctggcatgattgttgatttgagttcattcatcgtcaagaacttcttacatggttggataatatgcatgtttggaacatcttcggattgataccc

SEQ ID NO: 3170 - DNA, 610 bp, Brassica oleracea
gctagccgcaggagaaaacctcgagaggagtcactgatcggcggaaatgacgacgagattcaagaagaacaggaagaagcgcggccacgtcagcgccggacacggtcgtatcggaaagcaccgcaagcatcccggaggtcgtggtaacgccggaggtatgcaccaccacaggatcctcttcgacaagtaccatcccggttacttcggtaaagtcggtatgcggtacttccacaagctccgcaacaagttctactgcccgatcgtaaacctcgacaggctgtggtcgctcgtccctgaggacgtgaaggcgaagtcgacgaaggacaaggtgccgttgatcgacgtgactcagcacggtttcttcaaggtgttggggaaaggtcatttgcctgagaacaagccttttgttgtgaaggccaagttgatctcgaagactgctgagaagaagattaaggaagctggtggcgctgttgtgctcactgcttaggttttatcgaaattttatcttctctttttggttttattgttggatgtttagtaatgaatctttgtcggaaaattttaagtggtttttatgacattgtgatatgccatgtttttgaacatgttt

SEQ ID NO: 3171 - DNA, 814 bp, Brassica rapa
tgagtcactttataactctactcttcttgaaaccctagccgcaggagaaaacctcgagaggagtcactgatcggcggaaatgacgacgagattcaagaagaacaggaagaagcgtggtcacgtcagcgccggacacggtcgtatcggaaagcaccgcaagcatcccggaggtcgcggtaacgccggaggtatgcaccaccacaggatcctcttcgacaagtaccatcccggttacttcggtaaagtcggtatgcggtacttccacaagctccgcaacaagttctactgcccgatcgtgaacctcgacaggctttggtcgctcgtccccgaggacgtgaaggcgaagtccacgaaggataaggtgccgttgatcgacgtgacgcagcacgggttcttcaaggtgttggggaaaggtcatttgcctgagaacaagccttttgttgtgaaggcgaagcttatctcgaagacggcggagaagaagattaaggaagctggtggtgctgttgtgctcactgcttaggttttatcgaaattttatcttctctttttggttttattgttggatgtttagtaatgaatctttgtcggaaaattttaagtggttttatgacattgagatatgcatgttttgaacatgtttgggtgttacctgcatttctgttgcatattgtgaatttgcttcggacatatgttcgttataatggctgtctagattgaattttgatcggttacgcgtggtgtgattagttgtggagtcactttagctgctagagtattaaactgcgttcattgtcaagagcatggaactctgaag

SEQ ID NO: 3172 - DNA, 766 bp, Brassica rapa
agcgctttcagctccctctatataaaaaccaatctcttcacactccacagaaaaaaaatcccaagcatagatctgaagaaatggcgacggcgttgaagaagaacaggaagaagagaggccacgtcagcgccggtcacggtcgtatcgggaagcaccgcaagcatcccggaggtcgcggtaacgcgggaggtatgcaccaccaccgtatcctcttcgacaagtaccatcccggttacttcgggaaggtggggatgaggtacttccacaagctccgcaacaagttctactgccccatcgtcaacctcgacaagctctggtcgctcgtccccgaggacgtcaaggccaaggcggggaaagataaggtgccgatgatcgatgtgacgcagcacgggttcttcaaggttctggggaaagggcatttgcctgagggcaagccgtttgtggtgaaggcgaagcttatttcgaagactgctgagaagaagattaaggaggctggtggtgccgttgtgcttactgcttaaggtttcgtttttgtgtttttgaatttgttatgctttttggatattttggaatgagacatcttttaattaatattaatggattatataatcgttgttttgagtttaaatgtggtgttggtattgttagggactgtgttatgaacgctatgtcctttactttgatctcatttgcatgttagtcttgttcctagcctgcctgtactcttgctctaatatgattggtttaagagtctctttgcttgttc

SEQ ID NO: 3173 - DNA, 789 bp, Brassica rapa
tgttcatgctcatctggtaccattgggtctaaagcactccacaaggcccattaaaagcccaaacactaaaccctagcccgtcgtctcctatataaaaaccttttaactcctcagaagaagcttagaagatctaatcaaaaaatggcgacggcgttgaagaagaacaggaagaagagaggccacgtcagcgcggggcacgggcgtatcgggaagcaccgcaagcatccgggaggtcgcggaaacgcgggaggcatgcaccaccaccggatcctcttcgacaagtaccatccgggatacttcgggaaagtagggatgaggtacttccacaagctccgcaacaagttctactgccccatcgtcaacctcgacaggctctggtcgctggttccggaggacgtgaaggccaaggcggggaaggatgataaggtgccgatgatcgacgtgacgcagcacgggttctttaaggtgttggggaaagggcatttgcctgagggcaagccgtttgtggtgaaggcgaagcttatttcgaagactgctgagaagaagattaaggaggctggtggtgctgttgtgctcactgcctaggttagattgatttttcgttttaattattgtctttatctgtttttgatatcgttgttgaacacaaagtttgttgctttattgatttttggaatgagagatattttgatcattatcattggattatactcatttggtgtttgaacatggtagctttggattatctaatgtatcattccagattcaatgttagctttgcttttgctc

SEQ ID NO: 3174 - DNA, 920 bp, Brassica rapa
aatccttattaggcccatttaatatacaagcccagatcaaatatgaaaaacctaggtcatcactataagtgtgtgctgcttgcttcttcagaaaaccctagccgcagggcgaaaatgacgacgagattcaagaagaacaggaagaagcgtggccacgtcagcgccggacacggacgtatcggaaagcaccgaaagcatcccggaggtcgtggtaacgccggaggtatgcaccaccacaggatcctcttcgacaagtaccatcctggttacttcggtaaagttggtatgcggtacttccacaagcttcgcaacaagttcttctgcccgatcgtcaacctcgacaggctttggtcgttggtccctgaggatgtgaaggcgaaggctaccaaggataaggttccgttgatcgacgtgacgcagcacgggttcttcaaggtgttggggaaaggacatttgcctgagaacaagccttttgtggtgaaggcgaagttgatctcgaagactgctgagaagaagatcaaggaagctggtggtgccgttgttctcactgcttaggtttatcacaaatttatcttctatttttgtttttgaatattcgctaaaacttatcctgttttggatcttggaacatggttgttatgacattgagattctggaatttttgccttgccattttctcttgtgtttgtggtttgcgtaattttggtagatttagaattgcgattacgttcattatgctggcatgattgttgatttgagttcattcatcgtcaagaacttcttacatggttggataatatgcatgtttggaacatcttcggatcgatactcgcattcacagtgcatttctcttgtcgagggttatgaattcgcttctacaaatgtttgatttgtcgttatatagttgtgtggattggatt

SEQ ID NO: 3175 - DNA, 561 bp, Brassica napus
aagaggaaatgacgaccagattcaagaagaacaggaagaagcgtggccacgtcagcgccggacatggtcgtatcggaaagcaccgaaagcatcccggaggtcgtggtaacgccggaggaatgcaccaccaccggatcctcttcgacaagtaccatcccggttacttcggtaaagtgggtatgcgatacttccacaagcttcgcaacaagttcttctgcccgatcgtcaacctcgacaggctttggtctctcgtccccgaggacgtgaaggcgaaagcgacgaaggacaaggttcctttgatcgatgtgacgcagcacgggttctttaaggtgttggggaaaggtcatttgcctgagaacaagccttttgtggtgaaggcgaagcttatctcgaagactgcagagaagaagattaaggaagctggtggtgctgttgttcttacagcttaggttttgttataacttgtcttgttttggatcttgagatttggaacttatgtttgattttataaatggttgttatgacaaaaaaaaaaaaaactagtagactagccaaggacga

SEQ ID NO: 3176 - DNA, 581 bp, Brassica napus
ggaggaaatgacgacgagattcaagaagaacaggaagaagcgtggccacgtcagcgccggacatggtcgtatcggaaagcaccgaaagcatcccggaggtcgtggtaacgccggaggaatgcaccaccaccggatcctcttcgacaagtaccatcccggttacttcggtaaagtcggtatgcgatacttccacaagcttcgcaacaagttcttctgcccgatcgtcaacctcgacaggctttggtcgctcgtccccgaggacgtgaaggcgaaagcaacaaaggacaaggttcctttgatcgatgtgacgcagcacgggttcttcaaggtgttggggaaaggtcatttgcctgagaacaagcctttcgttgtgaaggcgaagcttatctcgaagactgctgagaagaagatcaaggaagctggtggtgctgttgttcttacagcttaggttttgttataattaacttgtcttgttttggatcttgagttttggaacttatgttggattttataaatggttgttatgacatttgggtttacggtaaaaaaaaaaaaactagtaagtactagtccaggacacg

SEQ ID NO: 3177 - DNA, 1341 bp, Brassica napus
gggaaaaggttcgagagatcggcgaaaatgacgacgagatttaagaagaacaggaagaagcgtggtcacgtcagcgccggacacggacgtatcggaaagcaccgcaagcatcccggaggtcgtggtaatgcaggaggtatgcaccaccacaggatcctcttcgacaagtaccatcccggttacttcggtaaagtcggtatgcggtacttccacaagcttcgcaacaagttcttctgcccgatcgtgaacctcgacaggctttggtcgttggtccctgaggatgtgaaggcgaaggctaccaaggataaggttccgttgatcgacgtgacgcagcacgggttcttcaaggtgttggggaaaggacatttgcctgagaacaagccttttgtggtgaaggcgaagttgatctcgaagactgctgagaagaagatcaaggaagctggtggtgccgtggtgctcactgcttaggtttatcacaagtttttattttctcatttttgctttttattgttgaatcttcactaaaacttatcctgttttggagtttggaacatggttgttatgacattgagattctggaatttttgccttgccattttctcttgtgttaaaaaaaaaaaaaaaaaaaaaaaactcgagcaattgccaaacaagttacggtgccgtgtaggaaaccgtcattaaacgtttttaaaccctaaattcatcatgaatcgattcctttatatatattagcctcttcccttccttttaatactttgatcctctttgttatttttttctttcaatcaaaccctagttcctcccgatcatcggtactaatcgaatcaccatggctaagaactccttcaagctctctaatcctcttgagataagaatggctgaatctactcgcatcagagagaaataccaagacagagttcccgtgattgtggagaaagctgaacagagcgatgttcctgacattgacaagaagaagtatcttgtaccagctgatctaaccgttggacaattcgtctacgttgtgaggaaaagaatcaagcttggagccgagaaagcaatctttgtctttgtcaagaacacgctacctccaactgcggcattgatgtctgcaatctatgaagaacacaaagacgaagatgggtttctctacatgacatacagtggagagaacacatttggatcagcatgctaatattatctctgctttggcagtttgatcttgataatgattgtacattcctttccccccctctagcttttgctgtgtttcgtcgacttcaataatgtctttttactttctgggatttatatttttagctcttttttatctggatttaa

SEQ ID NO: 3178 - DNA, 734 bp, Brassica napus
cttctcaaagaaaccctagccgcaggagaaaacctcgagaggagtcactgatcggcggaaatgacgacgagattcaagaagaacaggaagaagcgcggccacgtcagcgccggacacggtcgtatcggaaagcaccgcaagcatcccggaggtcgtggtaacgccggaggtatgcaccaccacaggatcctcttcgacaagtaccatcccggttacttcggtaaagtcggtatgcggtacttccacaagctccgcaacaagttctactgcccgatcgtaaacctcgacaggctgtggtcgctcgtccctgaggacgtgaaggcgaagtcgacgaaggacaaggtgccgttgatcgacgtgactcagcacggtttcttcaaggtgttggggaaaggtcatttgcctgagaacaagccttttgttgtgaaggccaagttgatctcgaagactgctgagaagaagattaaggaagctggtggcgctgttgtgctcactgcttaggttttatcgaaattttatcttctctgtttggttttattgttggatgtttagtaatgaatctttgtcggaaaattttaagtggttttatgacattgtgatatgcatgtttttgaacatgtttgggtgttacttgcatttctgttgcatattgtgaatttgcttcggacatatgttcggttttgaggtaatccttcttctcccaccaagtaatagggcgtgttattcattactct

SEQ ID NO: 3179 - DNA, 653 bp, Brassica napus
aggagaaaacctcgagaggagtcactgatcggcggaaatgacgacgagattcaagaagaacaggaagaagcgcggccacgtcagcgccggacacggtcgtatcggaaagcatcgcaagcatcccggaggtcgcggtaacgccggaggtatgcaccaccacaggatcctcttcgacaagtaccatcccggttacttcggtaaggtcggtatgcggtacttccacaagctccgcaacaagttctactgcccgatcgtaaacctcgacaggctgtggtcgctcgtccctgaggacgtgaaggcgaagtcgacgaaggataaggtgcctttgatcgacgtgacgcagcacgggttcttcaaggtgttggggaaaggtcatttgcctgagaacaagccttttgttgtgaaggcgaagcttatctcgaagacggcggagaagaagattaaggaagctggtggtgctgttgtgctcactgcttaggttttatcgaaattttatctttccgtttttattttattgttggatgtttttagtaatgaatctttgtcggaattttttaagtggttttatgacattgagatatgcatgttttgaacatgtttgggtgttacctgcatttctgttgcatattgtgaatttgcttcggacatatgtt

SEQ ID NO: 3180 - DNA, 538 bp, Chelidonium majus
gagatgacgaccaggttcaagaagaacaggaagaagagaggtcacgtcagtgccggtcatggacgtatcggaaagcaccgaaagcatcctggaggtcgtggtaacgccggaggtatgcaccaccaccggatcctcttcgacaagtaccatcctgggtacttcggtaaggtcggtatgaggtatttccacaagctcagaaacaagttttactgccctatcgttaacatcgacaagctttggtctatgcttcctgaagatgtcaaggcaaaagctacccctgaaaatgctcctgtcattgatgttacccagtatggttacttcaaggttttgggtaagggagctttacccccatctcagcctattgttgttaaggctaaacttatttcaaagactgctgagaagaagattaaggaagctggtggtgctgttgttctcaccgcttagatttagtcaagtttatgattcaatcgtcttagatttttaggttttgaagtctgggtatggatcatttatattttatttgaagtacttttaacag

SEQ ID NO: 3181 - DNA, 665 bp, Cleome spinosa
tcgccttttctttataaatctcgggcgctccaaaaaaccctagccgcacggggagaggaagacctgtagattggagaggatgacgacaaggttcaagaagaacaggaagaagcgtggtcacgtctccgccggtcacggtcgtatcgggaagcaccggaagcatcccggaggtcgtggaaatgctggaggcatgcaccatcaccgtatcctcttcgacaagtaccatcccggttacttcgggaaggttgggatgaggtactttcacaagttgaggaacaagttccattgccccatcgtgaatctggacaagctatggtcgctcgtgcctcaagaggtgaaggacaaggccaccaaggacaacgctcccttgatcgacgttactcagtttggatacttcaaggtgttggggaaaggtgtgttgccggagaacaagcctatcgtcgtgaaggcgaagttggtgtctaaaaacgccgagaagaagataaaggaggctggtggcgccgtcgttctcaccgcctaggtcaggcaattttcctccttccatttcccttttaagtttctggtggactcgttttggtgttccgttttaatcgagatctcgattgtagaacctttatcggatctgatacatgtcattgttcagatttcagagttgatatgattag

SEQ ID NO: 3182 - DNA, 622 bp, Cleome spinosa
ttcgagagggaagcgacagcaatgacgacgagcctgaagaagacaaggaagaagcgaggccacgtctccgctgggcatggtcgtatcggcaagcaccggaagcatcccggaggccgtggtaacgccggaggtatgcatcatcaccgcatcctcttcgacaagtatcaccctggttactttggcaaagtgggcatgaggtacttccacaagctcaggaacaagttccactgtccgatcgtcaacctcgacaagatctggtccatggttcctcaggacgtgagggacaaggcgaccaaagacaacgtgcccatgatcgatgtgacccagttcgggtatttcaaggttttgggtaagggtatgttgccggagaaccaacctatcgttgtcaaggccaagcttgtgtcgaagaccgccgagaagaagatcaaggaggccggcggcgccgtcgttctcaccgcttagatggtaggattttctttctatacatctgtttgttatttttgttgttctagatctttgaattttggatttgaacatcattatccctttatcattatgtgtgttaactataacaactcgaagagcgttcttggctttttaatgtggatctatcgtccaattc

SEQ ID NO: 3183 - DNA, 797 bp, Gossypium hirsutum
tctcgcggccgctcttaacccttcgtcctcccaacttccacacccatacgaaaatgacaacccgcttcaagaagaaccgcaagaagcgcggccacgtcagcgctggtcacggacgtattggtaagcacaggaagcatcctggaggtcgtggaaacgccggaggcatgcaccaccacaggatcctctttgacaaatatcaccctgggtatttcggtaaagtcggtatgaggtacttccacaagctccgcaacaagttttactgccccattgtcaacatcgacaagctctggtctctcgtcccacaagacgtgaaggcaaaagccaacaaggacgccgcgccgatgatcgacgtgacccagttcgggtactttaaggtccttggaaagggtgttttgcccgaggaccaaccgatcgtggttaaggctaagttggtgtccaagacagctgaaaagaagattaaggaggctggtggtgctgttgtgctcaccgcctaggttagcttttctgtttttgtggttttggatttgaatgacatttctgttatattattatcttatgttgtttggagttgatctagaaatgagattttcaatttattttggtcaattatatatgaagtctgcgacgatttgggtttattatgtttgttttgttgtgttttacgttgttgaatgtcgttggtttagtcttaatgacttggtttaaacagacttgtgtttaccctgccccttattgcacctttcgttgtctttctcgtatgatatcaaatctaaatgtacttgtccaagtttgttcgg

SEQ ID NO: 3184 - DNA, 695 bp, Cucumis sativus
cgctcgccgctccctccatctctgaaaacctaattcccttcctctcgccgacgaaatgacgacccgcttcaagaagaacagaaagaagcgcggtcacgtgagcgccgggcatggtcgtatcggcaagcaccgtaagcatcctggtggtcgtggtaacgccggaggtatgcaccaccacagaatcctcttcgacaaataccatcctggttacttcggtaaagttggtatgaggtacttccacaagctccgtaacaaattctattgccccattgtaaacgtcgacaagctctggtctctcgtccctcaggaggtcaaggacaaggcttctaaggataatgttcctttgattgatgttactcagtttgggtattttaaagttttgggtaaaggggttttgcctgagaacaagcccgtcgttgtgaaagccaagctcatctcgaaaatcgcagagaagaagatcaaagaaaatggtggtgcggttgtccttacggcttaggtttattgggtaacttttagttatgattttgttttgaaattagttttgatatctcatgtggctttattcgaagtattggattaatgttatcatcaaacatcgtgtttcagttttcttcactttgaactcagtccgattttgaatgtgtttcttgaattatcatttttcttgaatgttatacattgtcaatttcgctaat

SEQ ID NO: 3185 - DNA, 874 bp, Euonymus alatus
aattaaatcatcttcaagccctagcctccattcgattcccttctgccatccccgccgctctcgaaccctgcagatcgaacctactatctcctagaatgacaactaggttgaagaagaaccgtaagaagcgtggccacgtgagcgcaggccatggtcgtattggcaagcaccgaaagcatcccggaggtcgtggtaatgccggaggaatgcaccaccaccgtatcctcttcgacaagtatcacccgggttattttggtaaagtcggtatgcgctacttccataagctccgtaacaagttctactgcccgattgtcaacgtcgataagctctggtcaatggtaccccaagaggtcaaggacaaggcatccaaggataatgtgcccatgcttgatgtaactcagttcgggtactttaaggtgttggggaagggagtcttgccggaaaacaagccgatcgtgttaaaggccaagctcgtgtccaagattgccgagaagaagattaaggagaacggcggagcagtggtgcttgttgcttaggttcggcgccttttttttggttaggtttcgtatttccgctttttgagtatatcaagacatttttcttgtgatagttggcgatgttatatttctggatcttttattacgtttttttaaggcaaaggttttactaagtatgttccgtgaaatctgaaatgggtggattgtctcttggtttgtgcctgatcatgtgtcactattcgtgtaattgaccaggagcaaatagtttatgcattgtgtggttaagagctggttttgttttcatgcgtagctaatgttatgatcttatttgatttgttgggaaatgataattgaatgtgtaaagacattgggattcc

SEQ ID NO: 3186 - DNA, 879 bp, Euonymus alatus
tttcctctcctcaattaaatcatcttcaagccctagcctccattcgattcccttctgccatccccgccgctctcgaaccctgcagatcgtacctatcatctcctagaatgacaactgggttgaagaagaaccgtaagaagcgtggccacgtgagcgcaggccacggtcgtattggcaagcacagaaagcatcccggaggtcgcggtaatgccggaggaatgcaccaccaccgtatcctcttcgacaagtatcacccgggttattttggtaaagtcggtatgcgctacttccataagctccgtaacaagttctactgcccgattgtcaacgtcgataagctctggtcaatggtaccccaggaggtcaaggacaaggcatccaaggataatgtgcccatgcttgatgtaactcagttcgggtattttaaggtgttggggaagggagtcttgccggaaaacaagccgatcgtgttaaaggccaagctcgtgtccaagattgccgagaagaagattaaggagaacggcggagcagtggtgcttgttgcttaggttcggcgtcctttttttttggttaggtttcgtatttccgctttttgagtatatcaagacatttttcttgtgatagttggcgatgttatatttctggatctttattatgttttttgatggcaaaggttttactaagtatgttccgtgaaatctgaaatcggtggattgtttcttggtttgtgcctgatcatgtgattgtgtgtcactattcgtgtaattgaccaggagcaaatagtttatgcattatgtggttaagagctggttttaatttcatgcatagctaatgttatgatcttatttgatttgttgggaaatgataattgaatgtgac

SEQ ID NO: 3187 - DNA, 642 bp, Flaveria ramosissima
tctcgagtctcgactgtaacacagggtatctacagccgttcttcaacggcgtttgcttcaaaggggatataatgacgactagattgaggaagaatcggaagaagcgcggtcacgtgagcgccggccatggtcgtatcggaaagcaccgtaagcatcctggaggtcgcggtaacgccggaggtatgcatcaccaccggatcctcttcgacaagtaccatcccggttacttcggtaaagtcggtatgcggtacttccacaagctccgtaacaagttctactgccctatcatcaacgtcgacaagctctggtcgatggttccggaggacgtgaaggcaaaggcctccgccgataaggttccggtgattgacgtcactcagcatgggtacttcaaggtgttggggaagggcactgtgcctgcatctcagccgattgtcgttaaggcgaagctgatctcgaagactgctgagaagaagattaaagaagctggtggtgctgttgtgctcactgcttaggtttgttttcttgattttggctatcagttatggttattgatgttagtttttgttgcggattactttgctttgatgaaattggattcacatttgtataagttttgtgttgaatatctttgattgtgatatt

SEQ ID NO: 3188 - DNA, 1072 bp, Gossypium raimondii
ccatcaatcaacatattcagccaaaagcccattcattagggccgaaccacagccataaattatccacaaccctagagtaagggcaaatccggaaacgaaaaactcctctccaaaatataattcgcacaaaaccctagtttcatttacacctctctcggccgctcttaacccttcgtcctcccaacttccacacccatacgaaaatgacaacccgcttcaagaagaaccgcaagaagcgcggccacgtcagcgctggtcacggacgtattggtaagcacaggaagcatcctggaggtcgtggaaacgccggaggcatgcaccaccacaggatcctctttgacaaatatcaccctgggtatttcggtaaagtcggtatgaggtacttccacaagctccgcaacaagttttactgccccattgtcaacatcgacaagctctggtctctcgtcccacaagacgtgaaggcaaaagccaacaaggacgccgcgccgatgatcgacgtgacccagttcgggtactttaaggtccttggaaagggtgttttgcccgaggaccaaccgatcgtggttaaggctaagttggtgtccaagacagctgaaaagaagattaaggaggctggtggtgctgttgtgctcaccgcctaggttagcttttctgtttttgtggtttttggatttgaatgacatttctgttatattattatcttatgttgtttggagttgatctagaaatgagattttcaatttattttggtcaattatatatgaagtctgcgacgatttgggtttattatgtttgttttgttgtgttttacgttgttgaatgtcgttggtttagtcttaatgacttggtttaaacagacttgtgtttaccctgccccttattgcacctttcgttgtctttctcgtatgatatcaaatctaaatgtacttgtccaagtttgttcggtttggctctgctcgtgatatgatttgaagtttgtaggcaaaatgtgcagagcaagagatgaagcctttaaattttttttaaccattttgtaatcgtatctttcaaccacagaaacctgcaccca

SEQ ID NO: 3189 - DNA, 999 bp, Vitis vinifera
ctagctttgggagtgggaatggagactttgagactacaggctacagagaatgaaaagaaaaaggccggttgggttaaataaaagagatcccatgataaattttgagccctaatggatgaattagaatgaatcgtaacaaaaggggcaaaatggtcaaatcggaatcctcaccctcccaataaatccccccaaaccctagctccatccttcgccgcatctcccatatacgcagtagcagcacaggagggagagagaggagagaatgacgactcggttcaagaagaacaggaagaagcgcggccacgtcagcgccggccatggccgtatcggaaaacatagaaagcatcccggtggtcgcggtaacgccggaggtatgcaccatcaccgaatcctcttcgacaagtaccatcctggttacttcggcaaggtcggtatgcgatacttccacaagcttcgtaataagttctactgcccgatcgtcaacatcgacaagctctggtcccttatcccccaagatgtcaaggataaggcctctcccgagaacgcccccttgatcgacgtcactcagtttggctatttcaaggttttgggtaaaggagctttgccggagtcgaagccgattgttgtgaaggccaagctggtgtcgaagatcgccgagaagaagattaaggaggccggcggtgccgttgttctcactgcctaggtttgcttgctcctttttttttaaaataactttttgaggattattacggcttcgttattgattaggtttttggtggattttgattgttttcttgttgactctgagatgttgaaccttttgaggtgttatcttatccctttgttatcaatcaatatggagttatttagtatcttagttttaaaaatatgtggatttatgctgccctattggagcttttgaagtatagattcttgtttcatcaagcaatttgatagtgtgtggcattctcgtttattaaaaagaacgttgttggatgc

SEQ ID NO: 3190 - DNA, 627 bp, Actinidia deliciosa
  misc_feature (150)..(150): n is a, c, g, or t
  misc_feature (261)..(261): n is a, c, g, or t
gaagccctatcacagccgcctccgcccggatctagagagagagaaatgacgacccgcttcaagaagaaccggaagaagcggggccacgtgagcgccggccacggccgcatcggcaagcaccggaagcatcccggtggccgcggaaatgcnggtggcatgcaccaccaccgcatcctcttcgacaagtaccaccctggttacttcggaaaggtcggcatgaggtacttccacaagctccgtaacaagttctactgcccaatngtcaacgtcgacaagctctggtccctcgtaccccagcacgtcaaggaccaggccacaccggataatctccccctcatcgacgtcactcagttcggctacttcaaggttctcggcaagggcgtgttgccaccgtcgaagccggtcgtcgtcaaggccaagatcgtgtccaagaacgccgagaagaagatcaaggaggccggcggcgccgtcgtgctcaccgcttaggtttggttttgatttattttctagttgttttattgatcggatatttagtttttgatggtccatggttatgttaaactttagagaattgatgtgttacgttttgagctcaattcatataaatttcctgtgcttaactttaaa

SEQ ID NO: 3191 - DNA, 1052 bp, Lactuca sativa
tgtcttataaaatggcccttcattagtagactacaagcctacactttcaagcccatcaagtgatacgccctgccatattttcttacttgtttgctataaaaccaaagtagggtttcatttcctgcgctcgactattaacgcagggtttctgccgccgtcattcaccggaatttgcttaacagggtataatgacgaccagattgaggaagaatcgcaagaagcgtggccacgtgagcgctggacatggtcgtatcggaaagcaccgaaagcatcccggaggtcgtggtaatgccggaggtatgcaccaccaccggatcctcttcgacaagtaccatcccggttacttcggtaaggtcggtatgaggtatttccacaggctgaggaacaagttctactgcccaatcgtgaacgtcgacaagctctggtcgatggttccacaagacgcgaaggagaaggcttcagctgataaggttccagtcgtcgatgttactcaattcggatactttaaggttttgggaaagggagctgtgcctctttcacatcctatggttgttaaggcgaagctcatttcaaagtgtgctgagaagaaaattaaggaggccggtggtgctgttgttcttactgcttaggtttgtttttctatttttgatgttgattttgattattactgttagtttcaatggcagagtactcttaatttgctggatttgaactactttttgatcaaatttgtgttttaaacttcttacaaatgtgctttactcttctttgatgtgtttatctcgttgtgtttgaatgttttggaatgctatactttatatctgttagcttcactcaaaataaatatgaatgtgttcttacaaagtaaaacacagtgatttgaactttttttttattagatttcattatacccttgtttttagtatgtgaaaatattaatccttcgagtcgttacaatatgatcttagaggggttgcaaaactggtttttttaaaaatcgtttttggccaaatctgaattggttaaaatatgtttttgttttaagttggttt

SEQ ID NO: 3192 - DNA, 807 bp, Lactuca sativa
gttctggtaaaggcccacattcaatccagcccatgatccggtctaattttcagcctcttttataaaacgaaattagggtttccgttctatttcagtggagtttctaaactctattcccaatctctgccgcagtttctgatcggagtttgcttttaaggaacaatgacaacgagattgaggaagaatcgtaagaagcgcggccacgtgagcgccgggcacggtcgtatcggaaaacaccgaaagcatcccggaggtcgtggtaacgccggaggaatgcaccaccaccgtatcctcttcgacaagtaccatcccggttacttcggtaaagtcggtatgagatacttccatcgcctccgcaacaagttccattgtccaatcgttaacgtagacaagctctggtccatggtgccacaagatacaaaagagaaggcttcagccgataacgtaccggttgtcgacgtttctcaatttggttactttaaagtgttgggaaagggaatggttccgccgtcccatccgatggtggtgaaggcgaagctcatttccaagaccgctgaaaagaaaattaaggaggctggtggtgctgttctccttactgcttaggtttgtttttcagttgttaattccagttttgattatcagattaggggtttatgaatcatggattatcactctgttttgttgaaattgaaatcgaactatatgcatcgttattatattgattttgcttgcatgattaatatcatttttattaaagacacttcaaatcggtaatcatttgttatgttatcactacataaattaaac

SEQ ID NO: 3193 - DNA, 657 bp, Mimulus guttatus
atctctcatcgcctccgttgcgccgccgatccacacacacacacagtaagcagcaatgacgacccgcctgaggaagaacaggaagaagagaggccacgtcagcgccggacacggccgtatcggaaagcaccgcaagcatcccggaggcagaggaaacgccggaggcatgcaccaccaccgcatcctcttcgacaagtaccatcccggatacttcgggaaggtcggtatgcgctacttccacaagctccgaaaccagttccactgccccattgtcaacatcgagaagctctggtcgatgattccacaggatgtcagggacaaggcgacaaaggacaacgcgccgatgatcgacgtcacccagttcggatacttcaaggttctgggcaagggactcctgccggagaacaagccgttggtcgtgaaggcgaagctcgtctccaaggtcgccgagaagaagatcaaggaagccggaggtgctgttgttcttactgcttagaatttcctgcatttctgtttttttcttttttaaaaagatgagatttttagatacagttttatgagttttttttttgtttcccgaacgtgatgctgttatattttaatttcagtttatgcagattttgcttatgcttagattcttttgcatttatgtttttc

SEQ ID NO: 3194 - DNA, 686 bp, Mimulus guttatus
cctagatttcatttttcatcagcagcgccgatacacaccatttcctccgatctccccccaaatgaccaccgcactgaggaagaaccgcaagaagcgcggccacgtgagcgccgggcacggccgtatcggaaagcaccgcaagcatcccggaggtcggggtaacgccggaggaatgcaccaccaccggatcctgttcgacaagtaccatcccggttacttcggaaaggtcggtatgcggtacttccacaagctccgcaacaagttctactgccccacggtcaacatcgacaccctctggtcaatggtgccgcaggaggtcaaggacaaggccaccaaggacaacgcgccggtgattgacgtcactcagtttgggtacttcaaggttttgggcaagggtttgctgcccgccggtcagcccgtcgtcgtgaaggccaaacttgtatccaagactgctgagaagaagattaaggaagctggtggtgctgttttgctcactgcttagttagttttttttaatttaatttaatgcaatggggatttttatttttattattattattatggttgaaaagattttgattgaagggtggatttttaatattgctatgaatctgacattgacttttttattaagtgatttttggtattacagtagattattgaatttcatggaaatgttttcaggg

SEQ ID NO: 3195 - DNA, 489 bp, Parthenium argentatum
gtttctgcagccgttcttcacctgcttttcatctacagggaaaatgacaacaagcttgaggaaaaacaggaagaagcgcggacatgtgagtgccggacacggtcgtatcggaaagcaccgaaagcatcccggaggtcgtggtaacgctggaggtatgcaccaccatcggatcctctttgacaagtaccatcccgggtttttcggtaaagtcggtatgcggtatttccacaggctccgcaacaagttccactgccctatcgtcaacgtcgacaagctctggtcgatggtgccacaggacgtgaaggagaagtcgtctgcagataaggtcccggttattgatgtgacacagttcggttactttaaggtgttgggaaaggggactgttcctgcatcgcagccgattgttgttaaggcgaaactgatatcgaagactgctgagaagaagattaaggaagctggtggcgcggttgtgctcactgcttaggtttg

SEQ ID NO: 3196 - DNA, 725 bp, Platanus occidentalis
gggagatcccgaaggagcgagtagggttgcagagggagagaggaggagaaatgacgacccgtttcaagaagaacaggaagaagagaggccatgtcagcgctggccatgggcgtattgggaagcatcgaaagcatcccggaggccgcggtaatgccggaggcatgcaccaccatcggatcctcttcgacaagtaccatccaggttactttggcaaagtcggtatgcgttacttccacaggctccgcaacaagttctactgccccatcgtcaacatcgacaagctctggtccatgattcctcaagacgttaaggacaaggcttcccccgataacgttcccctcatcgatgtcactcagttcggttacttcaaggtgttgggaaagggtgtcttgccatcaactcagccgattgttgttaaggccaagaccatctcaaaggttgcggagaagaagatcaaggaggctggtggtgccgtcgtcctcacagcttaggtgaagctcttaacggtgatcggaactaccattacttgttcgttttctttagttagggtttaaattttgtgtgtttttttagttcgaaacagaacttgagtattatttggttacttttgaatatcattttgttttaattttgatctatcggtaactttaatgtagtttctttctaatagatatgttgaatggttgttgattgatgcaatgttatagtacttttaatactttttc

SEQ ID NO: 3197 - DNA, 854 bp, Populus trichocarpa
ccctgtggtaactcacccattgcagccgttcataaccctaaagaagcgatacctctcttcgaaaaccaaaaatgacaacccgcttcaagaagaaccggaagaagagaggtcacgtgagcgctggtcatggtcgtatcggaaagcacaggaagcaccctggaggtcgcggaaatgcaggaggcatgcaccaccacaggatcctcttcgacaaataccatcctggttacttcggtaaggtcggtatgcgctacttccacaagctccgcaacaaattccactgtcccattgtcaacatcgacaagctctggtccatggtcccacaagacgtcaaagacaaggcaaccaaggatactgtgcccatgattgatgtcactcagtttggttacttcaaggttcttggtaagggggttttgcctgagaagcaacccattgttgtcaaggccaagcttgtgtcaaagattgctgagaagaagattaaggaggctggtggagctgttgttcttacagcctaggttatgttcctttccaagattttgacttgtccttaaattaaacgtgtttagtgatacttttggatccttttataattttttatgttttttctgttggtaaattgggattttgcttatcacatggctctgtcctttggctctttttgatcctttcatttgtttagttgcttggattgatggtttgatgatgcttgttatgctgtgtttcttgaaaatgcttgactatgcttgttttagcaatgatgtgttcttgaaaatgcttgactatgcttgttttagagatgatagacatggttatgggtgcttttttgtcacttgatgaccaaaggttaggtgtacaaa

SEQ ID NO: 3198 - DNA, 1619 bp, Populus trichocarpa
cactaatatttttgagcatataatttctatttaatcaggtccagtatctcaaagcccattgaacaaagaactaccccgataacctagaggacaaaatcgtcaaccacaaaatccaatcaccactatatatagatccatcccaaaccctccctgtggtaactcacccattgcagccgttcataaccctaaagaagcgatacctctcttcgaaaaccaaaaatgacaacccgcttcaagaagaaccggaagaagagaggtcacgtgagcgctggtcatggtcgtatcggaaagcacaggaagcaccctggaggtcgcggaaatgcaggaggcatgcaccaccacaggatcctcttcgacaaataccatcctggttacttcggtaaggtcggtatgcgctacttccacaagctccgcaacaaattccactgtcccattgtcaacatcgacaagctctggtccatggtcccacaagatgtcaaagacaaggcaaccaaggatactgtgcccatgattgatgtcactcagtttggttacttcaaggttcttggtaagggggttttgcctgagaagcaacccattgttgtcaaggccaagcttgtgtcaaagattgctgagaagaagattaaggaggctggtggagctgttgttcttacagcctaggttatgttcctttccaagattttgacttgtccttaaattaaacgtgtttagtgatacttttggatccttttataattttttatgttttttctgttggtaaattgggattttgcttatcacatggctctgtcctttggctctttttgatcctttcatttgtttagttgcttggattgatggtttgatgatgcttgttatgctgtgtttcttgaaaatgcttgactatgcttgttttagcaatgatgtgttcttgaaaatgcttgactatgcttgttttagagatgatagacatggttatgggtgcttttttgtcacttgatgaccaaaggttaggtgtacaaatcatagtcctggagttgattcgtcactgaattcctcatggtaatttcatcactgggacagtcaattggtatcgatttccttattccgtgctaacatgtagctaaacaagcttctgtaattcgggcctgtttgtctttgcaccagtatccctagaacatttgtttcatactagcttgctatcttgcaattttaatgttaataattgttaattcttacatttttattttgcatttttcatggactcgtgtttcaccctttgtattcgataaatggagattgaggggtggaagtcgagtagaagttgcaatttttatagcattagttttattggttttgtaaaattttgtccatttttggtgggaatgagtggttgaagtggaaatctcaagtccccattgcccagagactgaggagtaaaagttgcaaagcttttagtattgggtttgttaggtttatcaaaggtttttgctcattactggtgggagtgagtggttgaagtagaaaattttactatagccattattcataaaatattgaagagctagacagaggcaatgtgaaaaattatcatgctggcacgttcaattacagcgctccagtgatcagggattccttag

SEQ ID NO: 3199 - DNA, 740 bp, Prunus persica
tatataatatatattcttcttcaaagaaaccctagcaggcacttccatttcactccttggtagccgctcctcagaaaccctaggaggacaaagagacagagactcatgacgacgaggttcaaaaagaatcgcaagaagcgtggccacgtcagcgccgggcatgggcgtatcggcaagcaccgcaagcatccaggcggtcgcggaaacgccggaggtatgcaccaccatcggatcctcttcgacaagtaccatccggggtattttggtaaagtcggtatgaggtacttccacaggctgcgcaacaagttccactgccccatcgtcaacctcgacaagctgtggtcacttgtaccccaggatgtgaaggacaaggccgccaaaggaaacgaggccccattgcttgacgtcacccagttcggctacttcaaggtgttgggtaagggcgtgttgcctagctctcagccgttggttgtgaaggccaagctgatttctaagaccgccgagaagaagatcaaggaggctggcggagccgtcgtgctcaccgcttaggttctcatccattttgattttctaatcattttaaagcatttccattatcttataatttgctacttttattattactgagatatgttattagactctatgcttattagatgtttttgtttacttacgccaacaaaaaactgaaatggattttgtggaccgttgctcattttttatatgtcaatcagttgctc

SEQ ID NO: 3200 - DNA, 620 bp, Rosa hybrid cultivar
ccctacgacactcagagagagagagagcagccatgacgacgaggttcaagaagaaccggaagaagagaggccacgtcagcgccgggcacggccgtatcggcaagcaccgcaagcatcccggcgggcggggaaacgccggaggcatgcaccaccaccggatcctgttcgacaagtaccacccggggtatttcggtaaagtcgggatgcgctacttccacaagctccgcaacaagttccattgccccatcgtcaacctcgagaagctctggtccatggtgccccaggaggtcaaggacaaggcgaccaagggcgaggctccgatgctcgacgtcactcagttcggctacttcaaggtcttgggcaaggggaagcttcccggatctcagccgttggttgtgaagaccaagctgatctccaaggtcgccgagaagaagatcaaggaggctggtggcgccgtcgtgctcaccgcctaggttttacttttggaattgtgtttttgttaagtttataatatgatgctacttgagcttaattgagagttttatcctaatgtttagaatgaaattggatcttaattttatgcctcattgttcagttttgatgttatggttattctaaaa

SEQ ID NO: 3201 - DNA, 630 bp, Senecio madagascariensis
ctcaccgccgccgcccgtcgccggagtcctccgtcaggtaaaaaatgacaactcgattgagaaaaaaccgaaagaagagaggacacgtgtcagccggacacggacgtatcggaaagcaccgtaagcatcccggaggtcgtggtaacgccggaggaatgcaccaccaccgtatcctcttcgacaaataccatcccggttatttcgggaaagtcggtatgcgttactttcacaaactccgtaacaaattctactgccccatagtcaacgtggacaagctctggtcaatggtcccacaagaagccaaaaacagtgccacatcagataaggttcccgttgttgacgtcactcagctagggtatttcaaggtgttggggaaaggagctgtcccggtgagtcatccgatggttgtcaaggccaagcttatatccaaagttgctgagaagaagattaaggaagctggtggtgcggttttgctcaccgcttaggtttgcttcttttatgtttttgtttatggttaattcatgttttaggatctgaattttgaatactttatatcaaattgataatgtcatctacttgttgcgattgaattgtttacttgctttttaggtattatgctgatttacgttt

SEQ ID NO: 3202 - DNA, 615 bp, Silene vulgaris
cttcctcaaaccaacagagagagagagagagatcagaaaggagggagccgccatgacaacccgcctaagaaagaacagaaagaagagaggtcacgtctcagcagggcacggtcgtatcggaaagcatcgcaagcatccaggaggtagaggtaacgccggaggaatgcatcaccaccggatcttgttcgacaaataccatccagggtattttggtaaagttggtatgcgttatttccatcgtcttcgtaacaagttccattgtcccactgtcaatctggacaagctttggtcaatggtccctgctgatgtcagagagaaagctgctaaggaaggaaaggctccattgcttgacgtcactcagtttggttactttaaggttcttggaaaaggtgtcttgcctgagggacaagctgttgttgttaagtctaagttgattagtaagattgctgagaagaagattaagcaaggtggtggcgctgttcttcttactgcttaattttactattaaatcttgttttcttttaattttagaagaaatgatacgctttttggcttcggattctagtttgtttatgttggatttctgggttttcatctagattcagatattttcag

SEQ ID NO: 3203 - DNA, 608 bp, Euphorbia esula
gccgagaagacccaaggagccaaaatgaccacccgatttaagaagaacaggaagaagcgtggtcacgtgagcgccggtcacgggcgtgtcggaaagcacaggaagcatcccggaggtcgtggtaacgccggaggtatgcaccatcaccggatcttgttcgacaagtatcatcctggatattttggaaaggtcggtatgcgatactttcacaagttgagaaacaagttctactgccctatcgtcaacatcgagaagctatggtcaatggttccccaggaagtcaaggataaggccagcaaggacaatgtccccatgctcgatgtcactcagtttggatttttcaaggtgctaggtaagggtgttcttcctgagaataaacctattgttgttaaagctaagcttatttccaagatcgctgagaaaaagatcaaggaaaatggtggagctgttgttcttacagcttgagttttgttttttgttgttattatctttggagtattagagatttacatgaattgagtttttttatggttatttgctgctactttctgatttgaattggaaatgagtaatttcagtgcttagatctattggtttgtttttggatg

SEQ ID NO: 3204 - DNA, 525 bp, Euphorbia esula
tgaagaagaatcgcaagaagagaggccacgtgagcgccggtcatgggcgtatcggaaagcacaggaagcatcccggaggtcgcggtaacgccggaggtatgcaccaccaccggatcctcttcgacaagtaccatccaggttatttcggaaaggtcggtatgcgatactttcacaagctccgcaacaagttctactgcccaatcgtgaatgtggagaagctctggtccatgattcctcaggacgtgaaggagaaggcgagcaaggataatgctccgatggttgatgttactcagtttgggtttttcaaggtgttggggaaaggagttttgccggagaatcagccgatcgtagtcaaggccaagcttatttcgaagattgccgagaagaagatcaaggaagctggtggcgccgtcgttcttactgcttaggtcagggtttatgtttactgtttttataattttgatttggagaattttcagagattgtttttggtataattgctggataaatagagattttatgatg

SEQ ID NO: 3205 - DNA, 718 bp, Tragopogon dubius
ggtattcgctataaaacagagatagggtttcatttcctgccctcgactataaagcagggtttctgccgccgtccattaccggatttcgcttaacaggggataatgacgaccagattgaggaagaatcgcaagaagcgcggtcacgtgagcgccggtcacggtcgtatcggaaagcaccgaaagcatcctggaggtcgtggtaacgccggaggtatgcatcaccaccggatcctcttcgacaagtaccatcccggttacttcggtaaggtcggtatgaggtatttccacaggctccgtaacaagttctattgccctatcgtgaacgtcgacaagctctggtcgatggttccacaagacgtgaaggagaagtcgtccgccgatagggttccggttctggatgtgactcagttcggttacttcaaggtgttggggaagggaagtttcccggcgtcgcagccattggttgttaaggccaagctcatttcaaagactgctgagaagaagatcaaggaagccggtggtgctgttgttcttactgcctaggtttgttttctgttttttaatgtcaattatgattatcaactttagtttcaatgacagagtggtttgattttgctgaatttgaacttacatttgatcgaaattttgttggagaatgtgttttacattgctatgattcttttttgtattttcatttgttttgattttactttgatcg

SEQ ID NO: 3206 - DNA, 658 bp, Tragopogon dubius
agttcctcctagaacagttactctaccctatcgtcgctgccgccacccgtcgccggatttttcctttgagggtagaatgacgaccagactaaggaagaaccgaaagaagagaggccacgtgagtgccggacatggtcgtatcgggaaacacaggaagcatcccggaggtagaggtaacgccggaggtatgcaccaccaccgtatcctctttgacaaataccatccagggtacttcgggaaagtcggtatgaggtacttccacaggcttagaaacaagttctattgccctatcgtcaacgtcgacaagctctggtccatggttcctcaggaagtcagagatcaggccaccgccgacaagatcccggtcgtcgatgtgacacagcacggatacttcaaggttttgggtaaaggaatggtgcccccgtcgcagccgatggttattaaggcgaaacttatttcaaaaacagctgagaagaagattaaggaggctggtggagctgttttgcttactgcttaggtgtgttttcagctgctgtatttttgtttttacaaatacttgcgcttttaggctgttttggtcctatttgaacatgaattttgtttcattttgagtttgtttgaaatacattagaccattttataaagtgatcaacttgtc

SEQ ID NO: 3207 - DNA, 733 bp, Tripterygium wilfordii
gccatccccgcggcttccgaactcaacagatcgaacctaccatcttccagaatgacaactaggttgaggaagaaccgcaagaagcgcggtcacgtgagcgcaggccacggccgtattggcaagcaccgaaagcatcccggaggtcgcggtaatgccggaggaatgcaccaccaccgtatcctcttcgacaagtatcatcctggttattttggtaaagtcggtatgcgatacttccacaagctccgtaacaagttctactgcccgattgtcaacgtcgataagctatggtcaatggtaccccaggaggtcaaggacaaggcatccaaggataatgtgcccatgcttgatgttactcagttcgggtactttaaggtgttggggaagggagtcttgccggaaaacaagccgatcgtggtgaaggccaagctcgtgtccaagattgccgagaagaagattaaggagaacggcggagctgtggtgcttgctgcttaggttcggcgccttttttggttaggtttcgtatttcagctttttttgagtatgtcaagacatttttcttgtgatagctggctatttagggatcagttatgggatattatatttttggatcttttatcttttttttatggcagagattgtgtttttgctaagtatgttccgtggaatctgaaatcggtggattgttcattggtttgtgcttgatcacaaaaaatagtttctccattatgtggtt

SEQ ID NO: 3208 - DNA, 560 bp, Euphorbia peplus
cactctaccaaaatagacaacaggcgacaggaagaaccgcaagaagagaggccacgtcagcgccgggcacgggcgtatcggaaagcacaggaagcatcccggaggtcggggtaacgccggaggtatgcaccaccaccggatcctcttcgacaagtaccatcctggatacttcgggaaggtcggtatgcgatacttccacaagcttcgcaacaagttctattgtccgatcgtcaacgtcgagaagctctggtccatgattcctcaggacgttaaggagaaggccagcaaggacagtgttcccatggttgatgttactcagttcggtttttttaaggtcttggggaaaggtgtcttgccggagaatcagcccattgttgtgaaggctaagcttatttcgaagattgccgagaagaagatcaaggaggctggtggcgccgttgtgcttactgcctaggttagggtttacgcttactgtttttatgattttgatttcgaggattttcgaggttgttttggtataattgctttatatttagagattttatgatgaatgacctttt

SEQ ID NO: 3209 - DNA, 574 bp, Flaveria ramosissima
gtcttacaaccaagggtttctgccgccttccttcaccgtacatctgcttcacaggcgacaatgacgacgagattgaggaagaaccggaagaagcgcggccacgtcagcgccggtcacggccgtatcggaaagcaccggaagcatcccggcggcagaggtaacgccggaggcatgcaccaccaccggatcctgttcgacaagtatcatcctggatacttcggtaaagtcggtatgcggtactttcacaggctccgaaacaagttccattgcccgattgtgaacgttgataagctgtggtcgatggtgcctgaggatgtgaaggagaaagcgagtggtgataaggtgcctgtggttgatgttacgcagtatgggtactttaaggtgttgggtaaggggactgtgcctgcgtcgcagccgattgtggtgaaggcgaagctgattcgaagaatgctgagaagaagattaaggaagctggtggtgctgttgtgctcactgcttaggtttgtggttttcattcttgttgattagtattgttgttgctgtttgaacttgcgtttttatcaaagatactatg

SEQ ID NO: 3210 - DNA, 905 bp, Fragaria vesca
tcagcgagtgagagcagcagcagcaatgacgaccagtttgaagaagaaccgaaagaagagaggccacgtcagcgccggccacggccgtatcgggaagcaccgcaagcaccccggcggcagaggaaacgctggagggatgcaccaccaccggatcctgttcgacaagtaccacccggggtattttggtaaagttgggatgagatacttccacaagcttcgcaacaagttctactgccccatcgtcaacgtcgacaagctctggtccttggtgccgcaggaggtcaaggacaaggcctccaaaaacgacgtgccgttgattgacgtgacgcagcacgggtacttcaagattttgggtaaggggaagctgccggcggaccggcctgtggtggtgaaggctaagcttatttcgaaggttgcggagaagaagatcaaggaggccggcggcgctgtggttctcaccgccttaggtttttttttttgcttgctttagatttatgtggattttgtggtttatacttttataaaataattgggattttagttaattttatgcattcttggttgattttggaaaattgagttggatttttgtgatgcttgcctaatgttcttcgaatttgatgacattttcgattcatgaattacagttggattcagtttttggaattacttagttactatatactaaagcaagcaggcagtgaatggtataatagagccccgagatgagctgttttctactagagtaccgattttgcttactgtgatatatatgcacctttgatttgtggaaatacattcaagttgcagtactattcagaactttgcttttgattcatgatcttttccttgtagtttcctctgtttaatgaatctgttcccgtttggatttctgatctatgaaa

SEQ ID NO: 3211 - DNA, 639 bp, Cedrus atlantica
gcatcttccaagtatattgggaagagtcagaacctagcgtatttcaactccgtaaaattttagggttttccgacgctccgttagggcaaactaaattagggtttccgtttaaagtcgtaaacacccaaatcctctcgcgggaaaccctattgaaggaggcagggccagaggcgaggaggacggcaaggcagagcagagcttcgcaggatgacgaccagattgaagaagaacaggaagaagagagggcacgtgagcgcaggccatggacgtatcggcaagcataggaagcatccgggtggtcggggtaacgctggaggtatgcaccaccaccgcattctcttcgacaagtaccatcccggttacttcggtaaggtcggtatgaggcatttccacaagctcaggaatcactatcactgtcccatagttaatattgaaaaactgtggtctctggttcccgaggatgtcaaggccaaggccaccgccgacagtgcccctctcgtagacgttacccagttcgggtattttaaggtcttgggaaagggggagctgccctcgcagcctatagtagtcaaggccaagcttatttctaagctggctgagaagaagatcaaggaggcaggaggggcagtcatgttgact

SEQ ID NO: 3212 - DNA, 874 bp, Cycas rumphii
ggtggatttttctgagggtttcgaaggaagagggagtgcaggatgacaacgaggctgaagaagaacaggaagaagagagggcacgtcagtgcagggcatggacgtgttgggaagcacagaaagcatccgggcggtagaggaaatgctggaggtctgcaccaccaccgtattctcttcgacaagtaccatcccggttactttggaaaggttggtatgaggcacttccacttgctcaggaataagtactactgccccattgtcaatgtagagaaattatggtctttggttcccgaagatatcaaagccaaggccacctcggataatgtgcccctcttagatgttacgcagtttgggtttttcaaggttttgggcaaaggagaattgccatctcagccccttgttgtcaaagccaaactcatttccaaattggccgagaagaagatcaaggaagctggcggcgctgttctgctgaccgcctgatcgggcttttaattcctggtatttttggtcagacacttgtttcctatatggcttttatcttcgtgagttgaacggattattttctaacatcttctcttggtccggttatttattgtaggtttaagtctaggtttttcattttcaaatccaagcacatcttgaatgcttccatggttttcccttctctccttattattattattgtttttggccccttatataggggcacacgaatgaatgtctcgaaccctcgcagtctttcatggtgcttggcagtggatactcaaaaggcttacaaatgaagatagaatttgctactttgtgaaaatttgtgaatcctcggagtattatttattattagtcaatccacaaagggagctttcttccatttacg

SEQ ID NO: 3213 - DNA, 943 bp, Picea glauca
tacatttgcaaggaaaaaaaaaagacattttagggtttccgccgctccatcaggacaaaccaaattagggtttcattttaaaatcgtaaaaccccagaaacgctcgagggaaaccctattgaaggaggcagggcctgaggggaaggagaaggcaaggcaggacagagcagaggttggcaggatgacgaccagattgaagaagaacaggaagaagagagggcacgtgagcgcaggtcatggccgtatcggcaaacacaggaagcatccgggtggtcggggtaacgctggaggtatgcaccaccaccgtattctcttcgacaagtaccatcctggctacttcggtaaggttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtattttaaggtcttgggcaaaggcgagctaccctcgcagcctatcgtagtcaaggccaagcttatttctaagctggccgagaaaaagatcaaggaggctggaggggcagtcatgttgactgcctgattgcagttttaccattttttgagttttagtacttttattcgatataggtttttaacctctgcttctaggatttttacatctgttagtgttttggggattaatggacagagttccatgaacccttgaaatttattatggattatttctgtctcgagtctttactaaaaagtctatggtagatcccaactttcaatgctatcatcatttttctatgtcatggattgcagtcattctgaactggttggccagaatcataatcggttggtatctttgaacatatttatgttaaatattattttactaagctaaggccagatatgtgtt

SEQ ID NO: 3214 - DNA, 888 bp, Picea glauca
gccgctccatcaggacaaaccaaattagggtttcattttaaaatcgtaaaaccccagaaacgctcgagggaaaccctattgaaggaggcagggcctgaggggaaggggaaggcaaggcaaggcaggacagagcagaggttggcaggatgacgaccagattgaagaagaacaggaagaagagagggcacgtgagcgcaggtcatggccgtatcggcaaacacaggaagcatccgggtggtcggggtaacgctggaggtatgcaccaccaccgtattctcttcgacaagtaccatcctggctacttcggtaaggttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtattttaaggtcttgggcaaaggcgagctaccctcgcagcctatcgtagtcaaggccaagcttatttctaagctggccgagaaaaagatcaaggaggctggaggggcagtcatgttgactgcctgattgcagttttaccattttttgagttttagtacttttattcgatataggtttttaacctctgcttctaggatttttacatctgttagtgttttggggattaatggacagagttccatgaacccttgaaatttattatggattatttctgtctcgagtctttactaaaaagtctatgatagatcccaactttcaatgctatcatcatttttctatgtcttggatcgcagtcattcttaactggttggccagaatcttaatcggttggtatctttgaacatatttatgttaaatattattttactaa

SEQ ID NO: 3215 - DNA, 889 bp, Picea glauca
caaattagggtttcattttaaaatcgtaaaaccccagaaacgctcgagggaaaccctattgaaggaggcagggcctgaggggaaggagaaggcaaggcaggacagagcagaggttggcaggatgacgaccagattgaagaagaacaggaagaagagagggcacgtgagcgcaggtcatggccgtatcggcaaacacaggaagcatccgggtggtcggggtaacgctggaggtatgcaccaccaccgtattctcttcgacaagtaccatcctggctacttcggtaaggttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtattttaaggtcttgggcaaaggcgagctaccctcgcagcctatcgtagtcaaggccaagcttatttctaagctggccgagaaaaagatcaaggaggctggaggggcagtcatgttgactgcctgattgcagttttaccattttttgagttttagtacttttattcgatataggtttttaacctctgcttctaggatttttacatctgttagtgttttggggattaatggacagagttccatgaacccttgaaatttattatggattatttctgtctcgagtctttactaaaaagtctatggtagatcccaactttcaatgctatcatcatttttctatgtcatggattgcagtcattctgaactggttggccagaatcttaatcggttggtatctttgaacatatttatgttaaatattattttactaagctaaggccagatatgtgtttaagaa

SEQ ID NO: 3216 - DNA, 838 bp, Picea glauca
cagaaacgctcgagggaaaccctattgaaggaggcagggcctgaggggaaggagaaggcaaggcaggacagagcagaggttggcaggatgacgaccagattgaagaagaacaggaagaagagagggcacgtgagcgcaggtcatggccgtatcggcaaacacaggaagcatccgggtggtcggggtaacgctggaggtatgcaccaccaccgtattctcttcgacaagtaccatcctggctacttcggtaaggttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtatttcaaggtcttgggcaaaggcgagctaccctcgcagcctatcgtagtcaaggccaagcttatttctaagctggccgagaaaaagatcaaggaggctggaggggcagtcatgttgactgcctgattgcagttttaccattttttgagttttagtacttttattcgatataggtttttaacctctgcttctaggatttttacatctgttagtgttttggggattaatggacagagttccatgaacccttgaaatttattatggattatttctgtctcgagtctttactaaaaaatctatgatagatcccaactttcaatgctatcatcatttttctatgtcttggattgcagtcattctgaactggttggccagaatcttaatcggttggtatctttgaacatatttatgttaaatattattttactaagctaaggcc

SEQ ID NO: 3217 - DNA, 833 bp, Picea glauca
ccgccgctccatcaggacaaccaaataggtttcatttaaatcgtaaaccccagaaacgctcgagggaaaccctattgaaggaggcagggcctgaggggaaggggaaggcaaggcaaggcaggacagagcagaggttggcaggatgacgaccagattgaagaagaacagaaagaagagagggcacgtgagcgcaggtcatggccgtatcggcaaacacaggaagcatccgggtggtcggggtaacgctggaggtatgcaccaccaccgtattctcttcgacaagtaccatcctggctacttcggtaaggttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtattttaaggtcttgggcaaaggcgagctaccctcgcagcctatcgtagtcaaggccaagcttatttctaagctggccgagaaaaagatcaaggaggctggaggggcagtcatgttgactgcctgattgcagttttaccattttttgagttttagtacttttattcgatataggtttttaacctctgcttctaggatttttacatctgttagtgttttggggattaatggacagagttccatgaacccatgaaatttattatggattatttctgtctttagtctttactaaaaagtctatgaaagatcccaactttcaatgctatcatcattttctatgtcttgggttgcagtcattctcaactggttggccagaatct

SEQ ID NO: 3218 - DNA, 705 bp, Picea glauca
cctgaggggaaggagaaggcaaggcaggacagagcagaggttggcaggatgacgaccagattgaagaagaacaggaagaagagagggcacgtgagcgcaggtcatggccgtatcggcaaacacaggaagcacccgggaggtaggggtaacgccggaggtatgcaccaccatcgcattctcttcgacaaataccatcccggctacttcggtaaggttggtatgaggcatttccacaagctcaggaaccactatcactgtcctatcgttaatatcgaaaaactgtggtctctggtccccgaggatgtcaaggccaaggccacccccgacagtgtcccgctcatagacgttacccagttcgggtattttaaggtcttgggcaaaggcgagctaccctcgcagcctatcgtagtcaaggccaaagcttatttctaagctggccgagaaaaagatcaaggaggctggaggggcagtcatgttgactgcctgattgcagttttaccccccctattttttgtagttttagtacttttattcgatataggttttaacctctgcttctaggatttttacatctgttagtgttttggggatttaatggacagagttccatgaacccttgaaattttattatggattatttctgtctttagtctttactaaaaagtctattgatagatcccagctttcaatgctatcatcattttc

SEQ ID NO: 3219 - DNA, 562 bp, Zostera marina
aaatcgctgcaaccatctcctgccgcgatgacaaccagattgaagaagaacaggaagaagagaggtcacgtgagtgcagggcatggacgtgtcggaaagcatcgtaaacatccaggaggtcgcgggaatgctggtggtatgcaccatcataggattcttttcgataagtaccatcctggatactttggaaaggtaggtatgcgatacttccataagctccgcaataaattttattgtcctaccgtcaatatcgaccggctctggtcgcttctccccgaagaggtgaaacaaaagtgcttcgaagcgggtgaaaatggtgctcctttgctcgatgtgacgcaatttgggtactttaaggtgctggggaaggggattttaccggaaggaaagcccatcgtcgtgaagaccaagttggtgagtaagaatgcggagaagaagatcaaggctaatggtggtgccgtcgttttaactgcttaatcttttcgttagggttttttctgtcaaaagaattgatttttgattctatcattttgttattcgtcaataaattctacattatttt

SEQ ID NO: 3220 - DNA, 590 bp, Zostera marina
atctcctgccgcgatgacaaccagattgaagaagaacaggaagaagagaggtcacgtgagtgcagggcatggacgtgtcggaaagcatcgtaaacatccaggaggtcgcgggaatgctggtggtatgcaccatcataggattcttttcgataagtaccatcctggatactttggaaaggtaggtatgcgatacttccataagctccgcaataaattttattgtcctaccgtcaatatcgaccggctctggtcgcttctccccgaagaggtgaaacaaaagtgcttcgaagcgggtgaaaatggtgctcctttgctcgatgtgacgcaatttgggtactttaaggtgctggggaaggggattttaccggaaggaaagcccatcgtcgtgaagaccaagttggtgagtaagaatgcggagaagaagatcaaggctaatggtggtgccgtcgttttaactgcttaatcttttcgttagggttttttctgtcaaaagaattgatttttgattctatcattttgttattcgtcaataaattctacattattttcgtcaattgtttttattcctaatggaataatgggtgaagagt

SEQ ID NO: 3221 - DNA, 671 bp, Zostera marina
aaacttcctcctccaacatctccgaagccctagtctccgccgcccgttcccgaaatgacgaccaggctgaaaaagaacaggaagaagaggggtcacgttagtgctggtcacggtcgtgtaggtaagcaccgtaagcatcctggaggacgtggtaacgccggaggtatgcaccaccatcggatcctcttcgacaagtatcatccaggttacttcggtaaggtcggaatgcgttacttccacaaactgaggaacaaattctactgtccaaccgtcaacatcgatcgtctctggtctttgctccctgaagaaacaaaggcgaaatgtcttaaagatggtgtcaatggtgcgccgttgcttgatgtgacgcagtttggttatttcaaggttttgggaaaaggtatgctcccagatggaaaaccgatcgttgttaagacgaagcttgtgagcaaaattgccgaaaagaagatcaaggccaatggcggtgctgttgtccttactgcttaaattaggttattgttgtttttctcctctcttttttgtcggatcttgataattattttccctttctgaattctatcatccttctttggattttgaatgcttgttgttttatgttttgatctatttaaaaaaaacgctttatcagatcatctttgcttcttcattgtttc

SEQ ID NO: 3222 - DNA, 754 bp, Zostera marina
atagaatctaaacctcatcgacaataaacttcctcctccaacatctccgaagccctagtctccgccgcccgttcccgaaatgacgaccaggctgaaaaagaacaggaagaagaggggtcacgttagtgctggtcacggtcgtgtaggtaagcaccgtaagcatcctggaggacgtggtaacgccggaggtatgcaccaccatcggatcctcttcgacaagtatcatccaggttacttcggtaaggtcggaatgcgttacttccacaaactgaggaacaaattctactgtccaaccgtcaacatcgatcgtctctggtctttgctccctgaagaaacaaaggcgaaatgtcttaaagatggtgtcaatggtgcgccgttgcttgatgtgacgcagtttggttatttcaaggttttgggaaaaggtatgctcccagatggaaaaccgatcgttgttaagacgaagcttgtgagcaaaattgccgaaaagaagatcaaggccaatggcggtgctgttgtccttactgcttaaattaggttattgttgtttttctcctctcttttttttgtcggatcttgataattattttccctttctgaattctatcatccttctttggattttgaatgcttgttgttttatgttttgatctatttaaaaaaaaacgctttatcagatcatctttgcttctttattgtttctcaattcttgattgtaacttaaattattgaaaatatcttctcatctaatctccga

SEQ ID NO: 3223 - DNA, 785 bp, Amorphophallus konjac
tcaagaagaacaggaagaagaggggccacgtcagcgccggccacggccggatcgggaagcaccggaagcaccccggtggtcgcggtaacgccggtggcatgcaccaccatcgcatcctcttcgacaagtaccacccgggctacttcggcaaggtcggtatgcgctacttccacaagctccggaacaagttctactgccccgccgtgaacgtcgaccgcctctggtcgctcgtcccggaggaggttaaggccaaggcgaagggcgacgggtcggcggcgccgctcctggatgtgacgcagttcggcttcttcaaggtgctcggcaagggcgcgctcccgccgtcgcagcccatcgtggtgaaggccaagctcgtctccaagatcgccgagaagaagatcaaggaagccggcggttccgtcgtcctcactgcctgatcggtatcgagcagtttggatcgtgtccctgtttttgttcttcttcttcttgtagggaaaacggagttctgtgcgtttgacacaatgttagtgcttattaagtttggaatagtctatgttcaacttttgaattttggttattttgattcggatctctttcgtgtactagatttgatatatagttcatgttttttgaaatctatttctcatttcagatcatgtgtgctagaacggaatggatttccagttatatgtgtgctttttggcggttttgattcagatctctgcttgttgagcgtcagattcaggtccctttctcattctagagatgattgacggtttattttcaat

SEQ ID NO: 3224 - DNA, 646 bp, Theobroma cacao
tcccttgcgccactcctcctttctttctgaagcagctgcctcaaagcgagacatacccagaaccaggaaatgacgacccgtttcaagaagcaccggaagaagagaggccacgtgagcgcgggccatggtcgtatcggcaagcacaggaagcatcccggaggtcgcggtaacgccggaggcatgcatcaccatcggatcctcttcgacaagtaccatccgggttactttggtaaggtcggtatgcgttacttccacaagcttcgcaacaagttctactgccccatcgtcaacatcgacaagctttggtctatggtccctcaagatgttaaagacaaggccaagtgttccaaggactctgcccctttgatcgatgttacccagttcggttactttaaggttttgggtaagggtgttttgcctgagaatcagcctattgttgtcaaagccaagcttgtttctaagactgctgagaagaagattaaggaggctggtggggctgttgtgcttactgcttaggctttttgaataatttttgaagatgttttagggtggactcgtagttatttttttcactcttaatgttattattagtacttaagtgtcatttcgttttgagttttgatttgcaatgaacttgtttactgat

SEQ ID NO: 3225 - DNA, 584 bp, Brassica napus
gcaggagaaaacctcgagaggagtcactgatcggcggaaatgacgacgagattcaagaagaacaggaagaagcgtggtcacgtcagcgccggacacggtcgtatcggaaagcatcgcaagcatcccggaggtcgcggtaacgccggaggtatgcaccaccacaggatcctcttcgacaagtaccatcccggttacttcggtaaggtcggtatgcggtacttccacaagctccgcaacaagttctactgcccgatcgtcaacctcgacaggctgtggtcgctcgtccctgaggacgtgaaggcgaagtcgacgaaggataaggtgccgttgatcgacgtgacgcagcacggtttcttcaaggtgttggggaaaggtcatttgcctgagaacaagccttttgtgtgaaggcgaagcttatctcgaagacggcggagaagaagattaaggaagctggtggtgctgttgtgctcactgcttaggttttatcgaaattttatctttccgtttttattttattgttggatgtttttagtaatgaatctttgtcggaattttttaagtggttttatgacattgagatatgc

SEQ ID NO: 3226 - DNA, 1393 bp, Cirsium arvense
gcgcggattgtgagaagaaaactgcttcctctgatctcttccgccttcctcttccctccttccctttccaaccagcaaccatgattattcccgagaagaatcgtaaggccatctccaaatacctctttcaagagggagtttgctttgcaaagaaggattacaatttggcaaagcatccggagatcgatgtgccaaacttgcaggtgattaagctgatgcaaagctttaaatcaaaggaatacgttcgtgagacatttgcctggatgcactactactggtatctcaccaacgatgggatcgagttcctcagaacttacttgaaccttccttccgacattgtgcctgctactctcaagaagtcagctaagcccctaggacgtcccatgggtggacctccaggcgaccgccctcgtggcccgccgagatttgaaggagacaggccgagatttggagatagggatggataccgtggcggacctagaggtcctccaggtgaatttggtggtgaaaagggcggagctccggctgattaccagcctgctttcaacaggggtcctggtggaaggccgagctttggtcgtggaggcggcagttatggaggtggcgcaccaccaagctcaagtttcgcttaaacatttcattcttcaagtgtttgcagttgaatttttgaactttatctcagtttgctgaatgctttgtttcacctttccatagcactggagttatattgattctctcttcctctattgaacttttaaatttagaatatacataaagattgtaggcattttttcaacaaggcaatcacttcataaaaatgatctattgtatatcaaaataagctcatcatgatgaaacaaaactcatgtttagcaaaacaaccaacagcctaacaaagcaagtaattatataaaaaaagaggattcaacaaactgaaaacagacctaagcagtgagcaaaacagaaccaccagcttccttaatcttcttctcggccgtcttcgagataagtttcgccttaacaaccatcgggtgcgaaagaggcaccgctccctttcccaaaaccttaaagtatccatgttgcgtaacatccacaacaggcaccttatcggccgaggccttctctctcacatcctcaggcaccatcgaccatagcttgtcgacgttaacgatcgggcaatggaacttgtttcggagcctatggaagtacctcataccgactttaccgaagtaacctggatggtacttgtcgaagaggatacggtggtggtgcattcctccggcgttacccctacctccgggatgcttcctgtgttttccgatacgaccgtgtccggcactcacgtgacctctcttctttcggttcttcctgagtctggtcgtcattctaccct

SEQ ID NO: 3227 - DNA, 552 bp, Fagopyrum esculentum
agagatgacgaccggattgaagaaaacaggaagaagagaggacacgtcagcgccggtcatggtcgtatcggaaagcaccgtaagcatcctggaggacgtggtaacgctggaggtatgcaccaccaccgtatcctgttcgacaagtaccatcctggttatttcggtaaggttggtatgaggtactttcacaagctcaggaacaagttctactgccctaaggtcaatgtcgagaacctctggtctcttcttccccaggaggtgaaagacaaggcttccaaggacaatgctcctgtgatcgatgtcactcaatatggctacttcaaggttttgggaaagggcgttttgcctcctaaccagcctattgttgtcaaggcgaagcttatctctaagatcgctgagaagaagatcaaggaaaccggtggatctgttgttcttaccgcttaggttttttcttacgagtatttcgttttcgccttatttactagacttttgattaatttttgaagtcagagtaagaattttgtgttgcttgttagacgttattcaacttct

SEQ ID NO: 3228 - DNA, 511 bp, Thalictrum flavum
gaaggcgagatgacaatcgattcaagaagaacaggaagaagagaggacacgtttcagctggacatggacgtatcgggaagcatagaaagcatccaggaggaagaggaaatgcaggaggaatgcatcatcatcggatcttgttcgacaaataccatccagggtatttcgggaaagtgggtatgaggtatttccataagcttcgtaataagttctattgccctactgttaatattgacaagctttggtctttggttcctcaagaaatcaaagacaaagcttctgccgataatgcccctttgattgatgttactcagttagggtttttcaaagttttgggtaagggtatgttgcctccttctcaacctgttgttgttaaagctaaacttatttcaaagaatgccgagaagaagatcaaggaagctggtggtgctgttctacttactgcttagttgtttggttaggatttcggttttgtaagcacagatttggccagacttgttttaatttttgc

SEQ ID NO: 3229 - DNA, 583 bp, Thalictrum flavum
ccttcctcgccgcaaaaactcttaaaaaccctaatcctcgaggaggaagaagaagagaggcaggtttaccatgacaacccgattcaagaagaacaggaagaagcgaggacacgtgtcagctggacatggacgtatcggaaaacatcgaaagcatccaggaggaagaggaaatgcaggaggaatgcatcatcatcggatcttgttcgacaaataccatccaggttacttcgggaaagttggaatgaggtacttccataagcttcgtaataagttctattgccctactgttaatatcgataagctttggtctttggttccacaagaaatcaaagacaaagcttctgccgataatgcccctttgattgatgttactcagttagggtttttcaaagttttgggtaaggtatgttgcctccttctcaacccgttgttgttaaagctaaacttatttcaaagaatgctgagaagaagatcaaggaagctggtggtgctgttctacttactgcttagtagttttagatcatatgtttatggagaaggatttcggctttgtaagcacaagttttaccatccttattttaaa

SEQ ID NO: 3230 - DNA, 1075 bp, Ricinus communis
gcaaaatggtaaagcacagttggactgcatctatctctatatataaatgggcaaaaccctagttcaagtctcttagcagctctctccatcatctccgcgaagagccgcatcttgtaatctgagaggagggccaaaatgacaaccagattcaagaagaacaggaagaagaggggccacgtaagcgccggacacggtcgtatcggaaagcacaggaagcatccaggaggtagaggtaatgcaggaggtatgcatcaccacaggatcctcttcgacaagtaccatcccggttatttcggaaaggtcggtatgcgttacttccacaaattgcgcaacaagttctattgtcccatcgtcaacatcgacaagctctggtctatggttcctgaggacgctaaagagaaggccagcaaggacaatgttcctatggttgatgtcactgagttcggttattttaaggtcttgggcaagggtgtgcttcctgagaataagcctattgttgtgaaagccaagttggtgtctaagattgccgagaaaaagattaaggagaacggcggagctgttgtcctcactgcttaagttgttacctttttttagtaatatttttgaattttcttagagtttgatatgaatgagtacctttttaatggttatttggtacgctttttattttaatggatatgagttaatttgccagtgcttttatatctgtggtgttttaattgtctggtgttattcatgtctgaatttttcgattgctttgggtgttttgggtggtgatatttgtgctgtgattcatttatttggatttatggtaacagtttgcatattttaatagattctagctattattgcataacagatgatgtgaatcttatcgaacctgaagaattgcaggagtgtcaatttgcaaattgcagaattgtccttgtgtttagtgctagactgttgtataagttgcgacttattaatctactttagtacttgtgaagcttggtgcttcaatatttgttgctagaaagaatgaccaaatcaaattcatttttttgataacgaatggtagtctttcttgattaca

SEQ ID NO: 3231 - DNA, 839 bp, Mimulus guttatus
aaaccctcagaacacacacactgacacctatatataaacacctcaaaaccctagccctcatttccgtttcacccaccagcggcgcagatccccttctccgccacccaattccgaaatgacgactcatctgaggaagaatcgcaagaagcgcggccacgtcagcgccggtcacggtcgtatcggaaagcaccgcaagcatcccggaggtcggggtaacgccggaggtatgcaccaccaccggatcctgttcgacaagtaccatcccggatacttcgggaaggtcggtatgcgttacttccacaagctccgcaaccagttcttctgccccacaatcaacgtcgacaagctctggtcgatggtcccgcaggaggtgaaggacaaggcgaccaaggacaacgcgccgctcatcgacgtcacgcagtttggttacttcaaggttttgggcaagggtttgctgcccgccggtcagcccgtcgtggtgaaggcgaagctcatctcgaagactgctgagaagaagatcaaggaggctggcggcgctgtcgtgctcactgcttgattaggttttttttttttttttttgtttttgatttactgcaatattgacttatatttattgctggacgtatttttgttgaagtgatcttgacataattttgttcgagtgatttaaattgctatagatccaacttttgattgatgcattttcttcgtgttcgcattcatcgagttctatatgaaatttacgtgtgcttgctactgctagtataggtttacgctttatggtgtttgtcaaattgttggtgacagaggtttctctgaattgtcttgttcgattaacg

SEQ ID NO: 3232 - DNA, 617 bp, Ambrosia trifida
ctctcgacagtagggtttctgccgccgttcttcaccgtttttcttatctacagtaggggaaaatgacaacaagattgaggaagaacaggaagaagcgcggtcatgtgagcgcaggacatggtcgtataggaaagcaccgaaagcatcctggaggtcgtggtaacgctggaggtatgcaccaccaccggatcctcttcgacaagtaccatcctggtttcttcggtaaagtcggtatgcggtacttccacaggctccgtaacaagttctattgccctatcgtcaacgtcgacaagctctggtcaatggtgccacaagacgtgaaggagaaggcttctgccgataaggttccagtgatcgacgtcactcagcatggttacttcaaggtgttggggaagggaactgttcctgcatctcagccatttgtcgtgaaggcgaaactgatatcgaagactgctgagaagaaaatcaaggaagctggtggcgctgttgtgcttacagcataggtttgtcatttcgtttcatttgcagattactctgttttgctaaaactggattcacattagttttaagttttgttttggaaaccttcaattgtgttctactttgctgagaatttt

SEQ ID NO: 3233 - DNA, 479 bp, Ambrosia trifida
tcgccgccgctagtcaccggagttctccacaggctacaatgacgacccgattgagaaagaaccggaagaagagaggccacgtcagcgccggtcacggccgtatcggtaaacaccgtaaacatccaggaggcagaggtaacgccggaggtatgcaccaccaccgtatcctgttcgacaagtaccatccaggtttcttcggtaaggtaggtatgaggtacttccacaggcttagaaacaaattctattgccccatagtcaacgtcgacaagctctggtcaatggtgcctcaagaggtgaaggataaggcttcagctgataaggtgcctgtggttgatgttactcagcttggatactttaaggtgttgggtaagggtatggtgcctccgtctcagccaatggttgttaaggctaagcttatttcgaagactgctgagaagaagattaaggaagctggtggtgctgttgtgctcactgcttag

SEQ ID NO: 3234 - DNA, 653 bp, Aquilegia formosa
ggaagaagaaggaggagaggagttgttgcagagatctggtgctgcgatgacaactcgattcaagaagaacaggaagaagagaggacacgtgtcagctggacatggacgaattggaaagcatagaaagcatccaggaggaagaggaaatgcaggaggaatgcatcatcatcgaatattgtttgataaataccatccagggtattttgggaaagtgggtatgaggtattttcataagcttcgtaataagttttattgcccaactgttaatattgataagttatggtctttggttcctcaagaaatcaaagataaagctaatactaccggaaatgcccctttaattgatgttactcaattagggtattttaaggttttgggtaagggtatgttaccaccttctcaacctgttgttgttaaggctaaacttgtttcaaagaatgctgagaagaagattaaggaagctggtggtgctgttctacttactgcttagtagaacaaacttgatcgattttatgtttaggtgtttatctttatgtttatggacaacaaattttggttatgtaagcaaagataatattggtagacttattttgatttgggtatttttaattttggataatgttactttggttattagatctgttattttcagt

SEQ ID NO: 3235 - DNA, 678 bp, Brassica juncea
aactctactcttcttgaaaccctagccgcaggagaaaacctcgagaggagtcactgatcggcggaaatgacgacgagattcaagaagaacaggaagaagcgtggtcacgtcagcgccggacacggtcgtatcggaaagcaccgcaagcatcccggaggtcgcggtaacgccggaggtatgcaccaccacaggatcctcttcgacaagtaccatcccggttacttcggtaaggtcggtatgcgatacttccacaagcttcgcaacaagttctactgcccgatcgtgaacctcgacaggctttggtcgctcgtccccgaggacgtgaaggcgaagtccacgaaggataaggtgccgttgatcgacgtgacgcagcacgggttcttcaaggtgttggggaaaggtcatttgcctgagaacaggccttttgttgtgaaggcgaagcttatctcgaagacggcggagaagaagattaaggaagctggtggtgctgttgtgctcactgcttaggttttatcgtaattttatcttcccgttttgctttttattgttggatgtttaaagagattatgaatctttgtcggaattttataggtggttttattacattgagatgcatgttttgaacatgttcggggattattgcacttctgttgcatattgtgaatttgcttcggatag

SEQ ID NO: 3236 - DNA, 496 bp, Brassica juncea
cttcttcttctctacagaagccctagccgcaggaggacaggttcgagagatcggcgaaaatgacgacgagatttaagaagaacaggaagaagcgtggccacgtcagcgccggacatggtcgtatcggaaagcaccgaaagcatcccggaggtcgtggtaacgccggaggaatgcaccaccacaggatcctcttcgacaagtaccatcccggttacttcggtaaagtcggtatgcgatacttccacaagcttcgcaacaagttcttctgcccgatcgtcaacctcgacaggctttggtcgctcgtccccgaggacgtgaaggcgaaagctacaaaggacaaggttcctttgatcgatgtgacgcagcacgggttcttcaaggtgttggggaaaggtcatttgcctgagaacaagccttttgtggtgaaggcgaagcttatctcgaagactgctgagaagaagattaaggaggctggtggtgccgtcgtgcttactgc

SEQ ID NO: 3237 - DNA, 911 bp, Brassica juncea
actttacgtctttataaatctgtgcttcttcttctctacagaagccctagccgcaggaggacaggttcgagagatcggcgaaaatgacgacgagattcaagaagaacaggaagaagcgtggccacgtcagcgccggacacggtcgtatcggaaagcaccgaaagcatcccggaggtcgtggtaacgccggaggtatgcaccaccacaggatcctcttcgacaagtaccatcctggtttcttcggtaaagtcggtatgcggtacttccacaagctccgcaacaagttcttctgcccgatcgtcaacctcgacaggctatggtcgttggtccctgaggatgtgaaggcgaaggccacgaaggacaaggtcccgttgatcgacgtgacgcagcacgggttcttcaaggtgttggggaaaggtcatttgcctgagaacaagccttttgtggtgaaggcgaagctgatctcgaagactgctgagaagaagatcaaggaagctggtggtgccgtggtgctcactgcttaggtttatcacaactttatcttctagtttttgctttttgtttttgaaattttggctaaaacttgtcttgttttggatcttggaacatggttgttataacattgagattctggaagttctgcctttacattttcgcctgtttctgttgtttaattgcgattaccttctttataccggtagttgtgttcattatggttgcatgattgttgatttgaattcattcatcgtcctgaaattattatgtgttgggatcatatgaatgtttggaacatcctcactatagtgcatttctcttgtccagggttataaaatcgcttccgataagcgtttgatttgtcgttatgataattgtctagattggagttgatcggttaaatatttataacaata

SEQ ID NO: 3238 - DNA, 576 bp, Brassica oleracea
gatccctagctagatctgaagaaatggcgacggcgttgaagaagaacaggaagaagagaggccacgtcagcgccggtcacgggcgtatcgggaagcaccgcaagcatcccggaggtcgcggtaacgcgggaggtatgcaccaccaccgtatcctcttcgacaagtaccatccaggttacttcgggaaggtgggtatgaggtacttccacaagctccgcaacaagttctactgccccatcgtcaacctcgacaagctctggtcgctcgtccccgaggacgtgaaggccaaggcgggcaaggataaggtgccgatgatcgatgtgacgcagcacgggttcttcaaggttctgggcaaaggtcatttgcctgagaacaggccttttgtggtgaaggcgaagcttatttcgaagactgctgagaagaagattaaggaggctggtggtgccgttgtgcttactgcctaagtgttagttgtttgagtttcgtttttgtgtttttgaattgttatcttctgagatgttgaacttgagatctcttaattaatattaatggattatatgatcgttgttttgagcc

SEQ ID NO: 3239 - DNA, 614 bp, Brassica oleracea
gctagccgcaggagggaaaggttcgagagatcgcgaaaatgacgaccagattcaagaagaacaggaagaagcgtggccacgtcagcgccggacacgggcgtgtcggaaagcaccgaaagcatcccggaggtcgtggtaacgcaggaggtatgcaccaccacaggatcctcttcgacaagtaccatcccggttacttcggcaaagtcggtatgcggtacttccacaagcttcgcaacaagttcttctgcccgatcgtgaacctcgacaggctttggtcgttggtccctgaggatgtgaaggcgaaggctacgaaggataaggttccgttgatcgacgtgacgcagcacgggttctttaaggtgttggggaaaggtcatttgcctgagaacaagccttttgtggtgaaggccaagcttatctcgaagactgctgagaagaagatcaaggaagctggcggtgccgtggtgctcactgcttaggtttatcacaagttttattttctcatttttgctttttattattgaatcttcacttaaacttatcctgttttggagattggaacatggttgttatgacattgaaattctggaatttttgccttaccattttcgctt

SEQ ID NO: 3240 - DNA, 598 bp, Ocimum basilicum
gcacgaggcgttttacctcactcgccattccaatctctgatccgccacaaaaatgaccactagattcaagaagaaccgcaagaagcgcggccatgtgagcgccggccatggacgtatcggtaagcaccgcaagcatcccggtggtaggggaaatgccggtggcatgcaccaccaccgcatcctcttcgacaagtaccatcctggttacttcggcaaagtcggtatgcgctacttccacaagctccgcaacaagttcttctgccccaccgtcaacatcgaccgcctctgggcgctcgtgccgcaggaggtgaaggacaaggcgtctaaggacaacgccccgctcatcgacgtcacgcagttcggatacttcaaggttttgggcaagggtttgctccccgccgataagcctgtcgttgttaaggcgaagctggtgtcgaagaatgctgagaagaagattaaggaggctggtggtgccgttgtgctcacggcttaatttaggtttattagcttctgtttttttataatgggccattgctacttttattatcgctggatggatttttactgattttttcctatatagatttataaatgtttt

SEQ ID NO: 3241 - DNA, 856 bp, Theobroma cacao
aatatcacaatcctcaagcccattgcagtaccccttgaagcccatcactcctcgtaccaacccaaatgcagacagccgttagggccgaaccctccttaagcccaccacagccgtaaaatccccgaaaccctagagggcaaacctggaaaccaaaaacctccccactccccaccattttcccgcaccaaaataaatccccacaagccctactctcattttctcgtccctcagccgctccgaacccttccctccccagatcctcaccaatccaaaaatgacaacccgcttcaagaagcaccgcaagaagcgcggccacgtgagcgccggtcacggccgtatcggcaagcaccgcaagcacccgggaggtcgcggaaacgccggaggcatgcaccaccacaggatcctcttcgacaagtaccaccctgggtattttgggaaggtcggtatgaggtacttccacaagctccgtaacaaattctactgtcccatcgtcaacatcgacaagctctggtctctcgttccacaagacgtgaaggcgaaagccaacaaggatgccgcgccgatgatcgacgtgactcagttcgggtactttaaggtcctcggaaagggtgtgttaccagagaatcaaccgatcgtggttaaggctaagttggtttcgaagactgctgagaagaagatcaaggaggctggtggtgctgttgtgctcaccgcctaggtcagggtttgtttttttctttatttttgggatctgaatgacgattctgttatactattatcttgggttgtttggatttatttttgaaatgagattttaaattaatgtcattaattttggcgcaattacgtattatgtttg

SEQ ID NO: 3242 - DNA, 610 bp, Brassica napus
tagatctgaagaaatggcgacggcgttgaagaagaacaggaagaagagaggccacgtcagcgccggtcacgggcgtatcgggaagcaccgcaagcatcccggaggtcgcggtaacgcgggaggtatgcaccaccaccgtatcctcttcgacaagtaccatccaggttacttcgggaaggtgggtatgaggtacttccacaagctccgcaacaagttctactgccccatcgtcaacctcgacaagctctggtcgctcgtccccgaggacgtgaaggccaaggcgggcaaggataaggtgccgatgatcgatgtgacgcagcacgggttcttcaaggttctggggaaaggtcatttgcctgagaacaggccttttgtggtgaaggcgaagcttatttcgaagactgctgagaagaagattaaggaggctggtggtgccgttgtgcttactgcctaagtgttagttgtttgagtttcgttttgtgtttttgaatttgttatcttctgagttgttggaacttgctttttcgatattttggaatgagggatcttttaattaatattaatggattatataatcgttgttttgagtttaaatgtggtattggtattg

SEQ ID NO: 3243 - DNA, 660 bp, Brassica napus
ggaatatcctctagtctttataatctgtgcttcttcttctacagaagccctagccgcaggagggaaaggttcgagagatcgcgaaaatgacgaccagattcaagaagaacaggaagaagcgtggccacgtcagcgccggacacggtcgtgtcggaaagcaccgaaagcatcccggaggtcgtggtaacgcaggaggtatgcaccaccacaggatcctcttcgacaagtaccatcccggttacttcggcaaagtcggtatgcggtacttccacaagcttcgcaacaagttcttctgcccgatcgtcaacctcgacaggctttggtcgttggtccctgaggatgtgaaggcgaaggctacgaaggataaggttccgttgatcgacgtgacgcagcacgggttctttaaggtgttggggaaaggtcatttgcctgagaacaagccttttgtggtgaaggccaagcttatctcgaagactgctgagaagaagatcaaggaagctggcggtgccgtggtgctcactgcttaggtttatcacaagttttattttctcatttttgctttttattattgaatcttcacttaaacttatcctgttttggagattggaacatggttgttatgacattgaaattctggaatttttgccttaccattttcgc

SEQ ID NO: 3244 - DNA, 696 bp, Brassica napus
gaagatctaataaaaaaaatggcgacggcgttgaagaagaacaggaagaagagaggccacgtcagcgcggggcacggtcgtatcgggaagcaccgcaagcatccgggaggtcgcggaaacgcgggaggaatgcaccaccaccggatcctcttcgacaagtaccatccgggatacttcgggaaagtagggatgaggtacttccacaagctccgcaacaagttctactgccccatcgtcaacctcgacaggctctggtcgctggttccggaggacgtgaaggccaaggcggggaaggatggtaaggtgccgatgatcgacgtgacgcagcacgggttctttaaagtgttggggaaagggcatttgcctgagggcaagccgtttgtggtgaaggcgaagcttatttcgaagactgctgagaagaagattaaggaggctggtggtgctgttgtgctcactgcctaggttataggttgagttttcgttttaattattgtctttatctgtttttgatatcgttgttgaactcaaagtttgttgctttattgatttttggaatgagagatattttgatcgatatcattggattatatttggtgttattgttattggtgttttcgaatgtttgattgagttgttcattcgattcggggcggaggggacaagggaggaagagaaagaacaccaaaaaaaacaaaa

SEQ ID NO: 3245 - DNA, 571 bp, Manihot esculenta
aacaaatccacgcccccaaaatgactacccgcttcaagaagaatcgcaagaagcgtggccacgtgagcgccggccatggccgtatcggcaaacacaggaagcatcccggtggtcgcggtaatgccggagggatgcaccaccacagaatactcttcgacaagtaccatcctgggtatttcggcaaagtaggtatgcgatactttcacaagcttcgcaacaagttctactgccccattgtcaacatcgacaagctctggtccatgattcctcaagaggtgaaggacaagacttccaaggataatgtgcctttggtcgatgttacccagtttggatactttaaagttttggggaagggggctttgcctgagaacaagccaatagtggtgaaggcaaagcttgtttcgaagattgctgaaaagaagatcaaggaggctggtggagctgtcgttctcactgcctaggtcaggctttgtttaaagttttgccataatgatgttttgcaattgttttaaaaggttattttttgttatgttgtctggatatttagaggttaatgttggaatgactctgt

SEQ ID NO: 3246 - DNA, 752 bp, Castanea mollissima
gcgccgaagaccccaacacacagagagaccgagaccgagagcgagagcgagcgatcccaacaatggcgacacgtttcaagaagaacaggaagaagcgcggacacgtgagcgccggacacggccgtatcggcaagcacaggaagcatcctggaggtcgcggaaacgccggaggcatgcaccaccaccggatcttgttcgacaagtaccatcctgggttcttcggcaaagtcggtatgcgctacttccacaagcttcgcaacaagttctactgcccaatcgttaatgtcgacaagctctggtctctcctccccaacgatgtcaaggacaaggcctccaacgacagcgctcctgtgatcgatgtcactcagttcgggtacttcaaggttctgggcaagggtgttcttcccgagaacaagcctgtcgttgttaaagccaagctcatctcgaagatcgcagagaagaagatcaaggaggctggtggtgctgtggtactcactgcttaggtttcggtactttttttttaggttcttatatgaaaattttggtttattcgcgaacccttttgagacgtgtttggttttattattgttatctgtttaatgaaagttttgaatcgtgggattattgttatatgtttgtttttggaatggtagattcaatcggtttattatgcatgatatatgatattttaatgttattctggatgattggcttggggatgttatgatatgagatttcatttcccttttaaa

SEQ ID NO: 3247 - DNA, 719 bp, Cleome gynandra
aaaacaaaagaagttgacccctctcgccctttatatatctctggctctcagaaagccctagccgcactgagaggggagctacagatcggagaagatgacaactaggtttaagaagaacaggaagaagcgcgggcacgtctccgccggacatggtcgtatcgggaaacaccgaaagcatcccggaggtcgcggtaacgcgggaggtatgcaccaccaccgtatcctcttcgacaagtaccatcctggttacttcggtaaggttggtatgaggtacttccacaagttgaggaacaagttctactgtcctatcgtcaatctagacaagctctggtccctcgtgccccaagaagtgaaggacaaggcgaccaaggacaacgttcccttgatcgacgtcactcaatttgggtacttcaaggtgttggggaaaggtgtgctgcccgaaaacaaacctgtggttgtgaaggcaaagctagtgtcgaagaacgcggagaagaagataaaggaggccggtggagccgtcgtgctcaccgcctaggttaggcaattttcctcctcccatatccgttttttatgttttttatgaagttatgttatttggtttggatcgagatgtcgagaaatggaaaacctttatcggatttgatacatcttttgatatgatacatttgaaccattgggttttactgcatcatctgaattcaatctttagatattgccga

SEQ ID NO: 3248 - DNA, 632 bp, Cleome spinosa
tcggggtaggagagagagagctgcagatcggggaagatgacgaccaggttcaagaagaacaggaagaagcgcggtcacgtatccgccggacacggtcgtatcgggaagcacaggaagcatcccggaggtcgtggtaacgccggtggtatgcaccaccaccgtatcctcttcgacaagtaccatcccggttacttcgggaaggttgggatgaggtacttccacaaactgaggaacaagttctactgtcccatcgtcaatctggacaagctatggtcgcttgtgccgcaagaagtgaaggacaaggccaccaaggacaacgttccattgatcgacgtcactcagttcggatacttcaaggtcttgggaaaaggtgttttgccggagaacaagcctgtcgtggtgaaggcaaagctggtgtctaagaacgccgagaagaagatcaaggaggccggtggagccgtcgtgctcaccgcctaggttaggcgattttcctccttccatttcgatggactcgttttgttattcggtttcaatcgatatctctaacgtagaacttttatcggattttatacatctatgttattctgagttttgaatttgatatgatgtgattgcatctttcggtttctgct

SEQ ID NO: 3249 - DNA, 629 bp, Gossypium hirsutum
cttcaccttcccaaaatgacaacccgcttcaagaaaaaccggaagaagcgcggccacgtgagcgccggtcacggccgtatcgggaagcaccgcaagcacccgggaggtcggggaaatgcaggaggcatgcaccaccacaggatcctgttcgacaagtaccaccctgggtatttcgggaaagtgggtatgaggtacttccacaagctacgcaacaagttctactgccccatcgtcaacatcgacaagctctggtctctcgtcccgcaggaggtgaaaaccaaagccaacaaggatgcggctccgatgatcgacgtgactcagttcggatactttaaagtcctcgggaaaggtgttttgccggagaaccaaccgatcgtcgtcaaggctaagttggtgtcgaaaactgctgagaagaaaataaaggaagctggtggcgccgttgttctgaccgcttaggttagggttcttcgttaattttcatttggatttgaatgacatttctttgacattaatgtcgttgattttgggttcactctatatatatgttctctatgcttgtttcgacttatatattcaacattgctttttaaagagaaagccagaatgattaaaatggataacaactcggc

SEQ ID NO: 3250 - DNA, 938 bp, Eucalyptus grandis
caccgccgcgcccacccgcaccgccgcccctctcggccgccgacctcctcttccttctccggcgagatgacgacccgattcaagaagaaccggaagaagcgcggccacgtgagcgccgggcacggccgcatcgggaagcaccgcaagcaccccggcggccgcgggaacgccggcgggatgcaccaccaccgcatcctcttcgacaagtaccacccgggctacttcgggaaggtcggcatgcggtacttccacaagctccgcaacaagttctactgccccatcgtcaacgtcgagaagctctggtccctcgtcccccaggatgccaaggacaaggcctcgaaggacagcgtgcccgtgatcgacgtgacccagtacggcttcttcaaggtcctgggcaagggggtgttgcccgagaagcagccggtcgtggtgaaggccaagctgatctcgaagatcgcggagaagaagatcaaggaggccggaggtgccgtcgtgctcactgcttaggtgaatcaaagttcgttcctttttcttcttttagttctaattttgtcggttttgtttactgaagttgtgtcgtttttatttttggggggaatagttgtatcggatgggaatggggcgttattgtcgcattgctcgtcgaatgctgataaatgttgagcatggtgtctttcttggtcaatggtttgatctgttttatggaggcaaatagtgaacttttttccgattcgtgggtgtttcaagttttacttcgttgttattgtctgtcttttgaggaattattaggaaaatccgggccgccatctcgcctggtgtgtgaacttcacttctgtgaaatccgccattatatgagagaaaagccggtgcttaatgcctattgtggatgattgaagtaatttggcattttatgaaaattgtggatgaaagtttggaaa

SEQ ID NO: 3251 - DNA, 614 bp, Fagopyrum esculentum
agcggcgcctctatcccagatttgcagagagatgacgaccggattgaagaagaacaggaagaagagagggcacgtcagcgccggtcatggtcgtatcggaaagcaccgtaagcatcctggaggtcgtggtaacgccggaggtatgcaccaccaccgtatcctgttcgacaagtaccatcctggttacttcggtaaggttggtatgaggtactttcacaagctgaggaacaagttcttctgccctaaggtgaacgtcgagaagctctggtctcttcttccccaggaggcgaaggacaaggcttccaaggacaatgctcctgtgatcgatgtcactcaatatggctacttcaaggttttgggaaagggagttttgcctcctaaccagcctatcgttgtcaaggcgaagcttatctctaagatcgccgagaagaagatcaaggaggccggtggctcggttgttcttaccgcttaggtttttttttccttacaagtatttcgttttcttgttatttactagacttttatcaatttttgaagtcaattaagaattttgtgttacttgttagacctattaaatctatcatttactctttacagggatttgttatggtttc

SEQ ID NO: 3252 - DNA, 765 bp, Gossypium raimondii
aaggttatattcgtaaatgaaatgtctagagggtaaacatggaaacccaaaacccctcgctattttctctcatgacaatataatccccacaaccaaaaaccctactattgggccgccactaaccttcaccttcccaaaatgacaacccgcttcaagaaaaaccggaagaagcgcggccacgtgagcgccggtcacggccgtatcgggaagcaccgcaagcacccgggaggtcggggaaatgcaggaggcatgcaccaccacaggatcctgttcgacaagtaccaccctgggtatttcgggaaagtgggtatgaggtacttccacaagctacgcaacaagttctactgccccatcgtcaacatcgacaagctctggtctctcgtcccgcaggaggtgaaaaccaaagccaacaaggatgcggctccgatgatcgacgtgactcagttcggatactttaaagtcctcgggaaaggtgttttgccggagaaccaaccgatcgtcgtcaaggctaagttggtgtcgaaaactgctgagaagaaaataaaggaagctggtggcgccgttgttctgaccgcttaggttagggttcttcgttaattttcatttggatttgaatgacatttctttgacattaatgtcgttgattttgggttcactctatatatatgttctctatgcttgtttcaacattgcttttttgcatttctaagtaaaaatattacttttaatttttataattaaattttaaaaactatataaatataa

SEQ ID NO: 3253 - DNA, 604 bp, Humulus lupulus
tcctcctgtgctcgtcgcgatccccgctagtcgacaaaaaccctcactcgctccatcttctctcagccgccgaaaccctaggagagaaggttcagagatcagagatgactacccgattcaagaagaacaggaagaagcgtggtcacgtgagtgccggccatggaagagtaggcaagcacaggaagcatcctggtggtcgtggtaacgctggaggcatgcaccaccaccggatcctcttcgacaagtaccatcctgggtacttcggtaaggtcggtatgagatacttccacaagcttcgcaacaagttctactgcccaatcgtcaacatcgacaagctctggtctatggtgccccaggaggtgaaggacaaggccaccaaggacaacgtccccttgatcgatgtgactcagtttggatacttcaaggtcttgggcaagggtgtcttgcctgagaatcaacccgtggtagtcaaggccaagctcatatccaagatcgccgagaagaagattaaggaggctggcggcgccgtcgtcctcactgcttaggtttgcataattaattttcgccagagtagaggttttgggtattctctgttttatttttt

SEQ ID NO: 3254 - DNA, 562 bp, Humulus lupulus
ctctcagccgccgaaaccctaggagagaaggttcagagatcagagatgactacccgattcaagaagaacaggaagaagcgtggtcacgtgagtgccggccatggaagagtaggcaagcacaggaagcatcctggtggtcgtggtaacgctggaggcatgcaccaccaccggatcctcttcgacaagtaccatcctgggtacttcggtaaggtcggtatgagatacttccacaagcttcgcaacaagttctactgcccaatcgtcaacatcgacaagctctggtctatggtgccccaggaggtgaaggacaaggccaccaaggacaacgtccccttgatcgatgtgactcagtttggatacttcaaggtcttgggcaagggtgtcttgcctgagaatcaacccgtggtagtcaaggccaagctcatatccaagatcgccgagaagaagattaaggaggctggcggcgccgtcgtcctcactgcttaggtttgcataattaattttcgccagagtagaagttttgggtattttctgtttttatttttttgtttgtaagtttggt

SEQ ID NO: 3255 - DNA, 568 bp, Ipomoea nil
gagtattagggtcagtgctcagccgccgctctgcaataatctccggcaaccatgacgacaaggttcaagaagaacaggaagaagagaggccacgtgagcgccgggcacgggcgcatcgggaagcaccggaagcacccgggaggccgcgggaacgccggagggatgcaccaccaccggatcctcttcgacaagtatcacccggggtatttcgggaaagtcgggatgcggtacttccacaagctccgcaacaagttctactgccccatcgtcaacgtcgacaagctctggtcaatggtgccgccggaagtgaaggccaaggcctccaaggacgacgttcccttgatcgatgtgactcagttagggtttttcaaggttctcgggaagggcgtgcttcctagcaatcagccggttgtggtaaaggctaagctcgtttcgaagatcgccgagaagaagatcaaggaggccggcggcgctgttcttctcaccgcctaaggttcttctttcactctccgtctcacattttgcggttttggaatcttaacatttatgatatgaacttgcggttgtt

SEQ ID NO: 3256 - DNA, 667 bp, Tropaeolum majus
cggccgggacctcgtcttatttcatctcatatttatacttcgccaaaaccctaaaagtaccttctcttcttgtatcgtcccatagagcctccagatctaaaagtgaaaaaatgacgaccagattcaagaagaacaggaagaagcgtggtcacgtcagtgcaggacacggtcgtatcggaaaacaccgaaagcatcccggaggtcgtggtaatgctggtggtatgcaccaccacagaatcctcttcgacaagtaccatcctggttatttcggtaaagtaggtatgaggtacttccacaagcttcgcaacaagttccattgcccgatcgtcaacctcgacaagctttggtcgcttgtaccacaagagaccaaagagaaggccaccaaggacgctgcccctgtgattgatgtcactcaattcgggtatttcaaggtattaggtaaaggtgttttgcccgagaatcaacctttcgtagtgaaggcgaagctcatttccaagattgccgagaagaagattaaggaggccggtggtgctgtgttgcttactgcttaggttaagtttttttgttactgttggatttgtctaattttcgatttttatattgtttaactctattttagtattatgtactaattctggttcattaccaaaaaaaaaaaaaagtacga

SEQ ID NO: 3257 - DNA, 765 bp, Quercus alba
cgcagagtacatgggacccctctctgaggcgcgccgaaaaccctaccgcacagagagaccgagagcgagagcgagagatcccaacaatggcgacacgtttcaagaagaacaggaagaagcgcggacacgtgagcgccggacacggccgtatcggcaagcacaggaagcatcctggaggtcgcggaaacgccggaggcatgcaccaccaccggatcttgttcgacaagtaccatcctgggttcttcggcaaagtcggtatgcgctatttccacaagcttcgcaacaagttctattgcccaatcgttaacgtcgacaagctctggtctctcctccccaacgatgtcaaggacaaggcctccaacgacagcgctcctgtgatcgatgtcactcagttcgggtacttcaaggttttgggcaagggtgttcttcccgagaacaagcctgtcgttgttaaagccaagctcatctcgaagatcgcagagaagaagatcaaggaggctggtggtgctgtggtactcactgcttaggtttcggtacttttttaggttcttatatgaaaattttggtttattcgcgaacccttttgagacgtgtttggtattattattgttatctgtttaatgaaagttttgaatcatgggattattgttatatgtttctttttttgggaatggtagattcaatcggtttattatgcttgatatatgatattttattgttgttctggattattggcttggtgattttatgttatgagatttcgtt

SEQ ID NO: 3258 - DNA, 780 bp, Cajanus cajan
ccctaattcgttgctgcggccgctctagcgtacgagagagagagagagagagagagaatgacgacccgcttcaagaagaacaggaagaagagaggtcacgtgagcgccgggcacgggcgtatcggaaagcaccggaagcatcccggaggtcgcggtaacgccggaggcatgcaccaccaccgcatcctcttcgacaagtaccatccgggttacttcggaaaggtaggtatgcgttacttccacaagctccgcaacaagttccattgccccatcgtcaacatcgacaagctctggtccctcctcccccaagaggccaaggacaaggcctccgccgacaaggcccccttgctcgacgtcacccagttcggttactttaaggttttgggcaaaggggttttgcctcagaaccagcctttggttgttaaggctaagcttatctctaagatcgctgagaagaagatcaaggaggccggtggagctgttgttctcaccgcttgattttagggtattttttgttttttttttgtttttttttttattttaaaggattttgagatctgttatttttattgcgcttttgcttattattgctattattgcctgtctggactggattagttgagtttaaatggtttttgtgctcaatgttctggattatatcgttttcgtttcgtgttattgtctgagatgcgtgttttacgtgctttaattggacctatagcttgttggatgaatgctcacgcctctcgcgacactacctttaatatcatacaaattttt

SEQ ID NO: 3259 - DNA, 707 bp, Platanus occidentalis
gaagccgaaggagcgagaaagggtttcagggatgacgacccgtttcaagaagaacaggaagaagagaggccatgtgagcgccggccatggccgtatcgggaagcaccgaaagcatccgggaggccgtggtaacgctggaggcatgcatcaccaccggatcctcttcgacaagtaccatcccggttacttcggtaaagttgggatgcgttacttccacaggcttcgcaacaagttctactgccccatcgtcaatatcgacaagctctggtccatgatccctcaagacgtcaaggacaaggcttctcccgataacgcgccatgcatcgatgtcactcagtttgggtacttcaaggttttgggcaagggcgtgttgccttcatctcagcccatcgttgttaaggccaagctcgtctcgaaggttgcggagaagaagatcaaggaggctggtggttccgtcgtcctcacagcttagatgctgctgttcacggtgatgtgtactaccattacatattgtttttcgttagttgaggtttaagttttggatgttttcataattccgaaggaggattagactattgtttgggtacttttggatattattttgttttagtttgatccaatcgattacttttttctatagatctgttgaaccattattgatcgattgaagttaatagtctttttttcatggatttatgtcttttcaa

SEQ ID NO: 3260 - DNA, 615 bp, Raphanus sativus
ggctagccgcaggaggaaaatgacgacgagactcaggaagaacaggaagaagcgcggccacgtcagcgccggacatggacgtatcggaaagcaccgaaagcatcccggaggtcgcggtaacgccggaggtatgcaccaccacaggatcctcttcgacaagtaccatcccggttacttcggcaaagtcggtatgaggtacttccacaagctccgcaacaagttcttctgcccgatcgtcaacctcgacaggctctggtcgctcgtccccgaggacgtgaaggccaaatcgaccaaggacaaggttccgttgatcgatgtgacgcagcacgggttcttcaaggtgttggggaaaggtcatttgcctgagaacaagcctttcgttgtgaaggcgaagcttatctcgaagactgctgagaagaagattaaggaagctggtggtgctgttgttcttacagcttaggcttttgtcagttgtttttggttataacttgtcttgtttttggatctttgagttttggaaacttatgttttggttttataaatggtttgttatgacatttcgggtttaggattgttattaccgttcgatgatctggaataattagtgaattgtcg

SEQ ID NO: 3261 - DNA, 618 bp, Raphanus sativus
gatctgaacgaaatggcgacggggttgaagaagaacaggaagaagagaggccacgtcagcgccggacacgggcgtatcgggaagcaccgcaagcatccaggaggtcgcggtaacgccggaggcatgcatcaccaccgtatcctcttcgacaagtaccatccaggttacttcgggaaggttggtatgaggtacttccacaagctccgcaacaagttctactgccccatcgtcaacctcgacaagctatggtcactcgtccccgaggatgtgaaggggaaggccacaaaggacaaggtgccgatgatcgatgtgacgcagcacgggttcttcaaggttcttgggaaaggtcatttgcctgagggaaagcctttcgttgtgaaggctaagctcatttccaagactgctgagaagaagatcaaggaggctggtggcgccgtcgtgctcactgcctagggttaggtctgttttttacgttttgcttttttaagtattgtcttttggaatcgttgttggactcagagtttgttgctttttggaatgagagatcttttaatcaatattattggattttataatcgtcatttcagttaaatgtggtattgattgatatggtttttt

SEQ ID NO: 3262 - DNA, 689 bp, Raphanus sativus
agccgcagtaagaggaaaggaaaggtgtcgagagagatcggcgaaaaatgacgaccagactcaggaagaacaggaagaagagaggtcatgtcagcgccggacacggtcgtatcgggaagcaccgcaagcatcccggaggtcgcggtaacgcaggaggtatgcaccaccacaggatcctcttcgacaagtaccatcccggttacttcggcaaagtaggtatgaggtacttccacaagctccgcaacaagttcttctgccccatcgtcaacctcgacaggctctggtcgctggttcccgaggatgtgaaggccaaggctaccaaggataaggtgccgatgattgatgtgacgcagcatggcttctttaaggtgcttgggaaaggtcatttgcctgagaacaagccttttgtggtgaaggcgaagctgatctcgaagactgctgagaagaagatcaaggaagctggtggtgccgtggtgctcactgcttaggtttatctgcaaatttatcttttgtttttgctttttgtttttgagtttttgctaagatttgtcctgttttggattttggaacatggttgttatcacattgaggttctggaatttttgccttgccattttcgattgattttgtggtttccgtaattttggtagattagaaatgcgattgccttctttacaccaaaaaaaaaa

SEQ ID NO: 3263 - DNA, 617 bp, Raphanus sativus
ggctagccgcacgcaggaggaaaagaagttgtcgagagagatcgccgagaaatgacgaccagactcaggaagaacaggaagaagcgcggtcacgtcagcgccggacacggtcgtatcgggaagcaccgcaagcatcccggaggtcgaggtaacgcaggaggtatgcaccaccacaggatccttttcgacaagtaccatcctggttacttcggcaaagtcggtatgaggtacttccacaagctccgcaacaagttctacaacccgatcgttaacctcgacaggctctggtcgcttgttcccgaggatgtgaaggccaaggctaccaaggataaggtgccgatgatcgatgtgacgcagcatgggttctttaaggtgctcgggaaaggtcatttgcctgagggcaagccgtttgtggtgaaggcgaagttgatctcgaagactgctgagaagaagatcaaggaagctggtggtgctgttgtgctcactgcttaggtttatcgcgaatttatctttttatttttgctttttgtttttgaattttttgctaagacttgtcctgttttggattttggaacatggttgttatcacattgaggttctggaatttttgccttgcc

SEQ ID NO: 3264 - DNA, 623 bp, Raphanus sativus
  misc_feature (210)..(210): n is a, c, g, or t
  misc_feature (240)..(240): n is a, c, g, or t
  misc_feature (273)..(273): n is a, c, g, or t
  misc_feature (288)..(288): n is a, c, g, or t
  misc_feature (360)..(360): n is a, c, g, or t
  misc_feature (375)..(375): n is a, c, g, or t
  misc_feature (423)..(423): n is a, c, g, or t
agccgcacgcaggaagaaagaaggtgtgtcaagagagatcgccgagaaatgacgaccagactcaggaagaacaggaagaagcgaggtcacgtcagcgccggacacggtcgtatcgggaagcaccgcaagcatcccggaggtcgcggtaacgcaggaggtatgcaccaccacaggatcctcttcgacaagtaccatcccggttacttcggnaaagtcggtatgaggtacttccacaagctncgcaacaagttctacaacccgatcgtcaacctngacaggctctggtcnctggttcccgaggatgtgaaggccaaggccaccaaggataaggtgccgatgatcgatgtgacgcagcatggnttctttaaggtgctngggaaaggtcatttgcctgagaacaagccttttgtggtgaaggcgaanctgatctcgaagactgctgagaagaagatcaaggaagctggtggtgccgtggtgctcactgcttaggtttatctgcaaatttatcttttgtttttgctttttgtttttgagtttttgctaagacttgtcatgttttggattttggaacatggttgttatcacattgaggttctggcatttttgccttgccattttcgatt

SEQ ID NO: 3265 - DNA, 663 bp, Senecio madagascariensis
tcgagcggccgcccgggcaggtacgcgggggactgaaacttagggtttctgccgccatctttcaccggattcaagcttttcagggaaaatgactaccagattgaggaagaatcgcaagaagagaggacacgtcagtgctggacatggtcgtatcggaaagcaccgaaagcatcctggaggtcgtggtaacgctggaggtatgcaccaccacagaatcctcttcgacaagtaccatcctggttacttcggtaaggtcggtatgcgatacttccacaagcttaggaacaagttctactgcccaatcgtgaacgttgacaagctttggtccatggttccacaagacgtgaaggagaaggattcaggcgataaggttccagtcattgatgtcacacaagctggtttctttaaggttttgggaaagggagctgttcctgcttcaaagccgtttgttgttaagactaagttgatttcaaagactgctgagaagaagatcaaggaagctggaggtgctgttgtgctttgcgcttagatttttatttcggtttttgttgccagttatggttgttgctactgttagttttatttgcagagtactttgttttgctggatttaaagttatatttgaacgaaattttgtttcgagatgcaaaaaaaaaaacgtta

SEQ ID NO: 3266 - DNA, 743 bp, Helianthus annuus
accgtagggtttctgccgctcttcttcaccggcttttcatctacaggggaaaatgacgaccagattgaggaagaacaggaagaagcgcggtcacgtgagcgctggacatggtcgtatcggaaagcaccgtaagcatcccggaggtcgtggtaacgctggaggtatgcaccaccaccggatccttttcgacaagtaccatcccggtttcttcggtaaagttggtatgaggtacttccacaggctccgcaacaagttccattgtcctattgtcaacgttgacaagctctggtcaatggtgccacaagacgtgaaggagaagtcatccacagacaaggttccggttattgacgtcacacagttcggttacttcaaggtgttgggaaaggggactgttcctgcatctcagccgattgttgttaaggcgaagttgatctcaaagacagccgagaagaagattaaggaagccggtggtgctgttgtgctcacagcttaggtctgttgttttgatttcatttgcagattactctactctgttttgctgaatttggattcagtttagatttaagttttgtttttgaatacttatatttgtgttttactttgctgagattttttgttattaatggtatgaacttacatgtttttcttctttaaataaatcatggcaaaattaaatacatgttgggccggcttggcccattcgactttagacttgatcaagtttatgcatgcggcccgcaatt

SEQ ID NO: 3267 - DNA, 683 bp, Helianthus annuus
ggggaaagcccacggaaatactcagttgggtctggctataaagccgacttagggttttcattttcttccagccctaacacaggtaagtcgccgccgctcgtcaccgtaattctcttttcagggtaaaatgacgaccaggttgaggaagaaccgcaagaagcgaggccacgtgagcgcgggacacggccgtatcggaaaacaccgaaagcatcccggaggtagaggtaacgccggaggtatgcaccaccaccggatcctgttcgacaagtaccatcccggtttcttcggtaaggtcggtatgaggtacttccacaggctcaggaacaagttctattgtccgatagtcaacgtggacaagctctggtcaatggtgccgcaggaggtgaaggataaggcttcagctgataaggtgcctgtggttgacgtcacgcagcttgggtactttaaggtgttggggaaggggatggtgcctccgtcacagccgatggtggttaaggcgaagcttatttcgaagactgctgagaagaagattaaggaagctggtggtgctgttgtgcttactgcttaggtttggtttatattttgcttttgttgaactgaattttgatttaaggtttttttttataatacaatggacgttatttatgattttgtttattgatgtcgctcgatgtttggtttga

SEQ ID NO: 3268 - DNA, 637 bp, Helianthus annuus
ttctgccgctcttcttcaccgccttttcatctacaggggaaaatgactaccagattgaggaagaacaggaagaagcgcggtcacgtgagcgcaggacatggtcgtatcggaaagcaccgtaagcatcccggaggtcgtggtaacgctggaggtatgcaccaccaccggatccttttcgacaagtaccatcccggtttcttcggtaaagtcggtatgaggtacttccacaggctccgcaacaagttccattgtcctattgtcaacgtcgacaagctctggtcaatggtgccacaagacgtgaaggagaagtcatccacagacaaggttccagttattgacgtcacacagttcggttacttcaaggtgttgggaaaggggactgttcctgcatctcagccgattgttgttaaggcgaagttgatctcaaagacagccgagaagaagattaaggaagccggtggtgctgttgtgctcactgcttaggtctgttgttttgatttcatttgcagaatactatgtattgctgaatttggattcagtttagatttaagttttgcttttgaatacttatatttgtgttctactttgctgagattttttgttattaatggtatgaacttacatgtcagtactatcc

SEQ ID NO: 3269 - DNA, 640 bp, Helianthus annuus
ttctgccgctcttcttcaccgccttttcacctacaggggaaaatgacgaccagattgaggaagaacaggaagaagcgtggtcacgtgagcgctggacatggtcgtattggaaagcaccgtaagcatcccggaggtcgtggtaacgctggaggtatgcaccaccaccgcatccttttcgacaagtaccatcccggtttctttggtaaagtcggtatgaggtacttccacaggctacgcaacaagttccattgtccaattgtcaacgtcgacaagctctggtcaatggtgccacaagacgtgaaggagaagtcatccacagacaaggttccggttattgacgtcacacagttcggttacttcaaggtgttgggaaaggggactgttcctgcatctcagccgattgttgttaaggcgaagttgatctcaaagacagccgagaagaagattaaggaagccggtggtgctgttgtgctcacagcttaggtctgttgttttgatttcatttgcagattactctactctgttttgctgaatttggattcagtttagatttaagttttgtttttgaatacttatatttgtgttctactttgctgaaattttttgttatcaatggtatgaacttacatgtcattactat

SEQ ID NO: 3270 - DNA, 653 bp, Helianthus annuus
ttctgccgctcttcttcaccgccttttcatctacaggggaaaatgacgaccagattgaggaagaacaggaagaagcgcggtcacgtgagcgctgggcatggtcgtatcggaaagcaccgtaagcatcccggaggtcgtggtaacgctggaggtatgcaccaccaccggatcctttttgacaagtaccatcccggtttctttggtaaagtcggtatgaggtacttccacaggctccgcaacaagttccattgtccaattgtcaacgtcgacaagctctggtcaatggtgccacaagacgtgaaggagaagtcatccacagacaaggttccggttattgacgtgacacagttcggttacttcaaggtgttgggaaaggggactgttcctgcatctcagccgattgttgttaaggcgaagttgatctcaaagacagccgagaagaagattaaggaagccggtggtgctgttgtgctcactgcttaggtctgttgttttgatttcatttgcagattactctgttttgctgaatttggattcagtttagatttaagttttgtttttgaatacttatatttgtgttctactttgctgagattttttgttatcaatggtatgaacttacatgtcattactatccatgatttgaggtaact

SEQ ID NO: 3271 - DNA, 570 bp, Helianthus annuus
agtcgccgccgctcgtcaccggagttctttttgcagggtaaaatgacgaccagattgagaaagaaccgcaagaagcgaggccacgtgagcgccggacacggtcgtatcggaaaacaccgaaaacatcccggaggtagaggtaacgccggaggtatgcaccaccaccggatcctgttcgacaagtaccatcccggtttcttcggtaaggtcggtatgaggtactttcacaggctcaggaacaagttctattgtccgatagtcaacgtggacaagctctggtcaatggtgccgcaggaggtgaaggataaggcttcagctgataaggtgcctgtggttgacgtcactcagcttggatactttaaggtgttggggaaggggatggtgcctccgtctcagccgatggtggttaaggctaagcttatttcgaagactgctgagaagaagattaaggaagctggtggtgctgttgtgcttactgcttaggtttggtttatattttgcttgttgaactaaattttcatttaagttttttttttataatataatggacgttatttatgattttgtttc

SEQ ID NO: 3272 - DNA, 583 bp, Helianthus annuus
gccctaacacaggtaagtcgccgccgctcgtcaccggaattctcttttcagggtaaaatgacgaccaggttgagaaagaaccgcaagaagcgaggccacgtgagcgccggacacggccgtatcggaaaacaccgaaagcatcccggaggtagaggtaacgccggaggtatgcaccaccaccggatcctgttcgacaagtaccatcccggtttcttcggtaaggtcggtatgaggtacttccataggctcaggaacaagttctattgtccgatagtcaacgtggacaagctctggtcaatggtgccgcaggaggtgaaggataaggcttcagctgataaggtgcctgtggttgacgtcacgcagcttgggtattttaaggtgttggggaaggggatggtgcctccgtcacagccgatggtggttaaggctaagcttatttcgaagactgctgagaagaagattaaggaagctggtggtgctgttgtgcttactgcttaggtttggtttatattttgcttggtgaactaaattttcagttaagttttttttataatataatggacgtaaatgatgattttgtttc

SEQ ID NO: 3273 - DNA, 652 bp, Helianthus annuus
ttctgccgctcttcttcccggcttttcatctacaggggaaaatgacgaccagattgaggaagaacaggaagaagcgcggtcacgtgagcgctggacatggtcgtatcggaaagcaccgtaagcatcctggaggtcgtggtaacgctggaggtatgcaccaccaccggattcttttcgacaagtaccatcctggtttctttggtaaagtcggtatgaggtacttccacaggctccgcaacaagttccattgtcctattgtcaacgtcgacaagctctggtcaatggtgccacaagacgtgaaggagaagtcatccacagacaaggttccagttattgacgtcacacagttcggttacttcaaggtgttgggaaaggggactgttcctgcatctcagccgattgttgtcaaggcgaagttgatctcaaagacagccgagaagaagattaaggaagccggtggtgctgttgtgctcacagcttaggtctgttgttttgatttcatttgcagattactctgttttgctgaatttggattcagtttagatttaagtgttgtttttgaatacttatatttgtgttctactttgctgagattttttgttatttgtggtatgaacttacatgtcattactatccatgatttgaggtaact

SEQ ID NO: 3274 - DNA, 604 bp, Helianthus annuus
ttctgccgctcttcttcaccgccttttcatctacaggggaaaatgacgaccagattgaggaagaacaggaagaagcgtggtcacgtgagcgctggacatggtcgtatcggaaagcaccgtaagcatcccggaggtcgtggtaacgctggaggtatgcaccaccaccggatcctttttgataagtaccatcccggtttctttggtaaagtcggtatgaggtacttccacaggctccgcaacaagttccattgtcctattgtcaacgtcgacaagctctggtcaatggtgccacaagacgtgaaggagaagtcatctacagacaaggttccggttattgacgtcacacagttcggttactttaaggtgttgggaaaggggactgttcctgcatctcagccgattgttgttaaggcaaagttgatctcaaagacagccgagaagaagattaaggaagccggtggtgctgttgtgctcacagcttaggtctgttgttttgatttcatttgcagattactctgttttgctgaatttggattcagtttagatttaagttttgtatttgaatacttatatttgtgttctactttgctgagattttttgtta

SEQ ID NO: 3275 - DNA, 653 bp, Tabernaemontana elegans
ctagtatccctccccgcccccctccctacaaaccccacgaccggaaaaatgacgacccgcttcaagaagaacaggaagaagagaggtcacgtcagcgctgggcacggccgtatcggaaagcacaggaagcatccaggaggtcgcggtaatgccggaggtatgcaccaccacaggatcctcttcgacaagtaccatccgggttatttcggtaaggttggtatgaggtattttcacaagctccgcaacaagttctattgtccgattgtcaacatcgacaagctctggtcgcttgtgccctctgatgtgaaggagaaggccaatggaagcaatgcgccagtgattgatgtttcccagttcgggtactttaaggtattgggtaagggtgtgttgcctcagaaccagcctgttgttgttaaggctaaactcgtctcgaaaactgctgaaaagaagattaaggaggctggcggcgctgtcgtgcttactgcttagggttttccgttttttgaatttatctgagtatattttaaattttgagaactcatttggatttagttaatgatgttgaacttggatattggactattgcagttttgttctgaggatgaaatactttactgggatagtattgttgttatgtttcaatttcagttaac

SEQ ID NO: 3276 - DNA, 765 bp, Thalictrum flavum
cccctaacctaacctaaccctaatccttcgaggaagaagaaggagagaggcaggtttaccatgacaactcgattcaagaagaacaggaagaagcgaggacacgtttcagctggacatggtcgtattggaaagcatcgaaagcatccaggaggaagaggaaatgcaggaggaatgcatcatcatcggatcttgttcgacaaataccatccagggtatttcgggaaagttggaatgaggtacttccataagcttcgcaataagttctattgccctactgttaatatcgataagctttggtctttggttccacaagaaatcaaagacaaagcttctgccgagaatgcccctttgattgatgttactcagttagggtttttcaaagttttgggtaagggtatgttgcctccttctcaacctgttgttgtcaaagctaaacttatttcgaagaatgctgagaagaagattaaggaagctggtggtgctgttcttcttactgcttagtagttctagatcttaatcttatggggtttatggataacgaatttagtctttgtatgcagagatcttactagacatagtttcatttggatcgtgttaatttttggagttttattatagatagtgttacttctcttgtttgagttttgcggtgaaattgtggaatcaatttcatataatatttgcatactttagtattgctggattctatgttatcaattgtttaggggtattcttctaatatcagcattttttatgtatgtgtgt

SEQ ID NO: 3277 - DNA, 731 bp, Triphysaria pusilla
cccatttcgttcccaatcggcgccgctcttcaacccccttcccaatccatttcccgatctccacaatgacgacccgattcaagaagaaccgcaagaagcgtggccacgtcagcgccggccacggtcgtatcggcaagcaccgcaagcatcccggaggtcgtggtaacgccggaggcatgcaccaccaccgtatccttttcgacaagtaccatccaggttacttcgggaaggtcggtatgcgctatttccacaggctgaggaacaagttccattgccccaccgtcaacatcgacactctctggtccatggtgccgcaggaggtgaaggataaggcgaccaaggacaacgcgccgttgatcgatgtgacgcagttcggttacttcaaggtcctcggcaaggggttgttgccggctgataggcctgtggttgtgaaggcgaagctcgtgtcgaaggttgcggagaagaagattaaggaggctggcggcgcggtcgttctcactgcttaattaggttacgattaattgctgttcttttggatttagcctttttttattgagatactcttgaatacagttctatatgaatggttttgagtttaccatgattttgcatttgtctttgttttgctattacgctggtatgaaaattcacaattctgtctattagaatctaatctggatgtttactggcattggtttctatattcaatagatgatgaacaattaagctga

SEQ ID NO: 3278 - DNA, 755 bp, Citrullus lanatus
acttcctcgcgctcgccgctcccttttactctgaaaacctaattctcctccactcgccgacgaaatgacgacccgcttcaagaagaacagaaagaagcgcggtcacgtgagcgccggccatggtcgtatcggcaagcaccgtaagcatcctggtggtcgtggtaacgcaggaggtatgcaccaccacagaatcctcttcgacaaataccatcctggttattttggtaaagttggtatgaggtacttccacaagctccgtaacaaattctattgccccattgtaaacgtcgacaagctctggtccctcgttcctcaggaggtgaaggacaaggcttctaaggataatgtccctttgattgatgttacccagtttgggtatttcaaagttttgggtaaaggggttttgcctgagaaccagcccgtcgttgtgaaagccaagctcatctccaaaattgcagagaagaagatcaaagagaatggtggtgcggttgtccttacggcttaggtttattgggtaactcttagttatgattttgtttccaaattagttttgatgtcttgtggcgttattcgaagtattggattaatgttatcaaactttgtatttcagttttcttcactttgaactcattccgattttgaatgtgtttcttgaattatcatttatcttgaatgttatacattgttaattttcgtagtttcttgggctttagttatcattgttgaaagtgctccttgcattccttatagatctt

SEQ ID NO: 3279 - DNA, 885 bp, Abies balsamea
atccgtattgttttaggagcaatgattcccatcgtttgctttggttgctcctaaatgtagggttttgttttgatattttttaaaggtataagcatacgggtttgagaaattggattgcaaacgaaattagggtttcgctttaaaaccctacaattaactataggaaatcgttttgaaggacgaaggagaggcagaggcagaggcgagcaggatgacgaccagactgaagaagaacaggaagaagagagggcatgtgagcgcaggccacgggcgtatcggcaagcacaggaagcatccgggtggtaggggtaacgccggaggtatgcaccaccatcgcattctcttcgacaaataccatcccggctacttcggcaaggttggtatgaggcatttccacaagcttaggaaccactatcactgtcccatcgttaatattgaaaagctgtggtctctggtaccagaggacgtcaaggccaaggccacccccgacagtgcccccctcatagacgttacacagttcggattttttaaggtcttgggcaagggtgagctgccctcgcagcctctcgttgtgaaggccaagcttatttctaagctggccgagaagaagatcaaggaggcaggcggggcagtcatgttgaccgcctgatttgggttttagggttttgttttctcttttcattacagagttttcaggttcgtttgtgttttgggtatcaatggataaatttagcaaggattatattatttctattttcacttggaatccttcttctgaacgcttatgatcaagtgttatattccatacctgtttctagatggtttgtgatttcgagacctactttcaatgcaatgaacaattttcttagctaaaaaaaaaaaaaa

SEQ ID NO: 3280 - DNA, 661 bp, Abies balsamea
acaagcgctcgagagaaaccctgttgaaggaggccggggcagaggcgagaggggaagacaaggcagaggttggcaggatgacgaccaggctgaagaagaacaggaagaagagagggcacgtgagcgctggccacggccgtatcggcaagcacaggaagcatccgggtggacggggtaacgctggaggtatgcaccaccatcgcattctcttcgataagtaccatcccggttacttcggtaaggttggtatgaggcatttccacaagctaaggaatcactatcactgccctattgttaatattgaaaaactgtggtctctgattcccgaggatgtcaaggccaaggccactgctgacagtgccccgctcatagacgttactcagtttgggtatttcaaggtcttgggcaagggcgagctgcccaagcaacctatcgtagtgaaggcgaagcttatctctaagctggccgagaggaagatcaaggaggccggaggggcagtcatgttgactgcttgatttgggttttaccattttgggtattagtatttttagtggttttagggttttgacctttgctttcagaattcttacatacattagtgtctcaggagaatggacagagttccatgaatccttaaacaaaactattatggattatgtta

SEQ ID NO: 3281 - DNA, 664 bp, Cycas rumphii
  misc_feature (115)..(115): n is a, c, g, or t
gccgaggaggaagctgcagaatgacgacgagattgaagaagaacaggaagaagagggggcacgtcagtgcagggcacgggcgtgtcggcaaacacagaaagcatccgggcggtanaggtaatgctggaggattgcaccaccaccgtattctcttcgacaaataccatcccggttactttggaaaggttggtatgagacatttccacttgcttaggaatcagtactactgccccattgtcaatgtagagaaactatggtcgttggttcccgaagacgtcaaggccaaggccacttcagataatgtgcctctgttagatgttactcagtttggttatttcaaggttttgggcaaaggagaattgcccactcagccccttgttgtcaaagccaaactcatttcgaagttggctgagaagaagatcaaggaggctggcggtgctgttcttttgaccgcttgatcggggtttcagttctcctgattttggtcacggactcgtttgttatatgatttttgattttctcagctgaacagaatatttttacttcatattttatttagggccagacctaaatctcccagtttcggttttattcactcaatataaggcaattaccctgttttttccttttaattggaagaaccctaagtatttgttgtctgacc

SEQ ID NO: 3282 - DNA, 678 bp, Pinus pinaster
attgtgggaggacgaagaggcggaggcgaagaagaggaaggagaggccgagcaggatgacgaccagactgaagaagaacaggaagaagagagggcatgtgagcgcaggccacgggcgtatcggcaagcacaggaagcatccaggtggtaggggtaacgccggaggtatgcaccaccatcgcattctcttcgacaaataccatcccggctactttggtaaggttggtatgaggcatttccacaagctgaggaaccattatcactgtcctatcgttaatattgacaagctgtgggctctggtacccgaggacgtcaaggccaaggccacccccgacagtgctcctttaatagatgtcactcagtttgggtattttaaggtattgggtaagggcgagctgccctcgcaacccatcgtcgtgaaggccaagcttatttctaagctggctgagaagaagatcaaggaggcaggcggggcagtcatgctgaccgcctgattggagttttagggtttttttgcatttgatttcagaatttttacctctgtcggtgttttgggtattattaatggacaaatttgttgaggatatactatttatgtttctcatttggaatcctatttctaaatgctcacaatcatgtgttatgttctatatttgtttctacatggtttgttattttg

SEQ ID NO: 3283 - DNA, 655 bp, Tropaeolum majus
cggccgggggaggagagagatagaccaaacacccccggagcacagaaatgacgaccagattcaagaagaacaggaagaagaggggtcacgtcagtgccggtcatggacgtatcggcaagcacaggaagcatccgggaggtcgcggtaacgctggaggtatgcaccaccacaggatcctcttcgacaagtaccatccagggtatttcggtaaggtaggtatgaggtacttccacaaactccgaaacaaattccattgccctattgttaacctagacaagctctggtcgcttgtgcctcaagagactaaggacaaagcaaccaaggacgccgcaccggtgattgacgtcactcagtttggttacttcaaggttttggggaaaggtgtgttgcctgatcagccatttgttgtgaaggccaagcttatctccaagatagctgagaagaagatcaaagccgcgggtggtgcagttcagcttactgcttaggttagatgttttttatgctagaatgtttcaaatgcaacatattttgttgtttattttgcgattttgatctagttgaatctgaacttgttttttatttcagttgtgccttggttattatggattttttgatgataaaatgtgttttgttcactcagatttaattgttattt

SEQ ID NO: 3284 - DNA, 607 bp, Pinus taeda
gaggacgaagaggcggaggcgaagaagaggaaggagaggccgagcaggatgacgaccagactgaagaagaacaggaagaagagagggcatgtgagcgcaggccacgggcgtatcggcaagcacaggaagcatccaggtggtaggggtaacgctggaggtatgcaccaccatcgcattctcttcgacaaataccatcccggctactttggtaaggttggtatgaggcatttccacaagctgaggaaccattatcactgtcctatcgttaatattgacaagctgtggtctctggtacccgaggacgtcaaggccaaggccacccccgacagtgctcctttaatagatgtcactcagtttgggttttttaaggtattgggtaagggcgagctgccctcgcaacccatcgtcgtgaaggccaagcttatttctaagctggctgagaagaagatcaaggaggcaggcggggcagtcatgctgaccgcctgattggagttttagggtttttgcctctgattttagaatttttatctgtgttcgtgttttgggtattaatggacaaatttgttcaggatatattatttatgtctctcatttggaatcctttttt

SEQ ID NO: 3285 - DNA, 636 bp, Picea glauca
ggcagaggcgaggagcaggaaggagaggcagagcaggatgacgaccagactgaagaagaacagaaagaagagagggcatgtgagcgccggccacgggcgtatcggcaagcacaggaagcacccgggaggtaggggtaacgccggaggtatgcaccaccatcgcattctcttcgacaaataccatcccggctacttcggtaaggttggtatgaggcatttccacaagctcaggaaccactatcactgtcctatcgttaatatcgaaaaactgtggtctctggtccccgaggatgtcaaggccaaggccacccccgacagtgtccccttaatagacgttacccagttcgggttttttaaggtcttgggcaagggcgagctgccctcgcagcccatcgttgtgaaggccaaacttatttctaagttggctgagaagaagatcaaggaggcaggcggggctgtcatgctgaccgcctgagtggggttttatggtttttgtctttgatttcataatttttatctttgttagtgttttgggtatcaatggacaaatttataaaggatatattgtttatgtttctcatttggaatccttcttctggatgcttatgattacgtgttatgttatatatttgtttc

SEQ ID NO: 3286 - DNA, 765 bp, Pinus taeda
gccaaattggattgcaaacgaaattagggtttcgcttcaaaaccctccagacgaccgaagaaagctctatcgtgggagggcgaagaggcggaggcgaagaagaggaaggacaggccgagcaagatgacgaccagactgaaaaagaacaggaagaagagagggcatgtgagcgcaggccacgggcgtatcggcaagcacaggaagcatccaggtggtaggggtaacgccggaggtatgcaccaccatcgcattctcttcgacaaataccatcccggctactttggtaaggttggtatgaggcatttccacaagctgaggaaccattatcactgtcctatcgttaatattgacaagctgtggtctctggtacccgaggacgtcaaggccaaggccacccccgacagtgctcctttaatagatgtcactcagtttgggtttttaaggtattgggtaagggcgagctgccgtcgcaacccatcgtcgtgaaggccaagcttatttctaagctggctgagaagaagatcaaggaggcaggcggggcagtcatgctgaccgcctgattggagttttagggttttttcctctgatttcagaattttgacctgtgttggtgtttttggtattaatggacaaatttgttcaggatatattatttatgtctctcatttgtaatcctttttctaaatgcttatgatcatatgttatgttctatatttgtttctagatggtttgttattttgtgacctcctattaaatgttatgatc

SEQ ID NO: 3287 - DNA, 628 bp, Pinus taeda
gggcgaagaggcggaggcgaagaagaggaaggacaggccgagcaagatgacgaccagactgaaaaagaacaggaagaagagagggcatgtgagcgcaggccacgggcgtatcggcaagcacaggaagcatccaggtggtaggggtaacgccggaggtatgcaccaccatcgcattctcttcgacaaataccatcccggctactttggtaaggttggtatgaggcatttccacaagctgaggaaccattatcactgtcctatcgttaatattgacaagctgtggtctctggtacccgaggacgtcaaggccaaggccacccccgacagtgctcctttaatagatgtcactcagtttgggtttttaaggtattgggtaagggcgagctgccgtcgcaacccatcgtcgtgaaggccaagcttatttctaagctggctgagaagaagatcaaggaggcaggcggggcagtcatgctgaccgcctgattggagtttagggttttcctctgatttcagaatttgacctgtgttggtgttttggtattaatggacaaatttgttcaggatatattatttatgtctctcatttgtaattctttttctaaatgcttatgatcatatgttatgttcc

SEQ ID NO: 3288 - DNA, 816 bp, Picea glauca
tttaaaatcgtaaaaccccagaaacgctcgagggaaaccctattgaaggaggcagggcctgaggggaaggggaaggcaaggcaaggcaggacagagcagaggttggcaggatgacgaccagattgaagaagaacaggaagaagagagggcacgtgagcgcaggtcatggccgtatcggcaaacacaggaagcatccgggtggtcggggtaacgctggaggtatgcaccaccaccgtattctcttcgacaagtaccatcctggctacttcggaagttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtattttaaggtcttgggcaaaggcgagctaccctcgcagcctatcgtagtcaaggccaaacttatttctaagttggctgagaagaagatcaaggaggcaggcggggctgtcatgctgactgcctgattgcagttttaccattttttgtagttttagttacttttatttcgatataggtttttaaccttctgcttcttaggatttttacttatctgtttagttgtttttgggggtagttaatggacagagttccatgaacccttgaaatttattatggattatttcttgtctcgagtctttacttaaaaaatactatgatagatcccaacttcaatgctatcgtcatttttcttattgtcttggtattgcagtcattctgaactggttggccagaat

SEQ ID NO: 3289 - DNA, 695 bp, Petunia hybrida
acgcgggggtctctcacacaactcttcactccccataaccctatccctcttttctccgccgtcagagaaaatgacaactcgtttcaagaagaacaggaagaagagaggacacgtgagcgcaggacacggtcgtatcggaaagcacaggaagcatccaggaggtcgtggtaacgcaggaggtatgcaccatcaccgtatcttattcgacaagtatcatccaggttactttggtaaagtaggtatgcgttatttccacaaactccgtaacaagttttattgccctactgttaacatcgataagttatggtcacttgtaccacaagatgttaaggataaggttgctgctggtggtgctaaaggtactgctcctttgattgatgttactcagtatggttactttaaggttttgggtaaaggtgttttgcctgagaatcaagctgtcgttgttaaggccaaacttgtttcgaagaatgctgagaagaagattaaggaagctggtggtgctgttgttcttactgcttaggtttcagttattgttagtagttttcagattcatgtgtccgatctcgtgtcgggattgaggctaacgatttactgttttgagttaatttgaaccagaagtaactggagttttgctttgaaatataattttggatattattatgttctatatttgagatcctgctttatcgatg

SEQ ID NO: 3290 - DNA, 692 bp, Euonymus alatus
acgggctcaactctcttcaaaacggctcgttaaagccctaattcccttgttctagccgctcctcagctctgctcccacagaacgagagagtagcagagatgacgacgagattgaggaagaaccggaaaaagaggggccacgtgagtgctgggcatggacgtatcgggaagcaccggaagcatcctggaggacgcggtaacgccggaggtatgcaccaccatcgaatcctcttcgacaagtatcatccagggtatttcggaaaggttggaatgcgatatttccataagctacgcaacaagttctattgccctagcgtaaatatagaaaagctctggtccatggttcctcaggacgtcaaggaggtggtcaaatcctctaaggacggcaatgttccggtgattgatgtcacccagtttggctacttcaaggtcttgggtaagggtgtccttcccgagaatcagcccatcgttgttaaggccaagctcatatctaaaattgccgagaaaaagattaaggaaaacggcggagccgttgttctaacagcataggttattttcgtaactttattgctatttttgatatgttgtgagtcatggttattgatggatttggacctcatggatcttcaacttttcattgcttaatcgaagatcatgatatcttacaacttttattgaatgattggctcttaa

SEQ ID NO: 3291 - DNA, 718 bp, Glycyrrhiza uralensis
gccctggactctccattgtttcttctgccgccgaaacgaacgagacgagatgactacccgcttcaagaagaaccgtaagaagcgaggccacgtcagcgccgggcacggccgtatcggaaagcaccgtaagcatccgggcggtaggggaaacgccggaggcatgcaccatcaccggatcctgttcgataagtaccatcctggttacttcggtaaagttggaatgcgctacttccacaagctccgcaacaaattctactgtcccatcgtcaacatcgacaagctttggtctctggttccccaggaagtgaaggacaaagccaccaaggacaacaacactgctcctttgctcgatgtcacacagctcggttactttaaggttctcggtaagggtgttttgccccctaaccagccccttgtcgttaaggccaagcttgtgtcgaagatcgccgagaagaagattaaggaagctggtggtgctgtcgtccttaccgcttaatttgtagctttttctatattttattcttccttaattccgattttcaagttgttttgttttcgcacattcgaacatgagacatgctgatggttttgttttggttaaattttcctagtattttacatatctcagttgattatatatcatgtttctagtacctactcgttggtttatgaaactgatttttgaggcacaagtttgtgttccttgttttatcaaaaa

SEQ ID NO: 3292 - DNA, 749 bp, Glycyrrhiza uralensis
ggcggctccgtgagagagtgggaggagaaggcaagggaggaaaatgacgacgaggttgaagaagaatcggaagaagagaggtcacgtgagtgccggtcacggccgcattgggaagcaccggaagcacccaggaggtcgcggtaacgccggaggcatgcaccaccaccgcatcctcttcgacaagtaccaccctggttacttcggcaaggttggcatgcggtacttccacaagctccgcaacaaattctactgccccaccctcaacattgacaagctctggtcgttgattccccaagaggtgaaggaccaagcctccactgataaggccaaagccccattgatcgatgtcactagcttcggatactttaaggttctgggcaaaggcgttctccctcccaaccaacccgtcgtcgttaaggccaaactcgtttcaaagatcgctgagaagaagatcaaggaggccggaggagccgttctcctcaccgcttgatttttaaagggtattatatttctgttcaaaaaaaattagggttttgagatctcgaatattgttgttcgcgctattggtttctgtgaactgacttagttgcaatgcaatatgatctcatacttattctcctttttatgctgagtgttttacattttagtttttgctttatgtttcttaacaaaattaaatggatgctgtgtttctgtttgaacagttatctctgtgaagagagtaataatatgctgtcctttatattgaa

SEQ ID NO: 3293 - DNA, 1057 bp, Arachis hypogaea
tccattatcacacacagaagcagcagcagcagcagcaaacaaagagagaaaatgacgacgagattcaagaagaacaggaagaagagaggtcacgtcagcgccggccacgggcgtattggaaagcaccggaagcacccgggaggtcgtggtaacgccggaggaatgcaccaccaccgcatcctcttcgacaagtaccatcccggttacttcggcaaggtcggtatgcggtacttccacaagctccgcaacaagttccattgccctatcgtcaacattgacaaactctggtccttggttcctcaagagttgaaggataaggcctccaaggacggtaccaaggcgccgttgattgacgtcacgcaattcggttacttcaaggttttggggaaggggattcttcctgagaaccaacctgtggtcgtgaaggccaagcttgtttcaaaggttgcggagaagaagatcaaggaggctggtggtgctgttgttctcaccgcttgatttctagggtattattctatttttgaataattttagggtttatgctttttacatttttggtttttggactattttaagatgttggatgttgttattactatgatatactttagctgggttagttgaagtgtttggctcgtactttagtctaatttttctgttggatgtttgattataaatttgaagtggggatcatattaattggacgctgcttatttaaaacatttatctgaaatgcggcatattaaggtgatagtgataggtttacaagaatgaagggtttgttatgcctttaatttcctggcatttataatagaaattgattgttttagggtttggtgattttgatccggttatgcttgatgcttttggttgtggcttgtgttcatttggggcatcaagttatacatttatggaccgtttttgtggggagtattttgttgtcttttgaatagaagtgcaggggagatgtgattagagcattttacaatggctttaacattttctaatcggtggtcatagtagctttggtctttattgtctttctttcttctcttca

SEQ ID NO: 3294 - DNA, 633 bp, Capsicum annuum
ccactcccctatcccattcccgccgccgcagaaatgactacccgtttcaagaagaacaggaagaagcgcggccacgtcagcgccggtcatggtcgtataggtaagcacaggaagcatcccggtggtcgtggtaacgccggaggtatgcaccatcaccgtatccttttcgacaagtaccatccaggttacttcggtaaagtcggtatgcgttacttccacaagctccgcaacaagttctattgccctactgtcaacatcgacaagctttggtcacttgttccacaagaggtgaaggataaggctgctgcaagcaaagatagtgctccgttgatcgatgtgactcagtacgggtactttaaggtgctgggaaaaggtgttttgccggagaatcaacctgttgtggtgaaggcgaagctgatttcgaagaatgctgagaagaagattaaggagaatggcggtgctgttgttctcactgcttaggtttggttttatttagtagtttttggtattcgtgtagccgatcttgacttgtttgggattaaggcttagtttatcttcagttttggattttgattattaaggtatgtttaagcctgagtattactgtgttttttcctttgcaatacattcgga

SEQ ID NO: 3295 - DNA, 839 bp, Glycine max
cgcaaacagagatgacgacccgattcaagaagaaccgcaagaagcgcggccacgtgagcgccggtcatggccgtatcggaaagcaccgtaagcaccccggcggccggggaaacgccggtggcatgcatcaccacaggatcctgttcgacaagtaccatccgggcttcttcgggaaggtgggaatgaggtacttccataagcttcgcaataaattctactcccccatcgtcaacgtcgaaaagctatggtctctcataccccaagacgcgaaggaaaaagccctaaaatcgaaggacactgcccctctaatcgacgtcacacagcacgggtacttcaaggtcctcggaaaaggtgttctgccccaaaatcagccttttgttgttaaggccaagcttatttccaagatcgccgagaagaagattaaggaagccggtggcgctgttcttctcaccgcttaggtttaaaaactgttttttaattgtgttgttttgtttcggataacttttttgattatatattgcaagtgatacattgtgtttttttttagtgtttttgttgttggatttaggttgattaaaaggtttatgcgaacagttttgacctaatatcctaaaaccttgttttaatgagttgtgataggaaatttattggaataagggaaacaaattttggggaggattataattatgggcaatattttgttgcgagttttgtcgattacaccaaattattagtgttccacgaacataacaacgagggatggaatgacctgcaatcttggtgctactgcactgcttctgaatttgtgtgattgaatcttaatattattattggaagca

SEQ ID NO: 3296 - DNA, 899 bp, Glycine max
actccaaaccctaattcaataaattgcttaatccccaaaccctaattcgtgccgcaaacagagatgacgacccgattcaagaagaaccgcaagaagcgcggccacgtgagcgccggtcatggccgtatcggaaagcaccgtaagcaccccggcggccggggaaacgccggtggcatgcatcaccacaggatcctgttcgacaagtaccatccgggcttcttcgggaaggtgggaatgaggtacttccataagcttcgcaataaattctactcccccatcgtcaacgtcgaaaagctatggtctctcataccccaagacgcgaaggaaaaagccctaaaatcgaaggacactgcccctctaatcgacgtcacacagcacgggtacttcaaggtcctcggaaaaggtgttctgccccaaaatcagccttttgttgttaaggccaagcttatttccaagatcgccgagaagaagattaaggaagccggtggcgctgttcttctcaccgcttaggtttaaaaactgttttttaattgtgttgttttgtttcggataacttttttgattatatattgcaagtgatacattgtgtttttttttagtgtttttgttgttggatttaggttgattaaaaggtttatgcgaacagttttgacctaatatcctaaaaccttgttttaatgagttgtgataggaaatttattggaataagggaaacaaattttggggaggattataattatgggcaatattttgttgcgagttttgtcgattacaccaaattattagtgttccacgaacataacaacgagggatggaatgacctgcaatcttggtgctactgcactgcttctgaatttgtgtgattgaatcttaatattattattggaagcaaggtttta

SEQ ID NO: 3297 - DNA, 666 bp, Gerbera hybrid cultivar
gccgccgtccttcgccggagtttgcttctaaggggagaatgacgaccagattgaggaagaatcgtaagaagcgcggccacgtgagcgccggtcatggtcgtatcggaaagcaccgaaagcatcccggaggtcgaggtaacgccggaggaatgcaccaccaccggatccttttcgacaagtaccatcccggttaattcggtaaagtcggtatgaggtacttccacaggctccgcaacaagttccattgcccgatcgtgaacgtcgacaagctttggtcgatggtgccacaggaggccaaggagaatgcgtcggccgataaggttccggtcgtcgacgtcactcagtttggttactttaaggtgttggggaaggggactgtgccttcgtcacagcctttggtggttaaggcgaagctcatttcgaagaccgctgagaagaagattaaggaagctggtggtgctgttctcctcactgcttaggtttgttttcaattgcttatgccaattatgattattactgttagttttcagaccgtttttgttgaattcgaacttacatttgatcaaaattttgtttcaaaatcggataattatgttttaaatgtttccgatctctttgttttcaaggatttgaacttataggttgatgataaaaaaaaaaaaaaaa

SEQ ID NO: 3298 - DNA, 687 bp, Vinca minor
atctccacagagaaaaaccctagaaaatccaccgccgccgccatgacaaccaggttcaagaagaacaggaagaagagaggccacgtcagcgccggccatgggcgtattggcaagcaccgtaagcatccaggaggaagaggtaacgccggaggaatgcaccaccatcggatcctgttcgacaagtaccatccagggtattttgggaaagtcggtatgaggtatttccacaagatgaagaaccagttccattgccccatagttaatgtcgacaagctctggtccatggtaccacaggatgttaaggataaggcaggaaaggacaaatctgccccggtgattgacgtcacccagttcggttactttaaagttttgggcaagggttttgcctgagatcaggctgttgttgttaaggccaaacttatttcgaagacggctgagaagaagattaaggaggctggtggcgctgttctgctcaccgcgtaaaatttcctgcggtctgatttttattataattacatgttactatcaagtatttgaaatggattatgcttttcttagttttttttgagttttaatggatgatcaaattttgagtattatgtttcatgggattttgtttaattagtatgtttcagttgttttggtaacttcgctgattaatttagcgataattgtctacttgttcta

SEQ ID NO: 3299 - DNA, 857 bp, Prunus mume
ccagctccctcgatcttctgtgagccgccgaaaccctaggtgagcgagagagaggcgcagagagagagagaaatgacgacccgattcaagaagaaccgcaagaagagaggccatgtcagcgccgggcatggtcgtatcggcaagcaccgcaagcatcctggaggtcgcggtaacgccggaggcatgcaccaccaccgcatcctcttcgacaagtaccatccggggtattttggtaaagttggtatgcgctacttccacaagctccgcaacaagttctactgccccatcgtcaatgtcgacaggctctggtctcttctcccccaggaggccaaggacaaggccaccaaggacagcgcgccgttgatcgacgtcacccagtacggcttcttcaaggtcttgggaaagggcgctttgccgcagaaccagccggttgtggtcaaggccaagctcatctccaagacagctgagaagaagatcaaggaagctggtggtgctgttgtgctcacagcttaggtttgggttgattttggatttttgtctgttagggttttggattcagttgctgtttttttgcttttaaattctggtttagactcttgggctacatttatgttatattttgaaagtttatctagcggatatttaattaatgcttgttttcagatgaatgggctttgcttcatatatgcttttgatatgattgtgggtttgtttcatttttggtattggtagagtttttgttcgcgctgcttaatacatttttgtgtgttgtgattatatgatgtgaaaagcataatgtggcattggtcgcactgaactaaaatctgtttatcttgttgtgaatgtttggattttgt

SEQ ID NO: 3300 - DNA, 610 bp, Acacia harpophylla
gggccgaaacctgagaaacgagaagcttttgcggagacagacagatcggaaatgacgactcgcttcaagaagaatcgtaagaagcgtgggcacgtgagtgccggtcacggccgtatcggcaagcaccggaagcacccaggtggtcgtggtaatgctggtggtatgcaccaccatagaatcctctttgacaagtatcaccctggttatttcgggaaagtaggtatgcgatacttccataagcttcgcaataagttctactgccctattgtcaacatcgacaagctctggtcattggttccgaatgaggtcaaagagaaggcctccaaggacagtgttcccttgatcgatgtcactcagcatgggtacttcaaggttttgggtaagggagttttgccggagaaccagcctgttgtggtgaaggccaagctcgtttccaagaatgcagagaagaagatcaaggaggctggcggggctgtggttcttactgcttaggttctggatactttttctgtttattagaattttgtttctctgttgttagttcctcttgaattgattgaaattttaagctttgatctattcgaactccagtgaaggttatgcatttgac

SEQ ID NO: 3301 - DNA, 840 bp, Amsonia hubrichtii
gccggagaaatgacgacacgcttcaagaagaacaggaagaagaggggtcatgtcagtgcagggcacggacgtattggaaagcacaggaagcatccaggaggtcgtggtaacgccggaggtatgcaccaccacaggatcctcttcgacaagtaccatcccggttatttcggtaaggttggtatgaggtacttccacaaacttcgcaacaagttctattgccccattgtcaacatcgacaagctctggtcgcttgtgccttctgatgtgaaggagaaggccaatggaagcaacaatgcccccgtgattgatgttacccagtttggatactttaaggtcttgggcaagggagtgttgcctcagaaccagcctgtggttgttaaggctaagctcgtctcgaaaaccgccgagaagaagattaaggaggctggcggcgctgtcgttcttactgcttagggttttttcttgtcttcgattcgagtatattttaaatttttggatacacattttaatcagttaatgttgtggaacttgaaaatcggagtattgcagttttgttctgatgatgaagtacacctttgggatattattagtatggcgtttcaatttcagttaaagtgcagaatttacactgttttctctttacttgtgtatgggttttgcttagaaaatgtgtggtttgtgtggtttaaagtatactggttagtgtaacgtggtgtgttgattatttagtgcgatactctagtggctttaatgttatatgatggacttcttaaatgttcaaagaagttagttgtcaatgttttaggatttcatagagcactagtgttcatgtggatgatt

SEQ ID NO: 3302 - DNA, 626 bp, Antirrhinum majus
  misc_feature (125)..(125): n is a, c, g, or t
  misc_feature (182)..(182): n is a, c, g, or t
  misc_feature (201)..(201): n is a, c, g, or t
  misc_feature (203)..(203): n is a, c, g, or t
  misc_feature (286)..(286): n is a, c, g, or t
  misc_feature (371)..(371): n is a, c, g, or t
  misc_feature (620)..(620): n is a, c, g, or t
gcacacacacatcctcgctcacacaaatgacgacccgattgaagaagaatcgcaagaagcggggccacgtcagcgccggtcacggccgtatcggaaaacaccgcaagcatcccggcggtcgcggnaacgccggcggcatgcaccaccaccgcatcctcttcgacaagtaccacccggggtanttcggtaaagtcggcatgngntacttccacaggctgaggaacaagttccactgccccacggtcaacgtcgagaggctctggtcaatggtcccacaggaggtganggataaggcctccaaggagagtgtgccgttgatcgacgtgacgcagttcgggtactttaaggttttggggaaaggattgttgccngatggtcaggctgtggtggtgaaggcgaagcttgtgtcgaagagtgcggagaagaagattaaggaggccggtggtgctgtggtgctcactgcttgatttgatcggattagggttttttgtttttgttttggttaatttactgtttttttatttgatgttgttaagcactgataatgtgatatgagtactttttataatattgttattattgtcattgagatggaatatgattttggaattgatttttgnaaaaaa

SEQ ID NO: 3303 - DNA, 758 bp, Malus domestica
tgccgccgaaaccctagctaggtgagtgagagaaggaggtgcagactcggggaacagagagaaatgacgacccgattcaagaagaaccgcaagaagagaggccacgtcagcgccggtcacggtcgtatcggcaagcaccgcaagcatcccggaggtcgcggtaacgccggaggcatgcaccaccaccggatcctcttcgacaagtaccatcctgggtatttcggtaaagtcggtatgaggtactttcacaagcttcgcaacaagttctactgccccatcgtcaacgtcgacaagctctggtcgctcctccctcaggaggccaaggacagggccaccaaggacaacgccccgctcatcgatgtcactcagtacggcttcttcaaggtcctcggcaagggcgagttgccgcagaaccagcccatcgtggtcaaggccaagctcatctccaagaccgccgagaagaagattaaggaggccggtggcgccgtcgtgctcaccgcttaggtttgggttgtttttttagcattaaggtttcggattaaagttgctgttttttggaattgaatttcagtttagactgctgagctacagtttatgttatattttggaagtttaattagcggatatttatatgcatttctgtttttccaaatgaatggtttttctgtgaacgtatgattatgttttgttatcgtgatgggtttgtttcgatttctgtttgctacattttggttggcattatgattcaggattatccg

SEQ ID NO: 3304 - DNA, 667 bp, Artemisia annua
cgggggagtctgtaacttcctagggtttcagccgccgttcttcaccacaaaagcttcttcacaggcaaaaatgactaccagattgaggaagaacaggaagaagagaggtcacgtcagtgctggtcatggtcgtatcggaaagcaccgaaagcatcctggaggtcgtggtaatgctggaggtatgcaccaccacaggatcttgttcgacaagtaccatcccggttacttcggtaaggttggtatgaggtacttccacaggctcaggaacaagttccattgcccaattgtgaacgtcgacaagctctggtctatggtcccacaagacgccaaggagaagtcatctgctgacaaggttccagttgtcgatgtgactcagtttggttacttcaaggtgttgggtaagggagctgtgcctttgactcaccccatggttgtgaaggctaagttgatctccaagaccgctgagaagaagattaaggaagctggtggtgctgttgtgcttactgcttaggtttcttttttgatttatgttgcgaagtatggttattattactgttagttttattcgcagagtactttgtttggttaaatttgaacctgcatttgaatcaaattttgttacaaaatgctacaatatggttatgatgcgatttatggtttttatctg

SEQ ID NO: 3305 - DNA, 789 bp, Brassica juncea
tcggggagtagcagatctaacgaaatggcgacggcgttgaagaagaacaggaagaagagaggccacgtcagcgccggtcacggacgtatcgggaagcaccgcaagcatccaggaggtcgcggtaacgcgggaggtatgcatcaccaccgtatcctcttcgacaagtaccatccaggttacttcggaaaggtggggatgaggtacttccacaagctccgcaacaagttctactgccccatcgtcaacctcgacaagctctggtctctcgtccccgaggatgtcaaggccaagtccaccaaagacaaggtgccgatgatcgatgtgacgcagcacggcttctttaaggttcttgggaaaggtcatttgcctgagggcaagcctttcgttgtcaaggctaagcttatctccaagactgctgagaagaagatcaaggaggctggtggtgccgtcgtcctcactgcttaagttagttcgagtttctcttttaattattgtctttttgtatcgttttttgttggactcaaagtttgttgcgttttggaatgagagatcttttaatcaatattaatggattttataataggtgttggagtttgaatgtggtattgattttgtcgaatgtttgctatagattgttcattgagttgttgagttgattggggaagactatgtgttagctcatatgcaagttttggtcttcatatagtttaaacatttcaagcccttgttctttagtgttacagtcatcatgtttagaaatgaaaaggattgttcattgagttgttgagt

SEQ ID NO: 3306 - DNA, 559 bp, Brassica juncea
gatctgacgaaatggcgacggcgttgaagaagaacaggaagaagagaggccacgtcagcgccgggcacggacgtatcgggaagcaccgcaagcatccaggaggtcgcggtaacgcgggaggtatgcatcaccaccgtatcctcttcgacaagtaccatcctggttacttcggaaaggtaggtatgaggtacttccacaagctccgcaacaagttcttctgccccatcgtcaacctcgacaagctctggtcgctggttcccgaggacgtgaaggcgaaggcgagcaaggataaggtgccgatgatcgacgtgacgcagcacgggttcttcaaggtgctggggaaagggcatttgcctgaggggaagccttttgtggtgaaggcgaagcttatttccaagactgctgagaagaagattaaggaggctggtggtgccgtcgtgcttactgcctaagcggttaggttttgagttttgtttttgttttgaattgttatcttctgagtttgttgcattttggatattttggaatgagagatcttttaattaatattaatggatta

SEQ ID NO: 3307 - DNA, 692 bp, Brassica juncea
cttcttctaacagaaaccctagccgcaagggagtcacagatcggcggaaatgacgacgagattcaagaagaacaggaagaagcgtggtcacgtcagcgccggacacggacgtatcggaaagcaccgcaagcatcccggaggtcgtggtaacgccggaggtatgcaccaccacaggatcctcttcgacaagtaccatcctggtttcttcggtaaagtcggtatgcggtacttccacaagcttcgcaacaagttcttctgcccgatcgtgaacctcgacaagctatggtcgttggtccctgaggatgtgaaggcgaaggccacgaaggacaaggtcccgttgatcgacgtgacgcagcacgggttctttaaggtgttggggaaaggtcatttgcctgagaacaagccttttgttgtgaaggcgaagcttatctcgaagacggcggagaagaagattaaggaagctggtggtgctgttgtgctcactgcttagtttttatcgaaattttatcttctctttttggttttattgttggatgtttagtaatgaatctttgtcggaaaattttaagttgttttatgacattgagatatgcatgttttgaacatgtttgggggttacttgcatttctgttgcatattgtgaatttgcttcggacatatgttcgttataatggctgtctagattgaatttt

SEQ ID NO: 3308 - DNA, 449 bp, Brassica juncea
gatcggcgaaaaatgacgacgagattcaagaagaacaggaagaagcgtggccacgtcagcgccggacacggccgtatcggaaagcacagaaagcatcccggaggtcgcggtaacgccggaggtatgcaccaccacaggatcctcttcgacaagtaccatcctggttacttcggtaaagtcggtatgcgatacttccacaagcttcgcaacaagttcttctgcccgatcgttaacctcgacaggctatggtcgttggtccctgaggatgtgaaggcgaaggctacgaaggataaggttccgttgatcgacgtgacgcagcatgggttctttaaggtgttggggaaaggacatttgcctgagaataagccttttgttgtgaaggcgaagcttatctcgaagactgctgagaggaagattaaggaagctggtggtgccgttgtgcttactgc

SEQ ID NO: 3309 - DNA, 584 bp, Brassica oleracea
gggaagaagcttagatctaatccaaaaatggcgacggcgttgaagaagaacaggaagaagagaggccacgtcagcgccgggcacgggcgtatcgggaagcaccgcaagcatccgggaggtcgcggaaacgcgggaggaatgcaccaccaccgcatcctcttcgacaagtaccatccaggatacttcgggaaagtcgggatgaggtacttccacaagctccgcaacaagttctactgcccgatcgtcaacctcgacaggctctggtcgctggtccccgaggacgtgaaggcgaaggcggggaaggatagtaaggtgccgatgatcgacgtgacgcagcacgggttctttaaggttctggggaaagggcatttgccggagaacaggccgtttgtggtgaaggcgaagcttatttcgaagactgctgagaagaagattaaggaggctggtggtgccgtcgtgcttactgcctaggttataggttgagttttcgttctctgtgtttttttaattattgtcttctctctgttttttatatcgttgttgttgaactcaaagtttgttgcgttttgaatgagaaatctttt

SEQ ID NO: 3310 - DNA, 612 bp, Brassica oleracea
aaatggcgacggcgttgaagaagaacaggaagaagaggggtcacgtcagcgccggtcacggacgtatcgggaagcaccgcaagcatccaggaggtcgcggtaacgcgggaggtatgcatcaccaccgtatcctcttcgacaagtaccatccaggttacttcggaaaggttggtatgaggtacttccacaagctccgcaacaagttctactgccccatcgtcaacctcgacaagctctggtctctcgtccccgatgatgtgaaggcgaagtccaccaaagacaaggtgccgatgatcgatgtgacgcagcacgggttctttaaggttcttggaaaaggtcatttgcctgagggcaagcctttcgttgtgaaggctaagcttatctccaagactgctgagaagaagatcaaggaggctggtggcgccgtcgtgctcactgcttaagttaggtcgagtttctttttttttttttttttaatttctgtcttttggaatcgtttttgttggactcaaagtttgttgctttttggaatgagagatcttttaattaatattaatggattttataatagtcgttcggagtttgattgtggtattgatgtgttttttttcg

SEQ ID NO: 3311 - DNA, 595 bp, Brassica napus
gcagtagatctaacgaaatggcgacggcgttgaagaagaacaggaagaagagaggccacgtcagcgccggtcacggacgtatcgggaagcaccgcaagcatccaggaggtcgcggtaacgcgggaggtatgcatcaccaccgtatcctcttcgacaagtaccatccaggctacttcggaaaggtggggatgaggtacttccacaagctccgcaacaagttctactgccccatcgtcaacctcgacaagctctggtctctcgtccccgaggacgtcaaggccaagtccaccaaagacaaggtgcccatgatcgatgtgacgcagcacggcttctttaaggttcttgggaaaggtcatttgcctgagggcaagcctttcgttgtcaaggctaagcttatctccaagactgctgagaagaagatcaaggaggctggtggcgccgtcgtcctcactgcttaagttagttcgagtttctcttttaattattgtctttttgtatcgttttttgttggactcaaagtttgttgcgttttggaatgagagatcttttaatcaatattaatggattttataataggtgtttggagtttgaatgt

SEQ ID NO: 3312 - DNA, 893 bp, Centaurea maculosa
aaccctaaaaccgccgtctctcgccggagttcttctttcaggttagaatgacgaccagactcaggaagaaccgcaagaagcgaggtcacgtgagtgccggacacggtcgtatcggaaaacacaggaagcatcccggaggtaggggtaacgccggaggaatgcaccaccaccgtatcctcttcgacaagtaccatccaggttacttcggtaaagtcggtatgaggtacttccataggctccgaaacaagttccattgcccgatcgttaatgtcgacaagctatggtcgatggtcgccgaggacgtgaaagagaaggcctcggccgataaggtgcctgttgtggatgttacgcaacatggatacttcaaggttttgggaaagggaaatgtacctctttcgcacccgatggttgttaaggccaaacttatctcgaagacagccgagaagaagattaaggaagctggtggttctgttttgctcactgcttaggtctgtttttcagttttataattacttgcttttttagggtgttggttattgtgctaaacatgaattttgttttatcatgatgagcttattttgatatacaatagatcatttttatgaaagtgattgccttgttgaatttgagtggttagataatttagttcttatgacattgttcaatgctaggaaatatttcttggtgtttgatgccatcttggagaacccctttaaaaaagaaaaaataccgactgcgactctgcttgttttgatcttcttcatcaatctttattttatgccattttgcttcttcttcttcttcttcttcttcttcttcagcatcagctgaattggtgctgaaatggggttgatggatgtctttcttttctagtctattaacgcccacctcca

SEQ ID NO: 3313 - DNA, 632 bp, Centaurea maculosa
gtttctgccgccgtccaccgagtttgcttaagaggggataatgactaccagattgaggaagaacaggaagaagagaggacacgtgtccgccggtcatggacgtatcggaaagcaccgaaagcatcccggaggtcgtggtaacgccggaggtatgcaccaccaccggatcctgttcgacaagtaccatcccggttacttcggtaaggtcggtatgaggtacttccacaggctaaggaacaagttccattgccctatcgtcaacgtcgacaagctctggtcgatggtgccacaggacgtcaaggagaagtcgtcggccgacaaggttccggtggtcgacgtcactcagttcggttacttcaaggtcttgggaaagggagccgtgcctcttacgcagccgatggtggtgaaggccaagctcatctcgaagaccgctgagaagaagatcaaggaagctggtggctgtgttgtgcttactgcttaggtttgttttttcaattttcaaatgccaattatgattatttctgttagttgttctgttggcagagagtactttgattttgatggatttgaacttaaattttatcacacttttgtttcagaagaaaaataaaaaaagaggcggtcgcttatta

SEQ ID NO: 3314 - DNA, 643 bp, Cirsium arvense
agactgaaacgcagggtttcttccgccgtcctccaccggaaattcgcataaaagggtataatgacgaccagattgaggaagaacaggaagaagcgtggacacgtcagcgccggtcatggtcgtatcggaaagcaccgaaagcatcccggaggtcgtggtaacgccggtggtatgcaccatcaccggatcctgttcgacaagtaccatcccggttacttcggtaaagtcggtatgaggtatttccataggctcaggaacaagttccattgccccatcgtgaacgtcgacaaactctggtcaatggtgccacaggacgtgaaggagaagtcttcagccgataaagttccagtcgtcgatgtcacccagtttggttactttaaagttttgggaaagggagctgtgcctttgactcagcctatggtagttaaggccaagctcatttcgaagactgctgagaagaaaatcaaggatgctggtggttgtgttgtgctcactgcttaggtttgttttcgattttcatcgccaattatgaattatgtctgttagttttgttattggcagagtactttaattttgatggatttgaacttacattttatcatatcaacattttgtttcaaaaaagaaaaaagtaccgactgcg

SEQ ID NO: 3315 - DNA, 781 bp, Citrus clementina
gaccatataaatccccgatcccccatctcatcgtcttactgctctccgccacctcaacactgacctagcgacctcttaagatctgccgaaatgacgacccgcttcaagaagaacaggaagaagagaggccacgtcagcgccggtcatggccgtatcgggaaacacagaaagcatcctggaggtcgcggtaacgccggaggcatgcaccaccacagaatccttttcgacaagtaccatccgggttattttggtaaagtcggtatgaggtacttccacaaactccgcaacaaattccactgccccatcgtcaacatcgacaagctctggtccatggtcccacaagatgtgaaagcaaaggccagcaaggacaatgttccgatgattgatgtcactcagttcggctactttaaggttttgggcaaaggtgttttgccggagaaccagcccgtcgttgtcaaggccaagctcgtttctaagaccgctgagaagaagatcaaagaggctggtggcgctgttgtgctcacagcttagggttattttggtaactctcccttgtctagggattttgttttattctgggatctgttgagacttatttaaatcacaatgtttttatcttcttttttttgggtatatctctcgcttaatgattaaatgtgacctgaatctcattttatttgacttcttggtgcatttaagcagttttttatagtccctgatgtagattttattctagatgttgtgttgctcttcctgattgagaatatgagcttgtttgcct

SEQ ID NO: 3316 - DNA, 743 bp, Citrus clementina
cgcagtgagtgcactccgcagaaggtaaggaaaaaggaggaagagagcttcctagtcccagcaagagaaagatgacaacccgattcaagaagaaccgtaagaagaggggccacgtcagcgcggggcatggtcgtatcgggaagcacagaaagcacccgggaggacgcggtaacgccggaggcatgcaccaccacaggatcctcttcgataagtaccatccgggttatttcggcaaagtcggtatgaggtacttccacaaactgcgtaataaatttcattgcccaattgtgaacgtcgacaagctttggtcgatggtacctcaggaggtcaaagccaaggcttccaaagacaatgtgccaatgatcgatgtgactcagtttggctactttaaggttttgggtaagggcgttttgcctgagaaccaacccgttgtggtgaaggccaagcttgtttccaagacagccgagaagaaaattaaagaagctggtggagctgttgtgcttactgcttaggtttactgttattgtttttagaaaatttttgtgatattttggatttcagtttttgaatatttgactatttttacatgtagttttggatgtttatgttatcatttgaaactttttgctttatattgagacctgttattgattaattctgttttggcgttaaaatgatttgatcgtggctgttattgttatgaatttgtttagctttatatctgcgagtgaaatgacgatttg

SEQ ID NO: 3317 - DNA, 627 bp, Cleome gynandra
ggggggagagagagcgccgcagatcggagaagatgacgacgaggtttaagaagaacaggaagaagcgcggtcacgtctccgccggacatggtcgtatcgggaagcacaggaagcatcctggaggtcgcggtaacgctggaggtatgcaccaccaccgtatcctcttcgacaagtaccatcctggatacttcggtaaggttggtatgaggtacttccacaagctgcggaacaagttctactgccccatcgtgaatctggacaagctctggtcgctcgtaccccaagaggtgaaagacaaggcgaccaaggacaacgttccaatgatcgacgtgactcagttcggatactttaaggttttggggaaaggtgtattgccggagaacaagccagtggttgtgaaggcgaagctggtgtcgaagaacgcggagaagaagataaaggaggccggtggtgccgttgtgctcaccgcctagatcaggcaattttcgtccttccttatccctcttaactttccgttggactcattttgttgtttgattttattggagatgtggaatgtagaacctttatcggatttgatacatttggttaatcaatagtttcgattttgggctacaaaaaaaaaaa

SEQ ID NO: 3318 - DNA, 798 bp, Gossypium hirsutum
ctcgtctataagccgcgcttcagaagtcccgttcaatccaagtatctaacaatgacaacccgtttcaagaagaatcgtaagaagcgcggccacgtgagcgccggtcatggccgtatcggcaagcaccgcaagcacccggggggtcgaggaaacgccggaggtatgcaccaccaccggatcctcttcgacaagtatcaccctgggtatttcgggaaagtgggtatgaggtacttccacaaactctgcaacaagttttactgccccatcgtcaacatcgacaagctttggtctctcgttccacaagacgtgaaggcaaaggccaacaaggattcggcgccgatgatcgacgtgacccagttcgggtactttaaggtcttgggaaaaggtgtgctgccccagaatcaaccgatggtggttaaggctaagttagtatctaagactgctgagaagaagattaaggaggctggtggggcggttgttctcactgcctaggttagggtttttgcttttggatctcttatattatcatctaggacttaattttttaaatgagattttaccataacattcttaattttgcttcaacaatatatggtatggtgtttatttacttgtgttttgctttgttgcatttgcttgatttaagttaagatgcggaaattcttgatactttactgagattattattagcttttcgtgctatctctatcgtcagaccattgcacattctgtatcaatccattcatttcccaaattggcttaaccttcctaatgcactgccatttctttttgttgtca

SEQ ID NO: 3319 - DNA, 782 bp, Cucumis sativus
aatccctcaaaccctattgtcattccatctcctccgagcagccgaaaccctagggtgtgtgtgtgtgagagagagggagagatccgccatgacgactcgtttcaagaagaacaggaagaagagaggacatgtcagtgctggacatggtagaatcggcaaacaccgaaagcatcctggtggtcggggaaacgctggaggtatgcaccaccacaggattctcttcgataagtatcatcctggttatttcggtaaagttggtatgcgttatttccacaagcttcgcaacaagttctattgcccgattgtaaacgtcgacaagatctggtcattgatccctcaagaagtgaaggataaagcctccaaagacaacgttccattggtcgatgttacgcagttcggatatttcaaggttttgggcaagggtgtcttaccggagaatcagcctattgtggtgaaggccaagcttgtgtccaagatcgccgagaagaagattaaggaggctggcggcgcggtggttcttacagcttaggtttgagtttctcttcgttatagagatttttgttcttggtgaattttcatttttgtctgtttgaacttattgaacttcttttttcttatataatttaaagctttttatgggtccatattctaatatctggtgctacgttcaagctctgttcttactcaattagtgtttaattcttagactatgcaagaggaatacatggttgattgaactattaagcgtagtgcaataagaaagtgtactaaaactttgatgg

SEQ ID NO: 3320 - DNA, 688 bp, Cucurbita pepo
atgacgactcgtttcaagaagaacaggaagaagagaggtcacgtcagcgccggtcatggtcgaatcggcaaacaccgaaagcatccaggtggtcggggtaacgccggaggtatgcaccaccatcggattctcttcgacaagtatcatcccggttatttcggtaaggtcggtatgcgttacttccacaagcttcgcaacaagttctattgcccgattgtcaacgttgacaagatctggtccttgatccctcaagaagtgaaggacaaggcttcaaaagacaatgttccattggtcgatgttacgcagttcggttatttcaaggttttaggcaagggtgtcttgccagagaatcagcctattgtggtgaaggccaagctcgtgtccaagatcgctgagaagaagattaaggaggctggtggcgcggtggttcttacagcctaggtttgagttacttttcgttataatagggatttttgttcttggtgcatttgaatgttgcctgtttgaacttattcaagatcttttttatataatttaagcttttattgaatcatatgctctcacctgatgcgatgtttaagttgttttctatatctcttttactgcttgatccttaggttaaccgaactattcaacattgtgctataagaatgcttattaaccactggtcgattagattttgatgaat

SEQ ID NO: 3321 - DNA, 691 bp, Cucurbita pepo
ttctccaccactcccagacgaaatgacgacccgcttcaagaggaacaggaagaagcgcggtcacgtgagcgccggtcatggtcgtatcggcaagcaccgtaagcatcctggtggtcgtggtaacgccggaggtatgcaccaccacagaatcctcttcgacaaataccatcctggttatttcggcaaagttggaatgaggtacttccacaagctccgaaacaaattctattgccccattgtaaacgtcgacaagctctggtctctcgtacctcaagaagtcaaggacaaggcttctaaggataacgtccctttgattgatgttactcagtttgggtatttcaaagttttgggcaaaggaggtttgcctgagaatcagcccgtcgttgtgaaagccaagctcatctccaaaattgccgagaagaagatcaaagaaaatggtggtgcggttgtccttacggcttaggtttattgggtaattgttagttatgattttgtttcaaagttagtttgatatttcttgtgccgtattcgatattggattaatgttatcaaacttcgtgcttcagtttcctttctttactgtgaactcagtcaattttgaatatgtttcttgaattgtcatgttacttgaaattcttatacatttgttaatttcggtagcttttttgggattttgctatctattattagt

SEQ ID NO: 3322 - DNA, 661 bp, Cucurbita pepo
gagagagagagagatctgccatgacgactcgattcaagaagaacaggaagaagagaggacatgtgagcgccggtcatggtagaatcggcaaacaccgaaagcatcctggaggtcggggaaacgccggaggtatgcaccaccatcggattctcttcgataagtatcaccctggttattttggtaaagttggtatgcgttacttccacaagcttcgcaacaagttctattgcccgattgtcaacgttgataagatctggtccttgatccctcaagaagtgaaggataaggcctccaaagacaacgttccattggttgatgtcacgcagttcggttatttcaaggttttgggcaagggtgtgttgccggagaatcagcctattgtggtgaaggccaagcttgtatcgaagatcgccgagaagaagattaaggaggccggtggcgcggtggttcttacagcttaggtttgagtttctcttcgttatagggattttgttcttcgtgaatttccatttttgtctgtttgaacttactggagacctttttgatataatttaagcgtttatgggttcacatacgattatctgatgcaatgttcaagcctttccatgtttgaatctttgactatgcgataggatatatggttgattgactattaaaacgt

SEQ ID NO: 3323 - DNA, 661 bp, Cynara scolymus
gcggggctgactgaactcgggtttctgccgccgtcctccaccggaattcgcttaaaaggggataatgacgaccagattgaggaagaacaggaagaagcgcggacacgtgagcgctggtcatggtcgtatcggaaagcaccgaaagcatcccggaggtcgtggtaacgccggaggaatgcatcatcaccggatcctgttcgacaagtaccatcctggttacttcggtaaagtcggtatgaggtatttccacaggctccggaacaagttccattgtcctatcgtgaacgtcgacaagctctggtcaatggtgccacaggacgttaaggagaagtcttcagccgacaaggtccccgtcgtcgatgtcactcagtttggttactttaaggtgttgggaaagggagctgtgcctctgactcagcctatggtagttaaggcgaagctcatttcgaagactgctgagaagaagatcaaggatgccggtggttgtgttgtgctcactgcttaggtttgttttcaattttcaatgccaattatgattattcctgttagttttattggcagagtactttaattttgctgaatctgaacttacattttatcaacaacattttgtttcaaaattctacaaatgtgttctacaatgtgctcatctttatggctt

SEQ ID NO: 3324 - DNA, 669 bp, Euonymus alatus
cggccgggggagctatccgtgctccacagaggccgcagacagagagcattcgccatgacgacgagattgaggaagaatcggaagaagcggggccatgtgagcgctggtcacggacgtatcggcaagcaccgtaagcacccgggaggtcgcggaaacgctggagggatgcaccaccaccgtatccttttcgacaagtaccaccctgggtacttcggcaaggtgggcatgaggtacttccacaaattgaggaacaagttctactgtcccatcgtcaatgttgacaagctctggtccatggtgccacaagaagtgaaagacaaggcaaccaaagataacgttccaattattgatgtcactcaattcggttacttcaaggtcttgggtaagggtgttttgcccgagaataagccgtttgtggtgagagcaaagcttgtgtctaagatcgcggagaagaagatcaaggagaatggtggagcggtggtgctcactgcttaggttttttgatggttttgattgtattaagaattttaagaagcagtagcatttgaatattgttattttaattccttatgattctgattttcatttttgactctgtttgctgccatggatattatcttcttcagttttattaaggtttctgatattgttatgactttctcattggga

SEQ ID NO: 3325 - DNA, 663 bp, Euonymus alatus
ctagctatccgtgctccacagaggccgcagacagagagcgttcgccatgacgacgagattgaggaagaatcggaagaagcggggccatgtgagcgctggtcacggacgtatcggcaagcaccgtaagcacccgggaggtcgcggaaacgctggagggatgcaccaccaccgtatccttttcgacaagtaccaccctgggtacttcggcaaggtgggcatgaggtacttccacaaattgagaaacaagttctactgtcccatcgtcaatgttgacaagctgtggtccatggtgccacaagaagtgaaagacaaggcaaccaaagataacgttccaattattgatgtcactcaattcggttacttcaaggtcttgggtaagggtgttttgcccgagaataagccgtttgtggtgagagcaaagcttgtgtctaagatcgcggagaagaagatcaaggagaatggtggagcggtggtgctcactgcttaggttttttgatggttttgattgtattaagaattttaagaagcattagcatttgaatattgttattttaattccttatgattctgattttcatttttgactctgtttgctgccatggatattatcttcttcagttttattaaggtttctgatattgttatgaatttctcattgggaga

SEQ ID NO: 3326 - DNA, 449 bp, Flaveria ramosissima
aaaatgacaaccagattcaggaagaatcggaagaagcgaggccacgtcagcgccggccacggccgcatcggaaaacaccggaagcaccctggcggcaggggtaacgccggaggaatgcaccaccaccgcatcctcttcgacaagtaccatccaggctacttcggtaaggtcggtatgcggtacttccacaaactccgcaacaagttctattgcccgatagtcaacgtcgacaagctctggtcaatggtgccgccggaggcgaaggagaaggcgtcggtggataacgttccggtggttgacgtcacgcagctagggttcttcaaggtgttagggaaggggatggtgccaccgtcgcaaccgctggtggttaaggcgaagcttgtgtcgaaaactgctgagaagaagattaaggaggctggtggtgctgttttgctcactgcttaggtttg

SEQ ID NO: 3327 - DNA, 774 bp, Gossypium raimondii
ctcgtctatcagccgcgcttcagaagtcccgttcaatccaagtatctaacaatgacaacccgtttcaagaagaatcgtaagaagcgcggccacgtgagcgccggtcatggccgtatcggcaagcaccgcaagcacccggggggtcgaggaaacgccggaggtatgcaccaccaccggatcctcttcgacaagtatcaccctgggtatttcgggaaagtgggtatgaggtacttccacaaactctgcaacaagttttactgccccatcgtcaacatcgacaagctttggtctctcgttccacaagacgtgaaggcaaaggccaacaaggattcggcgccgatgatcgacgtgacccagttcgggtactttaaggtcttgggaaaaggtgtgctgccccagaatcaaccgatggtggttaaggctaagttagtatctaagactgctgagaagaagattaaggaggctggtggggcggttgttctcactgcctaggttagggtttttgcttttggatctcttatattatcatctaggacttaattttttaaatgagattttaccataacattcttaattttgcttcaacaatatatggtatggtgtttatttacttgtgttttgctttgttgcatttgcttgatttaagttaagatgcggaaattcttgatactttaatgagattgctattagctgttcgtgctatctctatcgtcagtgttgaattatacatataacagatattgatgaatattatcaacttgtgttgcaatggaa

SEQ ID NO: 3328 - DNA, 681 bp, Guizotia abyssinica
acggggtccactacatcgcaggatctccgccgccgttcttaaccggctgttgctctacagctgtaggtaacaatgacgacgagcttgagaaaaaataggaagaagcgtggccacgtcagcgccggtcacggtcgtattggaaaacaccgaaagcatccaggtggccgtggtaatgccggaggcatacaccaccaccggatcctattcgacaagtattatcctggttatttcggtaaagtcggtatgcgatacttccgggggctccgtaacaagttccattgcccgacggtcaacgttgacaagctgtggtcactggtgccggaggaggcgaaggcaaaggtgggtggtgataaggttccggtgattgatgtgacgcagtttggatacttcaaggtgttggggaagggaactgtgcctccatcccatccaattgtggtgaaggcgaagcttatttcgaagacggctgagaagaagatcaaggaggctggtggtgctgtggtgctcactgcttaggtttgtttgtctgttattctgttatggttgttactgttagtttctgttttatatgcaaattactatgttttgctgaatttggattcataattgatctaagttttgttttagatacattttgctatgttctggttatcaatgatttgaacttagatgttattgatgggt

SEQ ID NO: 3329 - DNA, 785 bp, Carpinus betulus
aaaatgacgacccgcttcaagaagaaccgcaagaagcgaggccacgttagcgctggtcatggccgaatcggaaagcacaggaagcacccggggggtcgaggtaacgccggaggtatgcaccaccaccgaatcctcttcgacaagtaccaccctggctacttcggcaaggtcggcatgaggtacttccacaggctgcgcaacaagtttcactgcccaatcgtcaacgttgacaagctgtggtcgctcgttccccaggaggtgaaggacaaggcctccaaggacaacgtgccgttgctcgacgtgacccagttcggctacttcaaggtactgggcaaggggatcctgcctgagaaccagcccttcgtggtcaaggccaagctcgtgtccaagaccgctgagaagaagatcaaggaggccggcggggcagtcgttctcactgcttagtaggttattgggcatttcattttgtgggttttagttttgattaattaattaatctgaacttgtttagttgctgttggaattggatctgatatttggatatcatatattttagaaaatgctaaagtttcatcgttttcctttgaggtttgaacttctgctatgtaaaatggtttgaacatgggtttcgtataagaaatattgcgacttttaacagtttacgttataggtttgagataaaataagaccaaaatttgttttaatacaaaaaaaaagaaaaaaacaaaaaaagaaaaagaaaagaaaagaaagaataatatatactactactactatagtagtgt

SEQ ID NO: 3330 - DNA, 731 bp, Cucumis melo
agtgtgtgtgtgagagagagagagggagagatccgccatgacgactcgtttcaagaagaacaggaagaagagaggacatgtcagtgccggacatggtagaatcggcaaacaccgaaagcatcctggtggtcggggaaacgccggaggtatgcaccaccaccggattctcttcgataagtatcaccctggttatttcggtaaagtcggtatgcgttatttccacaagcttcgcaacaagttctattgcccgattgtaaacgttgacaagatctggtcattgatccctcaagaagtgaaggataaagcctccaaagacaacgttccattggtcgatgttacgcagttcggatatttcaaggttttgggcaagggtgtcttaccggagaatcagcctattgtggtgaaggccaagcttgtgtccaagatcgccgagaagaagattaaggaggctggcggcgcggtggttcttacagcttaggtttgggtttctctttgttatagagatttttgttcttggtgaattttcatttttgtctggttgaacttattgaacttcttttttcttttataatttaaagctttttatgggtccatattccattatctgatgctatgttcaagctctgttcttactcaattagtgtttgattcttagactatgcgagagaaatatatggttgattgaactattaagggtagtgcaataagaatgcctataaccactcaccttt

SEQ ID NO: 3331 - DNA, 696 bp, Orobanche aegyptiaca
tcacgatgaccactcgattcaagaagaaccgcaagaagcgcggccacgtcagcgcaggccacggtcgtatcggcaaacaccgcaagcatcccggaggtcgcggtaacgccggaggcatgcaccaccaccggatcctgttcgataagtaccatcccggttacttcgggaaggtcggtatgcgctatttccaccggctgagaaacaagttccactgcccgactgtcaacatcgataagatctggtcaatggtgccgcaggaggtgaaggacaaggcgactaaggacaacgcgccgttgatcgacgtcacgcagttcgggtactttaaggttctcggtaagggtttgctgccggcggataagccggtggtcgtgaaggcgaagcttgtgtcgaagaatgctgagaagaagattaaagaggctggtggtgctgttgttctcactgcttaagtaggttctattttgagtctaattactgttttttctttgattttatgctgttttgactgttattattactggaggattttgagttgcagtaattttgttctggttgtagttaattgagttttgcagtcatggtaacattgatctgcgaaattgcatttgctaaaagttggtctgggattgtactgtttggaaggcttaaaatcatgattttagataatgttttgaagatttgttttgcttgattgcatta

SEQ ID NO: 3332 - DNA, 782 bp, Orobanche aegyptiaca
cacgatgaccactcgattcaagaagaaccgcaagaagcgcggccacgtcagcgcaggccacggtcgtatcggcaaacaccgcaagcatcccggaggtcgcggtaacgccggtggcatgcaccaccaccgtatcctcttcgataagtatcaccccggttacttcgggaaggtcggtatgcgctatttccaccggctgaggaacaagttccactgcccgacggtcaacatcgacaagatctggtcaatggttccgcaggaggtgaaggataaggcaaccaaggacaacgcgccgttgatcgacgtcacgcagttcgggtactttaaggttctcggtaagggtttgctgccggcggataagccggtggtcgtgaaggcgaagctcgtgtcgaagaatgctgagaagaagattaaggaggctggtggtgccgttgttctcactgcttaagtaggttttatttttgagtttaattactgtttttttcttttgattttatgctgttttgactgttattattactggaggattttgagttgcagtaattttgttctggttgtagttaattgagttttgcagtcacggtaacattgatctgcgaaattgcatttgctaaaagtttgtctgggattgtactgtttggaaggcttaaaatcatgattttagataatgttttgcagatttgttttacttgattgcattagtatctaatgttcattctagaatggatttagattgatgactgccttgggttaattggtgattattcatgctgatatatgcctgt

SEQ ID NO: 3333 - DNA, 638 bp, Carica papaya
tcgcagccgcccacaaccctagcagaggagcaaccagatccaagagaagcagaaatgacaaccagattcaagaagaaccgcaagaagagaggccatgtgagcgccggccatggtcgtattgggaagcaccgcaagcaccctggaggtcgcggtaatgccggaggtatgcaccaccacaggatccttttcgacaagtaccatcctgggtacttcggtaaagttggtatgaggtatttccacaagctgcgtaacaagtaccactgccccatcgtcaacctcgacaaactctggtcgcttgtgccagaggatgtcaaagccaaggccaccaaggactccgctccattgatcgatgtcactcagtttggttacttcaaggtcttgggtaagggtgtcttgccggagaatcagcccgtcgtcgtaaaggctaagctcgtgtccaagaccgccgagaagaagattaaggaagctggtggcgccgtcgtcctaactgcctaggtttggtgtagatctttttctctcgggggaatcgagttgtttctttctagcataagttttagactctttggtttccgattttgatctcgttgaacttgttttaaaattgatatatctgtttacccggaatttaatgatgttat

SEQ ID NO: 3334 - DNA, 793 bp, Arachis hypogaea
tacgggggctctgtccgccgaacccctacattcagagtgctcgcttgagatccgaagatgacaactcgcttcaagaagaaccgcaagaagcgcggtcacgtgagcgctgggcacggtcgtatcggaaagcaccgtaagcatccaggaggtcgtggtaacgccggtggcatgcaccaccacagaatcctgtttgacaagtaccatcccggttacttcggtaaggtaggtatgcggtattttcacaagctccgcaacaagttccattgcccaatcgttaacatcgacaagctgtggtcattggtcccgcaagaggtgaaggataaggcctccaaggagaagaaggctccattgatcgatgtaactcagcacggttacttcaaggtcttgggaaaaggtgtgctccctcaggaccagcctgttgtcgtcaaggctaagcttatttccaaggtcgccgagaagaagatcaaggagaacggtggcgccgtccttctcaccgcttaggttaccttttaaacttcattttctttttcttcattcaggagttttaagttttgtgatctgttgagactctggtttctgatcgttttaattttaattaaatgctgttatggatattttccgaatcgcaatgctgtcttatattgctaaggatatatatatattttagagaagtttatttcatatgcgctgaaccgttgtttcaattagattagttaatctattaatccagtttgcgcaatggaaatggttcttcaggagtgcttggagaaatctattctaggtttgtcttttg

SEQ ID NO: 3335 - DNA, 643 bp, Physcomitrella patens
ctctttcaactttgtttattgcagagctgcgagcggcaccagcagcagcagccatgacaacccggctgaagaagaaccgcaagaagaggggccatgtgagcgccgggcacggacgtgttggaaagcatcgcaagcatccgggagggcgtggtaatgcgggaggtatgcaccaccaccggattctcttcgacaagtaccatccagggtacttcggaaaggtcggtatgcgctatttccacaagaccatgaacaagttccactgccctattgtgaatgtggacaaattgtggtcgcttgtgcccgaggctgtgaaggaaaaggccgatggggacaaatctgctcctctcttggacgtcacacaacatgggttcttcaaggtacttggcaagggggaccttccaactcaacccatggtagtgaaggcgaaattcttttctaaacttgctgagaagaagatcaaggaggccgggggagctgttgttttaaccgcttgatcttgactctgcatgcatgttgtgctgtagttttcggaaggatgcccagtatggtgtcttatgaggtgttgatgtacttaactcgacatttttgtgctgaagctgaatgtaagaacacattagaaatgaagatccattcttgcccatca

SEQ ID NO: 3336 - DNA, 610 bp, Raphanus sativus
  misc_feature (136)..(136): n is a, c, g, or t
gatctgaacgaaatggcgacggggttgaagaagaacaggaagaagagaggccacgtcagcgccggacacgggcgtatcgggaagcaccgcaagcatccaggaggtcgcggtaacgccggaggcatgcatcaccacngtatcctcttcgacaagtaccatccaggttacttcgggaaggttggtatgaggtacttccacaagctccgcaacaagttctactgccccatcgtcaacctcgacaagctctggtctctcgtcccggaggatgtgaaggcgaagtccaccaaggacaaggtgccgttgatcgatgtgacgcagcacgggttctttaaggttcttgggaaaggtcatttgcctgaggggaagccttttgttgtgaaggctaagctcatttccaagactgctgagaagaagatcaaggaggctggtggcgccgtcgtgctcactgcctagggttaggtctgttttttacgttttgctttttttaagtatcgttgttggactcagagtttgttgctttttggaatgagacgtcttttaatcaatattaatggattttataatcgtcatttcagttaaatgtggtattgattgattgatatgatatggc

SEQ ID NO: 3337 - DNA, 582 bp, Raphanus sativus
  misc_feature (168)..(168): n is a, c, g, or t
gggaaggaagccctaggcagtagatctgaatcaaaaatggcgacggcgctgaagaagaacaggaagaagagaggccacgtcagcgcggggcacggtcgtatcggaaagcaccgcaagcatcccggaggccgcggaaacgccggaggcatgcaccaccaccggatcctnttcgacaagtaccatcccggttacttcgggaaagtaggtatgaggtacttccacaagctcaggaacaagttctacagcccgatcgtcaacctcgacaggctgtggtcgctggttcccgaggatgtgaaggcgaaggcgaccaaggacaaggtgcctatgatcgacgtgacgcagcacgggttctttaaggtgctcgggaaagggcatttgcctgaggggaggccgttcgtggtgaaggccaagcttatttcgaagactgctgagaagaagatcaaagaggctggtggtgctgttgtgcttaccgcctagggttttcgattggtgtgttttaatttgctatcttttggaatcgttgttgaactcagagttggttgagcttttatggatttttttggaatcagagatcttttaacc

SEQ ID NO: 3338 - DNA, 774 bp, Raphanus sativus
  misc_feature (42)..(42): n is a, c, g, or t
  misc_feature (189)..(189): n is a, c, g, or t
  misc_feature (287)..(287): n is a, c, g, or t
  misc_feature (299)..(299): n is a, c, g, or t
  misc_feature (390)..(390): n is a, c, g, or t
  misc_feature (485)..(485): n is a, c, g, or t
acagatcggaggaaatgacgacgagattgaggaagaacaggnagaagcgtggccacgtcagcgccggacacggtcgtatcggaaaacaccgaaagcatcccggaggtcgcggtaacgccggaggaatgcaccaccacaggatcctcttcgacaagtaccatcccggttacttcggtaaagtcggtatgnggtacttccacaagctccgcaacaagttctactgcccgatcgtgaacctcgacaggctctggtcgctcgtccccgaggacgtgaaggcgaagtcgacnaaggataaggtnccgttgatcgacgtgacgcagcacgggttcttcaaggtgttggggaaaggtcatttgcctgagaacaagccttttgttgtgaaggcgaagntgatctcgaagacggctgagaagaagattaaggaagctggtggtgctgttgtgctcactgcttaggttttggggaaagttcctcttctcgctgtngttctactattggatctttaaagatgtctttgtctctaaagttgtagttttaaatctttgtcggaatttttataatggttatttacattgagatgtgcatgttttgaacatcttcgtattgctagcatttgcttcggacaaatgttagataactggttataatacttgtcttgattgggttagatttcattttagtttgcttagtaactatcgatcacccaaaatgtatagttaggatcgttaagacatttttagaagcagaagaaaacaagcgtgtcttataaataca

SEQ ID NO: 3339 - DNA, 665 bp, Rosa hybrid cultivar
ccgaaaccctaggctgaaaccctaggaagttacagagagccgcagagagagagagagagagagagcgttcgagatgacgacccgattcaagaagaaccggaagaagagaggccacgtcagcgccgggcacggccgtatcggcaagcaccgcaagcatcccggaggtcgcggaaacgccggaggcatgcaccaccaccgcatcctcttcgacaagtatcacccggggtatttcggtaaagtcggtatgaggtacttccacaagctccgcaacaagttctactgccccatcgtcaacgtcgacaagctctggtctctggtaccccaggaggccaaggacaaggccaccaaggacaacgtgcccttgatcgacgtcactcagcacggatacttcaagattctcggcaaggggaagctgccggtgaaccagcccgtcgtcgtcaaggccaagctcatctccaaggtcgctgagaagaagattaaggaagccggcggcgctgtggtgctcaccgcttaggtttgggacttttcgagttttgggaattagggattttgattttcgttgtttcgtttatgctgcgttttttgtttatctggtttagactgcctggagacagctatgttatattttcaatgttcgatcagcggatatttaaatggcttttcat

SEQ ID NO: 3340 - DNA, 617 bp, Glycine max
gtgcagccactctgtgagagaaagagatagtgtggtagagagagaggagcggaggagagaaaatgacgacgaggttcaagaagaacaggaagaagagaggccacgtcagcgccggtcacggtcgtatcgggaagcaccgcaagcatcccggtggtcggggtaacgccggtggcatgcaccaccaccgcatcctcttcgacaagtaccatcccggtttcttcggaaaggtgggtatgcgctacttccacaaactccgcaacaaattctactgccccatcgtcaacattgataagctatggtccctcctaccccaggaggccaaggacaaggccaccgccgacaaggcgccattgctcgatgtcacccagttcggttactttaaggttttgggtaaaggggttttgcctcagaaccagcctctggtcgtgaaggccaagcttgtttccaagatcgccgagaagaagatcaaggaggccggtggagccgtcgttctcaccgcctgatttttttggggtatttttatttaaaaggattttgagatctgttgttatttttggttttggttcttgttttaatctgtctgaactggattagtttaaatgtttttttttatattc

SEQ ID NO: 3341 - DNA, 1291 bp, Glycine max
cgcgagcagtggacaggcttataagtcccaaaaccctaattcgtttgtgcagccactctgtgagagaaagagatagtgtggtagagagagaggagcggaggagagaaaatgacgacgaggttcaagaagaacaggaagaagagaggccacgtcagcgccggtcacggtcgtatcgggaagcaccgcaagcatcccggtggtcggggtaacgccggtggcatgcaccaccaccgcatcctcttcgacaagtaccatcccggtttcttcggaaaggtgggtatgcgctacttccacaaactccgcaacaaattctactgccccatcgtcaacattgataagctatggtccctcctaccccaggaggccaaggacaaggccaccgccgacaaggcgccattgctcgatgtcacccagttcggttactttaaggttttgggtaaaggggttttgcctcagaaccagcctctggtcgtgaaggccaagcttgtttccaagatcgccgagaagaagatcaaggaggccggtggagccgtcgttctcaccgcctgatttttttggggtatttttatttaaaaggattttgagatctgttgttatttttggttttggttcttgttttaatctgtctgaactggattagtttaaatgtttttttttatattctcaatgttctggattatatcgttttttgttgcgtgttatggtatgcgatgggagttttacatgcacaaatcggtatttacaatactgatttggaacgaggcgactaaggttaatgttggatataattaaaaacagtgctttgttggaacgatgcttgttggcattgaaaactggcaatgcttcagcgcatggttggattttatattcattttttacggcttttttattaacccaagaatgagatttttctgtgattgcttgcgactattgggatataacaaaatggggtgaaatgaaatgtggaataaatttgcctgtttcattgttttgtgatatctttcccgtggaatggaaataataagattgacactatgtaatactagaggggaagataagcacacgggtattggatggaattcaatgaaatgtgttcaaccagatttattttgattctatcttagattagcttagcaatgtaacttaactattgtttcattttagacctttcactcaatctgagcatacccttccggtctaatttcatatgtaatcctacttaatttctttcatatttaagcatctctttgaggttcagtgaaatgctaatttcaatcagattgtggttttt

SEQ ID NO: 3342 - DNA, 730 bp, Fragaria vesca
ttctgtgagagccgccgaaccctaggaggctgaaaccctaggagagagagagagagagagcgccgcagcagcagcgatgacgacccgattcaagaagaaccgcaagaagagaggccacgtgagcgccggtcacggtcgaatcggcaagcaccgcaagcatcccggaggtcgcggaaacgccggaggcatgcaccaccaccgcatcctcttcgacaagtaccacccggggtatttcggtaaagtcggtatgaggtacttccacaagctccgcaacaagttctactgccccatcgtcaacgtcgacaagctctggtcactcgtcccccaggaggccaaggacaaggccaccaaggacaacgtccccttgatcgacgtcactcagcacggctacttcaagatcctcggcaaggggaagctcccggtgggccaccccgtcgtcgtcaaggccaagctcatctccaaggttgctgagaagaagattaaggaagccggcggcgctgtcgttctcaccgcttaggtttgggtccttctgagagaaattaggggttttgattttcgttttttcgtttatgttaatctggtttagtctgcctggagacagctatgttatattttcgattttggatcggtggatgttaaatggcttttcatatttatcggatttggttaattatctgtgttttttgttggtgtcatgatttgattgtttggtattcatagatttcgggtt

SEQ ID NO: 3343 - DNA, 790 bp, Fragaria vesca
agcttctgtgagagccgccgaaccctagaggccctaggagagattcacagagagcgatgacgacccgattcaagaagaaccgcaagaagagaggccacgtgagcgccggtcacggtcgtatcggcaagcaccgcaagcatcccggaggtcgcggaaacgccggaggcatgcaccaccaccgcatcctgttcgacaagtaccacccggggtatttcggtaaagtcggtatgaggtacttccacaagctccgcaacaagttctactgccccatcgtcaacgtcgacaagctctggtcactcgtcccccaggaggccaaggacaaggccaccaaggacaacgtccccttgatcgacgtcactcagcatggatacttcaagatcctcggcaagggcaagctcccggcgggccaccccgtcgtcgtcaaggccaagctcatctccaaggtcgctgagaagaagattaaggaagccggtggcgctgtcgttctcaccgcttaggtttgggtagtttttattcctgtttcaaagtttatgtttcgttcgtttagactgccaggagacagctatgttatatttttgattttcgatgatcagcgaatgtttaatggcttttcatatctatggtatttgcttaattatctatgttttcttattggtgtcatgatttgattttgtgtttggtattgatggattcagatgagttttgatatatcgtattgatatttgtggtgcttgttgcgtaaccctgtattgtgccttgtgtatgtgtatgaaataagggtcttgcagct

SEQ ID NO: 3344 - DNA, 789 bp, Tabernaemontana elegans
ggccgctctctcctcccgcacagagaggcaggtaagcagaaatcaaccatgacaaccaggttcaagaagaacaggaagaagagaggccacgtgagcgcaggccatggtcgtatcggtaaacaccgaaagcaccccggaggacgaggtaatgccggtggtatgcatcaccatagaatcctctttgacaaataccatcctgggtattttgggaaagttggtatgaggtacttccacaagcttcggaacaagttctactgccccatagtcaacatcgacaagctctggtcgatggtccctcaggatgtcaaagataaggcctccaaggacaacgctccagtgattgatgtcacccagttcggatgcttgaaggttttgggtaagggtgttttacctgagaatcagccggttgttgttaaggctaagcttgtttctaagactgctgagaaaaagattaaggaggctggcggtgctgttgtgctcacagcttaagtttcctgtttctatatggtctgttttactatatatgtttttggatattttagtagcctttttgagtattagtcaatgatcaaatttgagcattatgtttccattcgttggaatttattacatattgcatatcacttgatttggatgataagattggaaatgtggctgatgaatttagaatgacagtttgaaactctatcagaaacagatggggtaagaatggttgttttgacgtatgctgagtaatttgttgtaaacgtccctgtttgttatgtttatcctgggtgattttgactggtt

SEQ ID NO: 3345 - DNA, 632 bp, Triphysaria pusilla
ccgatcgccacaatgaccacccgattcaaaaagaaccgcaagaagcgcggccacgtcagcgccgggcacggtcgtatcggcaagcaccgcaagcatcccggaggtcgcggtaacgccggaggcatgcaccaccaccggatcttattcgataagtaccatcccggttacttcgggaaagtcggtatgcgctatttccacaggctgaggaacaaattccattgccccaccgtcaacatcgacactctctggtcaatggtgccgcaggaggtgaaggataaggcgactaaggataacgcgccgttgatcgatgtgacgcagtttggttacttcaaggtgcttggaaagggattgttgccggcggataagccggtggtggtgaaggcgaagctggtgtcgaggaatgccgagaagaagattaaggaggctggtggtgctgtggtgctcactgcttaattaggtttatcgatttgctgttttggtattgttatatttgctggattttgttatttgagattctctagatatatttttatgaatgttttgatgtttatcaatatgaatctgtttggatttcatctttgctattctatgtattagttacataattgatcgaatttgatttcattttcatc

SEQ ID NO: 3346 - DNA, 587 bp, Triphysaria pusilla
accccgagtaataaacgaaacccttcactctcactcgctctatataaatatctcaaaaccctaacccccatttcgttcccaatcggcgccgctctttaacccccttccccaatccattctccgatcgccacaatgacaactcgattcaagaagaaccggaagaagcgtggccacgtcagcgccggccacggtcgtatcggcaagcaccgcaagcatcccggaggtcgtggtaatgccggaggtatgcaccaccaccggatccttttcgacaagtaccatccaggttacttcggtaaggtcggtatgcgctatttccacaggcttaggaacaagttccattgccccacagtcaacatcgacactctctggtccatggtgccgcaggaggtgaaggataaggcgacaaaggataatgcgccgttgatcgatgtgacgcagttcggttacttcaaggttctcggcaagggtttgttgccggcggataagcctgtggttgtgaaggcgaagcttgtgtcgaggaatgctgagaagaagataaaggaagctggtggcgctgttgttctcactgcttaattaggttttgtttg

SEQ ID NO: 3347 - DNA, 636 bp, Juglans hindsii x Juglans regia
ggggagatcggaaatgattacccggttcaagaagaacaggaagaagcgcggacacgtgagcgccggacacggtcgtatcgggaagcacaggaagcatccgggaggccgcggaaacgctggaggcatgcaccaccatcggattctattcgataagtatcacccggggtactttggtaaggttggtatgcggtactttcacaagctccgcaacaagttctactgccccatcgtcaacgtcgacaagctctggtccctggtccctaaggatgtcaaggacaaggcgtccaaagacaaagttcccctgatcgacgtcacccagtatggcttcttcaaggtcttgggcaagggcgtgttgccggagaaccagcccgtcgtcgtcaaggccaagctcgtttcgaagattgccgagaagaaaattaaggaggccggtggtgctgtcgttctcactgcttaggtttcgctgcttttgctttttagttacatttttgttcttttttaaaattctggtctattttggaacttcttcgagccgtgattggtattattatctgtttttaatgagatttttaaatgattggatttctttatggttgttttatgttattcgcagtggtagattttatgggtttatgtctg

SEQ ID NO: 3348 - DNA, 821 bp, Citrullus lanatus
gacagaacaacacacttttctcccaactcatataatcccccaaaccctactgtcattccatcttctccgagcagccgaaaccctagagagtgtgtgagagagggagagatccgccatgacgactcgtttcaagaagaacaggaagaagagaggacacgttagcgccggccatggtagaatcggcaaacaccgaaagcatcctggtggtcggggaaacgccggaggtatgcaccaccaccggattctcttcgataagtatcaccctggttatttcggtaaagtcggtatgcgttacttccacaagcttcgcaacaagttctattgcccgattgtcaacgtcgacaagatctggtccttgatccctcaagaagtgaaggataaggcctccaaagacaacgttccattggttgatgtcacgcagttcggttatttcaaggttttgggcaagggtgtcttgccggagaatcagcctattgtggtgaaggccaagcttgtgtccaagatcgccgagaagaagattaaggaggctggcggcgcggtggttcttacagcttaggtttgagtttctcttcgttatagggatttttgttcttggcgaattttcatttttgtctgtttgaacttattggagatcttctttttttatataatttaagctttgatgggttcatatactattatctgatgggtatgttcaagctttttttcttactcaattagtgtttgatgcttagactatgcaagaggaatatatggttgattgaactattaagcgcagtgcaataagaacgcttataaccactgatctatcatattttgat

SEQ ID NO: 3349 - DNA, 872 bp, Gnetum gnemon
taacctctcctgaaccttgctagggtttctgtgaaaccctagggaggagtttttcttaaattaacagagcagaaagggagcagcggaggcggaaggcgagaaggcgcggcaatcacaatgacgacgcgtttgaagaagaacagaaagaagagagggcacgtgagcgctgggcacggccgtatcggcaagcacagaaagcatcccggaggccgcggtaacgccggaggtatgcaccatcaccgtattttgttcgacaagtaccatcctggttacttcggaaaggtcggtatgcgccattttcacaagctccgcaatcactacttttgccctaccgtcaatctggataagctctggtcgcttgtgccggaggaagtgaaagctgctgccggttcagataaggcgccgcttatcgatgtcacgcagttcgggtatttcaaggttctcggcaaaggcgaagcccctgctcagccgcttgtcgtgaaggcgaagctcgtgtctaagctcgccgagaagaagatcaaggaggccggcggtgcggtcgtgctcgccgcctgatttagatgtcgttgccagatatggaatttagtttccggtttttgttctatctgttgttgttgattagggtttagagcatgggtatgtttcagtgttttagaaagcaggatgaccttttgattcgggattcgaatatttttaacgatgatattgaggatttcaagtgcgttttatacagatccgaacggaattgctgttataatttaattgtaatgaaatttcggaaataccttctgaatttctccaggaattggttttagggcttggcatttctgcagtcatttcttttgtgagatcgatcttttggaatggacttt

SEQ ID NO: 3350 - DNA, 585 bp, Secale cereale
gcggccacgtgtccgccgggcacgggcgtgtgggcaagcaccgcaagcatcctggaggccgcggtaacgccggaggcatgcaccaccaccgcatcctcttcgacaagtaccatcccggctacttcggcaaggtcggtatgcgctacttccacaagctcagcaacaggttctacaccccgacgatcaacgtcgagaggctctggtccatggtgccggccgacaaggcggcggaggccggcggcgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgcagtcgtgctcgttgcctagggtttctgttcgcgaccgtgcctcgagatctatatctgaagtattagttgtttcccgtatctgaactatttgtgttgaacaagacatcgttagtttgttatcctggttcctgtgtggtaaaccaacatcttatgagaattttgcgctatgtcatggcagtttatatcagacgagttatcca

SEQ ID NO: 3351 - DNA, 684 bp, Tamarix hispida
ggggggcagctctctcgttcgctctcctccccacttcccggaccccagatcctgccgtcaccgccacaaaatgacgaccagattcaagaagaacagaaagaagaggggtcacgtgtccgctggtcacggtcgtatcggaaaacacagaaagcatccaggaggacgtggtaatgccggaggtctgcatcaccatcgtattctcttcgacaaataccatcctgggtactttggaaaagttggtatgcgttacttccacaaacttcgcaacaaatttttctgcccgactgttaacatcgacaagctatggtctatggttcctgaagatgttaagtccaaggcaactaaagataatgtgcctatgattgatgttactcagtttgggtattttaaggttttgggaaaaggtgttttgcctaatcaacccgttgttgtgaaagccaagttgattagtaagactgccgagaagaagattaaggagaacggcggtgctgttgtccttactgcttaacttttcattgctgttaggttaagattttcggctttataaagtattactctttaattgttttgaagatggattatgttattttgggtcaattttgtactgctatcgttggatcgtactctggtatttttttttttttattctgcggaaatgtttttttttttattgatttttgagct

SEQ ID NO: 3352 - DNA, 631 bp, Euonymus alatus
cggccggggctcgccgctcctcagctctgcctcacaaaacgagagagtagtagcagagatgacgacgagattgaggaagaacaggaagaagaggggccacgtgagtgcagggcatggacgtatcggaaagcaccggaagcatcctggagggcgcggtaacgccggaggcatgcaccatcaccgcatccttttcgataagtaccatccagggtacttcggaaaggttggaatgcgttattttcacaagctacgcaacaagttctattgccctagcatcaatgtagagaagctctggtccatggttccgcaggacgtgaaggagaaagtcaagtcctctaaggacgggaacgttccggtgattgatgtcactcagtttggctacttcaaggtcttgggtaagggtgtcctgcccgagaatcagcccatggttattaaggccaagctcatatctaaaattgccgagaagaagatcaaggagaacggcggagcggttgttctcactgcataggttgttttccgtaactttctttgttgttttgttatgattaatgacttattgttatttatggagttgtacctctcagatctacaagttttatattgtttaatcaaagatcatggtcatttggaa

SEQ ID NO: 3353 - DNA, 666 bp, Euonymus alatus
cggccggggctactcgccgctcctcaggtctgccacacaaaacgagagagtagtagcagagatgacgacgagattgaggaagaacaggaagaagaggggccacgtgagtgcagggcatggacgtattggaaagcaccggaagcatcctggagggcgcggtaacgccggaggcatgcaccatcaccggatccttttcgataagtaccatccagggtacttcggaaaggttggaatgcgttattttcacaagctacgcaacaagttctattgccctagcatcaatgtagagaagctctggtccatggttccgcaggacgtgaaggagaaagtcaagtcctctaaggacgggcacgttccggtgattgatgtcactcagtttggctacttcaaggtcttgggtaagggtgtcctgcccgagaatcagcccatggttattaaggccaagctcatatctaaaattgccgagaagaagatcaaggagaacggcggagcggttgttctcactgcataggttgttttccgcaactttctttgttgtttcgttatgattaatgagttattgttatttatggagttgtacctctcagatctacaagttttatattgtttaatcaaagatcatggtcatttcatttggaactatttgcggtgttattggcttttaat

SEQ ID NO: 3354 - DNA, 642 bp, Capsicum annuum
tttccctttccccattttgccccgctgccgccgcctacaaaatgacaaccagattcaagaagaacaggaagaagcgtggccacgtcagcgccggtcacgggcgtatcggcaaacaccgtaagcatcccggaggacgaggtaacgccggaggtatgcaccatcatcggattctcttcgacaagtaccatcctggttactttggtaaagttggtatgcgttacttccacaaattgcgtaacaaattctactgtccaactgttaacgttgacaagctatggtcacttattccacaagaagtgaaagataaggcggttgctaacaaaggcagtgctgctccgttgattgatgttactcagtttgggtattttaaggttttgggtaaaggtgttttgcctactggacaaccagttgttgtgaaggctaagttggtttccaagaatgctgagaagaaaattaaggaaaatggcggtgctgttgttcttactgcttagttttttgttaaagttaatgtttttgattagttaatggagatttgagtacttgggattttacttgtttgaaatacttttgacatgttttgatttaatgagatattgttctttaaagcacctattgaatgctacagttatgtttaaaaaaaaa

SEQ ID NO: 3355 - DNA, 662 bp, Tripterygium wilfordii
cctcagctttgccagcacagaaaagagagagtagcagggatgacgacgagattgaggaagaaccggaagaagaggggccacgtgagtgcggggcatggacgtatcgggaagcacaggaagcatcctggaggacgcggtaacgccggaggtatgcaccaccaccgaatccttttcgataagtaccatccagggtatttcggaaaggttggtatgcgatatttccacaagctacgcaacaggttctattgccctagcgtgaacatagacaagctctggtccatggttccccaggacgtcaaggagaaggtcaagtcctccaaggacggcaatgttccggtgattgatgtcacccaatttggctacttcaaggtcttgggtaagggtgtcctgcctgagaatcagcccatcgttgttaaggccaagctcatatctaaaattgccgagaaaaagatcaaggagaacggcggagcggttgttctcaccgcataggtttttctcgtaactttattgctacttggtatgttgttattatggttattgatggatttggacgtctcagatctacaagttttgtattgcttaatcgaagataatgatctcttacaactatttgtggaataattgactcttaattaggtgattgtgtgaattacttggtcttc

SEQ ID NO: 3356 - DNA, 600 bp, Cicer arietinum
accattcccatttcgccgaaccctagattcaaccacatctaaccatgaccaccagcctcaagaaaaaccgcaagaagcgcggccacgtcagcgccggccacggacgcataggcaaacaccgcaagcatcctggaggacgaggaaacgccggaggcatgcaccaccaccgcatcctcttcgacaagtaccatcccggttacttcggtaaagtaggaatgcgttacttccacaaactccgcaacaaattccactgtccaacggtgaacatcgacactctctggtctcttcttcctcaagaggtgaaggataaagcttctaaatcgaaggaaactgcaccagtgatcgatgttactcagtttggttactttaaggttttgggtaaaggtgttttgccgaagaatcagcctgttgttgttaaagctaaacttgtttccaagattgctgagaagaagattaaagaggctggtggtgctgttcttcttactgcttaggtttttttttgtcttttaagttctattttaatttaataattattaagtaatgtttgagagtttgatctatttgaactgagtaattgatagttgatatttccgaattttt

SEQ ID NO: 3357 - DNA, 1328 bp, Cicer arietinum
ctttgagtaagggcattttcgaaatttctggggcggagcatatgagcaattctgtggggttaaaacataagacaaggtatgggctcaatgccacaaaaagcccaatttatcaacaacaaaatgctgttaaaccgaaatcaccacgttaccattcccatttcgccgaaccctagattcaaccacatctaaccatgaccaccagcctcaagaaaaaccgcaagaagcgcggccacgtcagcgccggccacggacgcataggcaaacaccgcaagcatcctggaggacgaggaaacgccggaggcatgcaccaccaccgcatcctcttcgacaagtaccatcccggttacttcggtaaagtaggaatgcgttacttccacaaactccgcaacaaattccactgtccaacggtgaacatcgacactctctggtctcttcttcctcaagaggtgaaggataaagcttctaaatcgaaggaaactgcaccagtgatcgatgttactcagtttggttactttaaggttttgggtaaaggtgttttgccgaagaatcagcctgttgttgttaaagctaaacttgtttccaagattgctgagaagaagattaaagaggctggtggtgctgttcttcttactgcttaggtttttttttttgtcttttaagttctattttaattttaataattattaagtaatgtttgagagtttgatctatttgaactgagtaattgatagttgatatttccgaattttttatgttatttctcatggtgttttggattttaagttgaatggttggttttctgattttgaagtagaaatctgcttgattttttgggttttattatgaatttaatttgtatgcattttaaaaagcattttttgttctttatgtatatgtggaattatgatgtttgatatgataccaaaccaatccgttcttcatcagaaaactgaaccaaactgaatatttacaccgatagcagagatgtatgctctgatacaaattgaaaaccaaatttgatattcttacatcttacctatggggcacaatttgttcttgaaattttaattggatgtaccttatgttaaagtctccttccttgtttttccatcataagttttgcattagttatcatttatgcttttttgatgtcgaaataggttggtagaattatgacaaaatggtaattgacacaagaatccatgttgaatacaacccctgtttttgctgtccatttttgctccaaacaagctaacttgttaaaatattgatacgagcttttgtttgatgaagttttttcaatgtatttccattttcaaagttgtgtt

SEQ ID NO: 3358 - DNA, 663 bp, Elaeis guineensis
cgcgcttcaagaagaaccggaagaagcgtgggcatgtgagcgccggccatggccggatcgggaagcatcggaagcaccccggtggccgcggtaacgccggagggatgcaccaccaccggatcctcttcgacaagtaccacccagggtacttcggtaaggttggcatgcgctacttccaccgcctccgtaacaaattctactgccccaccgtcaacgtcgaccgtctctggtccctcgtacctgacgacgtcaaggaggccgccgcggccgccgccagtagctccgccccgatgatcgacgtcactcagttcgggtacttcaaggtgctcggcaaggggatgatgcccccctccttccccgttgtcgtgaaggccaagctcgtgtccaagatcgccgagaagaaaatcaaggccgccggcggcgccgtcgtgctcaccgcctaatggtcagttttgaccagatctaagtctttttaccctttttttgtctttcggaacttgtctctctttattttggtcggttgaaggagtggattttagatcagaaagctggtttttatttgaatctggacgtgttcgaacttgaatttttcatccaattgttaaggattgatacatgtttagattaatgaagcgggtaagtattgatccaaaaaaaaaaaaa

SEQ ID NO: 3359 - DNA, 595 bp, Ipomoea nil
gccgttcccttcccctttccccgtctgctcgaagctccggagatccagaaatgacgacccgctttaagaagaacaggaagaagcgcggtcacgtgagcgccgggcacggccgtatcggcaagcacaggaagcaccctggaggtcgcggtaacgccggaggcatgcaccaccaccgcatcctcttcgacaaataccatcctggttacttcgggaaggtgggtatgcgctatttccacaagctgaggaacaagttcttttgccccaccgtgaacattgacaagatctggtctctgctcccgccggaagttcaagaaaaggcggccaagaacaaggactccgcccctctgatcgacgtcacccagttcgggtactttaaggtcctgggtaagggtgtcttgccgccgtcgcagcccgtggtggtcaaggccaagctcatctccaagattgctgagaagaagatcaaggaggctggtggtgccgtcgtgctcacggcttaggtttatttctgtttgttttattttcactgatttattaatagtgactggatttttggatatttgagttttatataaattgttctgagatattactgcta

SEQ ID NO: 3360 - DNA, 831 bp, Glycine max
gatctggtggaaggaggtggcaacgcaacagggagggaaggtggtgggagagaggaggaagaaggttaaaaagaatattagagaattaggaggtgtaccaagcaagaaatggggtgagttaagtacttttcttcattggcccatatgcagtaagacgaggcccagtagcccatagccacgaacaactaactccaaaccctaactcaataaattcccccaatccccaaaccctaatcctgccgcaagcagagatgacaacccgatttaagaagaaccgcaagaagcgcggccacgtcagcgccggccacggccgtattggaaagcaccgcaagcaccccggcggccggggaaatgccggcggcatgcaccaccacaggatcctcttcgacaagtaccacccggggttcttcgggaaggtagggatgaggtactttcataagctccgcaacaaattctactcccccatcgtcaacatcgacaagctatggtctctgataccccaagacgcgaaggacaaagccctaaaatcgaaggacactgcccctctaatcgacgtcactcagcacgggtacttcaaggttctcggaaaaggtgtgctgccccaaaaccagcccattgttgtgaaggccaagcttatttcgaagatcgcggagaagaagatcaaggaagccggtggtgctgttcttcttacggcttaggttaatttttttttcccatacattcgaggttgttgtttttgttttgtgtgttttgtttcggatgacttttttatattacatattgcaagtaatacattgtgtttttttattgtttcgttgttgtcggattcag

SEQ ID NO: 3361 - DNA, 1690 bp, Glycine max
gtttccactttggggccctttctcaagtcccgaagaagttcttgcctcactgggttgcaattgggccagttccaaacacctactcattggcggcaattactcaaagcacatcatttttttttggcttggtgtaccctcaaaaatttgtaaagtcttcatcttacccttttcatctcactcgctctcttcatctctccatcttcctcttcaccacagtggcacttgtgcagatcctctcgactggaatggtggcggcttcgatcaaaccacaatgatgattttcaaggagcattatggttgcttaaacacaaattgcggtcttttaggcagaaacgtctttggactcaatagactctctatcaaagtaccacaaacaaagttgcacgctgatctggtggaaggaggtggcaacgcaacagggagggaaggtggtgggagagaggaggaagaaggttaaaaagaatattagagaattaggaggtgtaccaagcaagaaatggggtgagttaagtacttttcttcattggcccatatgcagtaagacgaggcccagtagcccatagccacgaacaactaactccaaaccctaactcaataaattcccccaatccccaaaccctaatcctgccgcaagcagagatgacaacccgatttaagaagaaccgcaagaagcgcggccacgtcagcgccggccacggccgtattggaaagcaccgcaagcaccccggcggccggggaaatgccggcggcatgcaccaccacaggatcctcttcgacaagtaccacccggggttcttcgggaaggtagggatgaggtactttcataagctccgcaacaaattctactcccccatcgtcaacatcgacaagctatggtctctgataccccaagacgcgaaggacaaagccctaaaatcgaaggacactgcccctctaatcgacgtcactcagcacgggtacttcaaggttctcggaaaaggtgtgctgccccaaaaccagcccattgttgtgaaggccaagcttatttcgaagatcgcggagaagaagatcaaggaagccggtggtgctgttcttcttacggcttaggttaatttttttttcccatacattcgaggttgttgtttttgttttgtgtgttttgtttcggatgacttttttatattacatattgcaagtaatacattgtgtttttttattgtttcgttgttgtcggattcaggttaattaaaaggtttatgcgaacaattttgcgctaatgtcctaaaaaccttgttgtgataggaaatttattggaataattgaaacgaaatttgggaggattataattatgggcaatattttgttgcgagttttgtcgattacactaactactgtgttccacgaacataacaacgagtgatggaatgacctgcaatcttgtggtgctgtgtctgaatttgtattggaagaaggttttagactggtctcagttgaattctcgcgatgctgtgatatatggattaattttgcaggtggcagaatgtagttttggcaatgatgcgatactcattagtttttcccagttgcaggttgtgttttttgcaattatgggtttctaactcagatttgaattcgagaactttgatcaaactgtaataaccttgtgctaattgatgaacgccttcgtttgttatttctcttattatttcca

SEQ ID NO: 3362 - DNA, 858 bp, Glycine max
gggcaaataagtaaaatctcgagctgtagctaggttataagtcccaaaaccctaattcgtttgtgctgccgctctctgagaaaaacagatagtgtgggagagagaagagcggaagagaaaatgacgaccaggttcaagaagaacaggaagaagagaggtcacgtcagcgccggacacggccgtatcggaaagcaccgcaagcatcccggaggtcgcggtaacgccggtggcatgcatcaccaccgtatcctcttcgacaagtaccatcctggtttcttcgggaaggtaggcatgcgctacttccacaaacttcgcaacaaattctacaatccgatcatcaacatcgacaagctgtggtccctcctcccccaggaggccaaagacaaggccaccgccgacaaggcacccttgctcgatgtcacccagttcggttactttaaggttttgggtaaaggggttttgcctcagaaccagcctcttgtcgtcaaggccaagcttatttccaagatcgctgagaagaagatcaaggaggccggtggagccgtcgttctcaccgcttgattttttagggatcttgagaaaaacttcccctatccaagtcttgctacatttgattccgtgacttgggaaggggaattgatggctagtttctccccccatggaggaagttttctccccttttcagtgatccgcacctcattttcaacctcgtgcaatcgtgcatgataacccttgggtgcattttgaggtataacatctgattctcttagccaacaaaaagaaattgatcctcagtgttccttttgtggtatatcgccggaaacaattctcaaaattgatgttcatatttcttgaaga

SEQ ID NO: 3363 - DNA, 531 bp, Ambrosia trifida
agctgcacctcaaggcttctgccgcctccattcatcaccttcttctttaaggggaaaatgacgacaagtttgagaaaaaaccgtaagaagcgtggccacgtgagtgcgggtcacggccgtataggtaaacaccgaaagcatccaggaggtagaggtaacgcaggaggtatgcaccaccatcgaatattattcgacaagtatcatcccggttttttcggtaaagtcggtatgcgatactttcacaagctgaggaataagttctattgcccaattgtgaatgtggataggctgtggtcacttgtgccacaagaggtgaaggacaaggcgactgccgataaggttccggttattgatgtgagtcagcatggctactttaaggtgttggggaaggggaatgtgcctgcttcgcacccgtttgttgttaaggcgaagctggtttcgaagacggccgagaagaagattaaggaggctggtggttctgttttgcttactgcttagtttgattgttggttatgttaggttactttgttt

SEQ ID NO: 3364 - DNA, 626 bp, Arabidopsis lyrata
aaaaacccttatagctcatttcttttcaaaaccctagatcttaatcccaaaaatggcgacggcgttgaagaagaacagaaagaagagaggacacgtcagcgccggtcatggacgtatcggaaaacatcgcaagcatcccggaggtcgtggaaacgcaggaggtatgcatcaccaccgtatcctcttcgacaagtaccatccaggttacttcggcaaagttggtatgaggtatttccacaagcttcgtaacaagttcttttgcccaatcgtgaacctcgacaagctctggtcacttgttcctgaagacgtgaaggcgaaatcgagcaaggataatgttccgttgattgatgtgacgcagcatggtttctttaaggttttggggaaaggtcatttgcctgagaacaaacctttcgttgtgaaggctaagcttatctctaagactgctgagaagaagattaaggaagctggtggtgctgttgttctcactgcttaggtttttcaattcagtctctttttaagtattattttcatgtttttgaactcagctttgttggattttggaatcagagatcttttaatctatggtattggattacataattgctttgtgttattgggaaattttg

SEQ ID NO: 3365 - DNA, 634 bp, Arabidopsis lyrata
ggaatatcctctagtctttataatctgtgcttcttcttctacagaagccctagccgcaggagggaaaaggttcgagagatcggcgaaaatgacaacgagattcaagaagaacaggaagaaaagaggtcacgtcagcgccgggcatggtcgtatcggtaagcaccgtaagcatcccggaggtcgtggtaacgccggaggtatgcatcaccacaggatcctcttcgacaagtaccatccaggttactttggtaaagttggtatgaggtatttccacaagctgaggaacaagttcttctgcccaatcgttaacctcgacaagctttggtcactcgtccctgaagatgtgaaggcgaaatcaaccaaggataatgtgccgttgatcgatgtgacgcaacatggtttcttcaaggttttggggaaaggtcatttgcctgagaacaagccgttcgttgtgaaggcgaagcttatctcgaagactgctgagaagaagattaaggaagctggtggtgctgttgtgctcactgcctaagttaggtgaatttttatttgcttgactcttttttttgaatcttctctggagttttgttatctttttgttgtcttttggatttagtttatgaacctcttgttggat

SEQ ID NO: 3366 - DNA, 632 bp, Arabidopsis thaliana
aaaaaccctttaagatcatttctggttcaaaaccctagatctgatactaaaatggcgacggcgttgaagaagaacagaaagaagagaggtcacgtcagcgccggacatggacgtatcggtaagcaccgtaagcatcccggaggtcgtggaaacgcaggaggtatgcatcaccacaggatcctcttcgacaagtaccatccaggttacttcgggaaagttggtatgaggtatttccacaagcttcgtaacaagttcttttgcccaatcgtgaacctggacaagctatggtcacttgttcctgaagacgtgaaggcgaaatcgagcaaggataatattccgttgatcgatgtgacgcagcatggtttcttcaaggttttggggaaaggtcatttgcctgagaacaaacctttcgttgtgaaggctaagcttatctctaagactgctgagaagaagattaaggaagctggtggtgctgttgttctcactgcttagttttttttttcaattcagtctctttttaatttatttcatgttattgaactcagctttgttggattttggaatcagagatcttttaatctatggtattggattatataatttgcttcgtattatttggaaattttgggatt

SEQ ID NO: 3367 - DNA, 673 bp, Arabidopsis thaliana
cttaagaaaccctagccgcaaagagagaaagggagggaggagagtgtagcagatcggcgaaaatgacaaccagattcaagaagaacaggaagaagagaggtcacgtcagcgccggacatggacgtatcggtaagcaccgtaagcatcccggaggtcgtggtaacgctggaggtatgcatcaccacaggatcctcttcgacaagtaccatccaggttacttcggtaaagttggtatgaggtatttccacaagctgaggaacaagttcttctgcccaatcgttaacctcgacaagctttggtcactcgtccctgaagatgtgaaggcgaaatcaaccaaggacaatgttccgttgatcgatgtgactcaacatggtttcttcaaggttttgggtaaaggtcatttgcctgagaacaagccgttcgttgtgaaggcgaagcttatttcgaagactgctgagaagaagattaaggaagctggtggtgctgttgtgcttactgcttaagttaggtgaatttatttgcttaactctgtttttgaatcttctatggagttttatcatcttttgttgtcttttggattttggaaagagcgagatctctttaaagttagtagttttatgaaccttttgttggattttgataaatgtttggtattccgaattcagacttataa

SEQ ID NO: 3368 - DNA, 887 bp, Aristolochia fimbriata
agagaagtcacaaaaccctaatttttcacgacacaaaagcgccaagcgcgcgaactcgcctccatcttccctgtgctcggtaccagctcggcggcgcagcggtagcagaggggggcaaagcaatgacgacgaggttcaagaagaacaggaagaagcgcggccacgtgagcgccggccacggtcgtatcggaaagcaccgtaagcaccccggaggtcgaggtaacgccggaggcatgcaccaccatcgcatcctcttcgacaagtaccaccccggttacttcgggaaagtgggtatgcgttacttccataaactacgcaacaagttctactgccccgtcgtcaacatcgatcgtctctactctctactgcccgaggacgttaaagccaaggccgattcggacaaagttcccctgatcgatctcactcagtttgggtactttaagcttcttgggaagggagttttgccgcagggtaagccagtagtagtgaaaacaaagctcgtgtccaagatcgcggagaagaagattaagcaagccggtggtgcggttatgctaactgcgtagtctgtcaccgcctgatttgagaaaaaaaaaaaaattggaaacattttctccttgtttggtgtaccagattatgacacttgcgaacgtcttagcttataatattaggatttatgttggatatatataatttttagatgtggtgagaagcatttcctctttcaattcattacattgtcgaaagcgtggatgtctatttgtcagtttttagggcccgaaatctactatagattttagctctctcatttggacatgaagcgtgttgatgcatttcttaaagatgatttaaaaaaagaacttctagttttcctatcggaagatttatct

SEQ ID NO: 3369 - DNA, 928 bp, Aristolochia fimbriata
gccagtctaatttacgtgggttggaagcagttcacttggcccagtaagtgacgtgtcacgcgcgcggagcatcactcacaaaccctaattttcacgacacaaaaggggtgagcgcgccttctatcttccccgtgctcggtaccagctccgcggcgcagcagtagcagaggggtggaaagcaatgacgacgcgattcaagaagaacaggaagaagcgcggccatgtcagcgccggccacggtcgtatcgggaagcaccggaagcatcccggaggtcggggtaacgccggaggcatgcaccaccaccgcatcctcttcgacaagtatcaccccggttactttggtaaggtgggtatgcggtacttccacaaacttcgcaacaagttctactgccccgtcgtcaacattgatcgcctctactctctccttccggacgacgttaaggccaaggccgatgccgacaaggttccgatgatcgatctcactcaatttgggtactttaagcttctggggaagggggttctgccgcagggtaagccagttgtagtcaaaacaaagctcgtgtccaagatcgcggagaagaagattaagaaagccggtggtgctgttctactaacagcgtagtgtgtctccgccagatttgcgaaatttttgttcttgaaacgttttctcttcttgtttggtgtacctgattatgacaatttgcgaatgtcttagcttataatattaggatttatgttggatacatataatttttagatgtggatgagaaacatttcctctttcaattcgtaacatattagggaccgtggatgtctttttgtctgtttttagggcctgaaacgtatttcagtcattagatggctcatttgggcatgaagcgtgttgatacatttcttaaaaatgatatgaaaaaaaacttctagcttt

SEQ ID NO: 3370 - DNA, 578 bp, Arnica chamissonis
atcaccggagttttcctttcagggtaaaatgacgaccagattgaggaagaatcgcaagaagcggggacatgttagtgccggacacggtcgtattggaaagcaccgaaagcatccaggaggtaggggtaacgccggaggaatgcaccaccaccgtatcctcttcgataagtaccatccaggttacttcggtaaagtcggtatgaggtacttccacaggctccgaaacaagttctattgtccgatagtcaacgtcgacaagctctggtcaatggtccctcaggaggcgaaggacagcgcctcagccgataaggtccctgtggttgacgtcacgcaactcggttacttcaaggtgttgggtaaggggacggtgcctctgtcgcatccgttggtggttaagacgaaacttatttcaaagacagctgagaagaagattaaggaggctggtggtgctgtattgctcactgcttaggtttgtttcgatttctgagctttctattttataattacttgcatttttaggctgaatatgagttttgattcatcctgagtttgtttttaaaagactatatctatgaagt

SEQ ID NO: 3371 - DNA, 472 bp, Brassica juncea
gaaaacctagtggatctgacaaaatggcgacggcgttgaagaagaacaggaagaagagaggccacgtcagcgccgggcacggacgtatcgggaagcaccggaagcatccaggaggtcgtggtaacgcaggaggtatgcatcaccaccgtatcctcttcgacaagtaccatccaggttacttcggaaaggtaggtatgaggtacttccacaagctccgtaacaagttcttctgccccatcgtcaacctcgacaagctctggtctctcgtccctgaggatgtgaaggcgaaggcgactaaggataatgttccggtgatcgatgtgacgcagcatgggttctttaaggttcttgggaaaggtcatttgcctgagaacaagcctttcgttgtgaaggctaagctcatttccaagactgctgagaagaagattaaggaggctggtggtgctgtcgtgctcactgcctaggttaggtc

SEQ ID NO: 3372 - DNA, 803 bp, Brassica rapa
aaaccaaacatccgaggaagaacctagtagcagatctaacgaaatggcgacggcgttgaagaagaacaggaagaagagaggccacgtcagcgccggtcacggacgtatcgggaagcaccgcaagcatccaggaggtcgcggtaacgcgggagttatgcatcaccaccgtatcctcttcgacaagtaccatccaggttacttcgggaaggtggggatgaggtacttccacaagctccgcaacaagttctactgccccatcgtcaacctcgacaagctctggtctctcgtccccgaggatgtcaaggccaagtccaccaaagacaaggtgccgatgatcgatgtgacgcagcacggcttctttaaggttcttgggaaaggtcatttgcctgagggcaagcctttcgttgtcaaggctaagcttatctccaagactgctgagaagaagatcaaggaggctggtggcgccgtcgtcctcactgcttaagttagttcgagtttctcttttaattattgtctttttgtatcgttttttgttggactcaaagtttgttgcgttttggaatgagagatcttttaatcaatattaatggattttataataggtgttggagtttgaatgtggtattgattttgtcgaatgtttgctatagattgttcattgagttgttgagttgattggggaagactatgtgttagctcatatgcaagttttggtcttcatatagtttaaacatttcaagcccttgttctttagtgttacagtcatcatgtttagaaatgaaaaggattgtttttttgaattt

SEQ ID NO: 3373 - DNA, 888 bp, Brassica rapa
aatccttattaggcccatttaatatacaagcccagatcaaatatgaaaaacctaggtcatcactataagtgtgtgctgcttgcttcttcagaaaaccctagccgcagggggaaaatgacgacgagattcaagaagaacaggaagaagggtggccacgtcagcgccggacatggtcgtatcggaaagcacagaaagcatcccggaggtcgtggtaacgccggaggaatgcaccacctccggatcctcttcgacaagtaccatcccggttacttcggtaaagtcggtattcgatacttccacaagcttcgcaacaagttcttctgcccgatcgtcaacctcgacaggctttggtcgctcgtccccgaggacgtgaaggcgaaagcgaccaaggacaaggttcctttgatcgatgtgacgcagcacgggttcttcaaggtgttggggaaaggtcatttgcctgagaacaagccttttgtggtgaaggcgaagcttatctcgaagactgctgagaagaagattaaggaagctggtggtgctgttgttcttacagcttaggttttgttataacttgtcttgttttggatcttgagttttggaacttatgttggattttataaatggttgttttgacatttgggttgaggattgtgattcagctattaatcgttcatgctctggaataattagtgaattatcgctaggttgaggttaaaagagtcgattactttgacaccacggtactcgaagataataagaagcttagcgagtagcttgtaatgcacgccagttattggctttaagactagtagctgttacaagacacaagtcaaacattttctcactaatgttttgttgcctcgtgatgcatttcttcagaaatttatcgac

SEQ ID NO: 3374 - DNA, 475 bp, Fagus grandifolia
gggagagaaaatgactacccgcttcaagaagaaccggaagaagcgcggccacgtgagcgcaggccatggtcgtatcggcaagcaccgcaagcatcctggtggtcgtggaaacgctggaggtatgcaccaccatcgcattctcttcgacaagtaccatcctggtttcttcggtaaagtcggtatgaggtatttccacaagctccgcaacaagttccattgccccatcgtcaacctcgacaagctctggtctctcgtaccccagcaagtcaaggacaaggcttccaacgacaacgctccattgattgatgttacccagttcggttacttcaaggttcttggcaagggtgtcttgccccagaaccaacccattgttgttaaggccaagctcgtttccaagaccgctgagaagaagatcaaggaggctggtggctctgtcgttctcactgcttaggtttggtttaatgggtttttttta

SEQ ID NO: 3375 - DNA, 764 bp, Vaccinium corymbosum
aaatgacaacccgcttcaagaagaacaggaagaagcgcggccacgtctccgccgggcacggccgtatcggcaagcaccgcaagcatcccggaggccgcggtaacgccggaggtatgcaccaccacaggatcctcttcgacaagtaccatccgggttatttcggtaaggtcggcatgcgatacttccacaagctacgcaacaagttctactgccccatcgtcaacgtcgacaagctctggtcactcgtcccacaggaggtcaaggacaaggccacaccccataacctacccatgattgatgtgacccagtttgggtactttaaggttttgggtaagggtgtgttgcctgcgtcgcatccggttgtggtgaaggctaagctggtgtcaaagaatgctgagaagaagattaaggaagctggtggggccgtcgtgcttaccgcttaggtctggtttttgtttttgtttctattacatgttctggtcgatttatcgattagggtttttaattgcgagtgttttgtgttatgttgaatttctgagtaatgacattttgggtttcaataggtatgaacttaatttactttgtcttggatctgttgtttgtggctattttgatgggaaattgctatgagaattactagcaattgataagtaatgcttacgatgtgatgctaatttctttacgtagtccatatatatattcatagactatttactgggtaagtgtcctaaattagaatgttgattggtgcacattcaattagg

SEQ ID NO: 3376 - DNA, 1183 bp, Cannabis sativa
ctttgacaacgttttgaaagatagcattaaacaatgggccacagtatggtccaatcattcatgccgaaagcaaaagcccagcccacaacgagcccaacattttccctataaagttgaaaaaccctaatttccccatcctttgccgcatagggtttggttgcaggagggttcgaaaatcttgaggagaggagaagatgactacccgattcaagaagaaccgtaagaagagaggccacgtcagtgccgggcatggacgagtgggtaagcacaggaagcatcccggaggaagaggtaacgccggaggtatgcaccaccacaggatcttgttcgacaagtaccatcctgggtactttggaaaggtcggaatgaggtacttccacaagctcaggaacaagttctattgccccattgtcaacatcgacaagctctggtccatggttcctcaagagatcaaggacaagtccaccaaggacaacgttcctttgatcgatgtatcgcagtttgggtatttcaaggtcttgggtaaaggtaccctcccagaggataagcccttcgttgttaaggccaagctcatttctaagatcgcagagaagaagatcaagcaggctggtggcgctgtcgttttgacggcttaggttgtcgttttgattgccctttcccttcgtcttctttttaatgtttttaattttgctattttgagctttagtatttttacattgaattagtttaaatttgaaccttttttgtcacatttggacccgttattgataacatatttaatgggaaatgttatagatttgatacttttatgggtttgttttttcttattgatattattttagaatcttttagaattaattatttcttaattaagtggtagaggaaggctgatgaaaagctttatctataaacatactgattgaacgtgaatctttagttgtaagaatatggtagggttttatgcttgtaacttgtaagaaatgtcttctttgtgcctatataattttggttttggttccatgtccagaagatttggaatgttcccaacttctttttcaagaaaataaaaatagaaatgtaggtattcatattcatttaggtcaaataatttaattttacgaacgagtgtagatgaggttctggtttgcgtgaaagaagctatttgttttcgtttatattagtg

SEQ ID NO: 3377 - DNA, 623 bp, Manihot esculenta
cagatccacagctctaccccaaatgaccacccgcttcaagaagaaccgcaagaagcgtggccacgtgagcgcgggccatggccgtatcggcaaacacaggaagcatcccggtggtcgcggtaatgccggaggcatgcaccaccacaggatccttttcgacaagtaccatcctgggtattttgggaaagttggtatgcgttacttccataagctacgcaacaagttctactgccccatcgtgaacatcgacaagctctggtcaatgattcctcaggaggcgaaggacaagtcttctaaggataatgtgcccttggtagatgttacccagtttggatattttaaagttctaggaaaaggggctttgcctgagaatcagccgatagtggtgaaggctaagctagtttcgaagattgctgagaagaagatcaaggaggctggtggagctgtcgtccttactgcctaggttaggcttttgcaattttttgatataatgatgttttggaattgtgtgagaggttacttttgttattatgtctggagatttagagattaacaatgggatgacttaatagcctttatgattttaatttttcttcgatgatatatctatttggattttgctt

SEQ ID NO: 3378 - DNA, 577 bp, Centaurea maculosa
cccagggtttctgccgccgtccaccggagtttgcttaagagggtaaaatgactaccagattgaggaagaacaggaagaagagaggacacgtgtccgccggtcatggacgtatcggaaagcaccgaaagcatcctggaggtcgtggtaacgccggaggtatgcaccaccaccggatccttttcgacaagtaccatcccggttacttcggtaaggtcggtatgaggtacttccacaggctcagaaacaagttccattgccctatcgtgaacgtcgacaagctctggtcgatggtgccacaagacgtgaaggagaagtcgtcggccgacaaggttccggtggtcgacgtgactcagcttggctacttcaaggtgttgggaaagggtgctgtgcctttgacgcatccgatggtggttaaggccaagctcatttcgaagaccgctgagaagaagatcaaggaagccggtggctgtgttgtgcttactgcttaggtttgttttcagttttcaattgccaattatgattattcctgttagttgttatgttggcagagtactttgattttgatggatttgaactt

SEQ ID NO: 3379 - DNA, 628 bp, Cirsium arvense
cccagggtttctgccgccgtccaccggagtttgcttaagagggtaaaatgactaccagattgaggaagaacaggaagaagagaggacacgtgtccgccggtcatggacgtattggaaagcaccgaaagcatcccggaggtcgtggtaacgccggaggtatgcaccaccatcggatcctctttgacaagtaccatcccggttacttcggtaaggtcggtatgaggtacttccacaggctcaggaacaagttccattgccctatcgtgaacgtcgacaagctctggtcgatggtgccacaggacgtgaaggagaagtcgtcggccgacaaggttccagtggtcgacgtgactcagcttggctacttcaaggtgttgggaaagggagccgtgcctctgacgcatcctatggtggttaaggccaagctcatttcgaagaccgctgagaagaagatcaaggaagccggtggctgtgttgtgcttactgcttaggtttgttttcagttttcaattgccaattatgattattcctgttagttgttctgttggcagactactttgattttgatggatttgaacttaaattttaaaacaacttttttgtttcagaaatctaaaagtatgttctataa

SEQ ID NO: 3380 - DNA, 544 bp, Cirsium arvense
agactgaatcccagggtttctgccgccgtccgccggagtttgcttaagagggtaaaatgactaccagattgaggaagaacaggaagaagagaggacacgtgtctgccggtcatggacgtatcggaaagcaccgaaagcatcccggaggtcgtggtaacgctggaggtatgcaccaccaccggatcctcttcgacaagtaccatcccggttacttcggtaaggtcggtatgaggtacttccacaggctcaggaacaagttccattgccctatcgtgaatgtcgacaagctctggtcgatggtgccacaggacgtgaaggagaagtcgtcggccgacaaggttccggtggtcgacgtgactcagcttggctacttcaaggtgttgggaaagggagctgtgcctttgacgcatccgatggtggttaaggccaagctcatttcgaagaccgctgagaagaagatcaaggaagctggtggctgtgttgtgcttactgcttaggtttgttttcagttttcaattgccaattatgattattcctgttagtt

SEQ ID NO: 3381 - DNA, 578 bp, Flaveria ramosissima
cgcacaaaccctttatgcattttatatggagctagggttaccattttcctctagcagagttactcaaccctaacaccgctcatcgccgtcgtcatccgccaccggatttctcctctcagggcaaaatgacaaccagattccgaaaaaaccgtaagaagcggggccacgtcagcgccggccacggtcgcatcggaaaacaccgtaaacaccccggcggcagaggtaacgccggaggaatgcaccaccaccggatcctcttcgataagtatcatccaggctacttcggtaaagtcggtatgcggtacttccacaggctccgaaacaagttctattgccctatagtcaacgtcgacaagctctggtcaatggtgccgccggaggcgaaggagaaggcgacggtggataacgttccggtggttgacgtcacgcagctagggttcttcaaggtgttggggaagggaatggtgcctccgtcgcaaccgctggtggttaaagcgaagcttgtgtcgaaaactgctgagaagaagattaaggaagctggtggtgctgttttgctcactgcttaggtttgtatttct

SEQ ID NO: 3382 - DNA, 955 bp, Vitis vinifera
cgaaaccttaaagcccattaattcaccaggagatcatcaaaacctagagcgcaaaacagctataaatcccgcaaaccctaaccctactgccgccgcgagagggagagagcagagacatgactacccgtttcaagaagcaccgaaagaagcgcggccacgtcagcgccggccacggacgtatcggcaagcaccggaaacatcctggcggtcgcggtaacgccggaggcatgcaccaccaccgtatcctcttcgacaagtaccatccagggtacttcggaaaggttggtatgcgttacttccacaagcttcgcaacaagtttttctgccccatcgtcaacgtcgacaagctctggtccctaattcctcaagaagtcaaggccaaagcctcacccgaaaatgcaccaatgatcgatgtcacccagttcggttatgtcaaggttttaggcaagggattcttgccagagtcgcagccgattgtggtcaaggccaagctcatttctaaggtcgccgagaagaagattaaggaggctggtggtgccgtggtcctcaccgcctaggtttggctacattccatagtttataattttagaaattagggtttttgaaatttgaatgatttcatatctgaacaggttggcatttctgttgaatctgtatgcagagactttctgttaatgtccttttttgttttttttttttgtttttgcgttggatacaatattaaatcttgattatggtattgtggtttcagtggcttaagatatggaaaatgaactaatgatattgcaagtagtagtcgatcttgccctaatgttaaaaatgatgcttttttagttgatctgagaatatcttgactggaatttagggctaattaacaataattttcatctattgaaattatagatgatggatttggttcaatgtggactattcttttggaaattgaatttgcgtt

SEQ ID NO: 3383 - DNA, 631 bp, Actinidia deliciosa
gagagagagagagagagcagccatgacgacaaggttcaggaagaacagaaagaagaggggccacgtgagcgccggccacggacgcatcggcaagcaccggaagcacccgggaggccgcggaaacgccggagggatgcaccaccaccgcatcctcttcgacaagtaccatcccggctacttcggcaaggtcggcatgaggtacttccacaagctccgcaacaagttctattgccccatagtcaacgtcgacaagctctggtccctcgttcctcaggaggtcaaggataaagcttccccttccagtgccccagtgatcgacgtcactcagttcgggtacttcaaggtcctcggcaagggcgtgattcccagcgctcagcctatcgtcgtcaaggccaagctcgtctccaagaccgccgagaagaagatcaaggaggccggtggtgctgtggttctcaccgcttaggtttgctttgttttctctgttatgatttagttttaaattttgctatatattgggagcactctgtacccgatctatttggttttcatgatatacttttggttgagatgtttacttttaaatgattggaatgtttttggctatgcaatgtatttgggtatcttctttcta

SEQ ID NO: 3384 - DNA, 780 bp, Citrus sinensis
gaccatataaatccccgatcccccatctcatcatcgtactgctctccgccacctcaacactgacctcgcgacctctttaagatctgccgaaatgacgacccgcttcaagaagaacaggaagaagagaggccacgtcagcgccggtcatggccgtattgggaaacacagaaagcatcctggaggtcgcggtaacgccggaggcatgcaccaccacagaatccttttcgacaagtaccatcctggtttttttggtaaagtcggtatgaggtacttccacaaactccgcaacaaattccactgccccatcgtcaacatcgacaagctctggtccatggtcccacaagatgtgaaagcaaaggccagcaaggacaatgttccgatgattgatgtcactcagttcggctactttaaggttttgggcaaaggtgttttgccggagaaccagcccgtcgttgtcaaggccaagctcgtttctaagaccgctgagaagaagatcaaagaggctggtggcgctgttgtgctcacagcttagggttattttggtaactctcccttgtctagggattttgttttattctgggatctgttgagacttatttaaatcacaatgtttttatctttttttttgggtatatctctcgcttaatgattaaatgtgacctgaatctcattttatttgacttcttggtgcatttaagcagttttttatagtccctgatctagattttattctagatgttgtgttgctcttcctgattgagaatatgagcctgtttgcct

SEQ ID NO: 3385 - DNA, 458 bp, Orobanche aegyptiaca
tccgaccaccaatcaatcacaatgacgacccgattcaagaagaaccgcaagaagcgcggccacgtcagcgccggccacggtcgtatcggcaaacaccgcaagcatcccggtggtcgcggtaacgccggaggcatgcaccaccaccgtatcctcttcgataagtatcaccccggttacttcgggaaggtcggtatgcgctacttccacaggctgaggaacaagttccactgcccgacggtcaacatcgacaagatctggtcaatggtgccgcaggaggtgaaggacaaggcgactaaggacaacgcgccgttgatcgacgtgacgcagttcgggtactttaaggttctcggtaagggtttgttgccggccgataagccggtcgtcgtgaaggcgaagctcgtgtcgaagaatgccgagaagaagattaaggaggccggcggcgccgttgttctcactgc

SEQ ID NO: 3386 - DNA, 679 bp, Arachis hypogaea
atctctgtccgccgagccctgcgttcacttcacattcgattgaaaatgacaacccgcttgaagaagaatcgcaagaagcgcggtcacgtgagcgctgggcacggtcgtatcggaaagcaccgcaagcatcctggaggtcgtggtaacgccggtggcatgcaccaccaccgaatcctatttgacaaataccatcccggatacttcggtaaggtaggtatgcgctacttcaacaagcatcgcaacaagttttactgtccaaccgtcaacattgaccaactctggtcactcgtcccgcaagaggtgaaggataaggcttcccaggagaagaaggctccgttgatcgatgtcacgcagaacggttacttcaaggtcttgggaaaaggtgtgctccctcacaaccagcctgttgtcgtcaaggctaagcttatttccaagctcgctgagaagaagatcaaggacaatggcggcgccgtccttctcaccgcataagtttctttttaatattttttttcgttttcttgtgatctgttcgttctttttatctgggatctgttttgagactgttacactgatttctttgatttagatgttagttttaattttacttactgttatggatattttttagaatgcacacaggaaaacctgcttggttcaattcaatataattttagttacc

SEQ ID NO: 3387 - DNA, 752 bp, Arachis hypogaea
gggggggctagctctgtccgccgaaccctacgttcacttcacattcacagggagtgctcgattgaaaatgacaacccgcttgaagaagaatcgcaagaagcgcggtcacgtgagcgctgggcacggtcgtatcggaaagcaccgcaagcatcctggaggtcgtggtaacgccggtggcatgcaccaccaccgaatcctatttgacaagtaccatcccggatacttcggtaaggtaggtatgcgctacttcaacaagcatcgcaacaagttttattgtccaaccgtgaacattgatcaactctggtccctggtcccgcaagaggtgaaggataaggcttccgaggagaagaaggctccgttgatcgatgtcacgcagaacggttacttcaaggtcttgggaaaaggtgtactccctcagaatcagcctgttgtcgtgaaggctaagcttatttccaagctcgctgagaagaagatcaaggagaatggcggcgccgtccttctcaccgcataagtttcttttaatttttttttcgttttcttgtgatctgtccgttcttgttatctgggatctgttttgagactgttacactgatttcttcgatttagctgttagttttaattttaattacttttatggatattttttagaatgcacacaggaaaacctgcttggttcaattcaatataattttagttaccttttcgaaggggtttctccttaattacacaatacataaacactttgcatctaa

SEQ ID NO: 3388 - DNA, 680 bp, Prunus persica
ccagcttcagtcaatcttctgtgagccgccgaaaccctaggtgagcgagagagaggcgcagagagagagagagagaaatgacgacccgattcaagaagaaccgcaagaagagaggccacgtcagcgccgggcatggtcgtatcggcaagcaccgcaagcatcctggaggtcgcggtaacgccggaggcatgcaccaccaccgcatcctcttcgacaagtaccatccggggtattttggtaaagttggtatgcgctacttccacaagctccgcaacaagttctactgccccatcgtcaacgtcgacaagctctggtctctcctcccccaggaggccaaggataaggccaccaaggacagcgcgccgttgatcgacgtcacccagtacggcttcttcaaggtcttgggaaagggcgctttgccgcagaaccagcccgttgtggtcaaggccaagctcatctccaagacagctgagaagaagatcaaggaagctggtggtgctgttgtgctcacagcttaggtttgggttgattttggatttttgtccgttagggttttggattcagttgctgtttttttgcttttaaattctggtttagactcttgggctacatttatgttatattttgaaagtttatctagcggatatttaattaatgcttgttttcagatgaatgggctt

SEQ ID NO: 3389 - DNA, 818 bp, Glycine max
gtgctgccgctctctgagaaaaacagatagtgtgggagagagaagagcggaagagaaaatgacgaccaggttcaagaagaacaggaagaagagaggtcacgtcagcgccggacacggccgtatcggaaagcaccgcaagcatcccggaggtcgcggtaacgccggtggcatgcatcaccaccgtatcctcttcgacaagtaccatcctggtttcttcgggaaggtaggcatgcgctacttccacaaacttcgcaacaaattctacaatccgatcatcaacatcgacaagctgtggtccctcctcccccaggaggccaaagacaaggccaccgccgacaaggcacccttgctcgatgtcacccagttcggttactttaaggttttgggtaaaggggttttgcctcagaaccagcctcttgtcgtcaaggccaagcttatttccaagatcgctgagaagaagatcaaggaggccggtggagccgtcgttctcaccgcttgattttttagggtatttttatttttaaaggattttaagatctgttgttatttttggttcttgatttaatctctctgaactgtattagtttaaatggttttttatattctcagtgttctggattctatcgtttttgttgcgtgttatgttatgtgatgggagttttacatgcactaattgaaacctattccctatgcatctctgttagtcggtagtgttgccattctagtgctaatttcaatcagattaagcatctcttcgaggttcggtgtatgctgatttcaatcagattgtgtttgttaaaactggttacttttccttg

SEQ ID NO: 3390 - DNA, 1021 bp, Glycine max
gggcaaataagtaaaatctcgagctgtagctaggttataagtcccaaaaccctaattcgtttgtgctgccgctctctgagaaaaacagatagtgtgggagagagaagagcggaagagaaaatgacgaccaggttcaagaagaacaggaagaagagaggtcacgtcagcgccggacacggccgtatcggaaagcaccgcaagcatcccggaggtcgcggtaacgccggtggcatgcatcaccaccgtatcctcttcgacaagtaccatcctggtttcttcgggaaggtaggcatgcgctacttccacaaacttcgcaacaaattctacaatccgatcatcaacatcgacaagctgtggtccctcctcccccaggaggccaaagacaaggccaccgccgacaaggcacccttgctcgatgtcacccagttcggttactttaaggttttgggtaaaggggttttgcctcagaaccagcctcttgtcgtcaaggccaagcttatttccaagatcgctgagaagaagatcaaggaggccggtggagccgtcgttctcaccgcttgattttttagggtatttttatttttaaaggattttaagatctgttgttatttttggttcttgatttaatctctctgaactgtattagtttaaatggttttttatattctcagtgttctggattctatcgtttttgttgcgtgttatgttatgtgatgggagttttacatgcactaattgaaacctattccctatgcatctctgttagtcggtagtgttgccattctagtgctaatttcaatcagattaagcatctcttcgaggttcggtgtatgctgatttcaatcagattgtgtttgttaaaactggttacttttccttgatgaaattgtgaaaatagttagacgataaattcagaaattatctttgggagcatccatgggtgtcatgtgaaactttcgggtgcagctttttaattagtattggcgaatcggatgtagtgaaagtcttaattggttccctg

SEQ ID NO: 3391 - DNA, 636 bp, Helianthus annuus
ttctgccgctcttcttcaccggcttttcatctacaggagaaaatgacgaccagattgaggaagaacaggaagaagcgtggtcacgtaagcgccggacatggtcgtatcggaaagcaccgtaagcatcctggaggtcgtggtaacgctggaggtatgcaccaccaccggatccttttcgacaagtaccatcccggtttctttggtaaagtcggtatgaggtacttccacaggctccgcaacaagttccattgtcctattgtcaacgtcgacaagatctggtcaatggtgccacaagacgtgaaggataagtcatccacagacaaggttccggttattgacgtcacacagttcggttacttcaaggtgttgggaaaggggactgttcctgcatctcagccgattgttgtcaaggcgaagttgatctcaaagacagccgagaagaagattaaggaagccggtggtgctgttgtgctcacagcttaggtctgttgttttcacttcatttgcagactactctgttttgctgaatttggattcagtttagatttaagttgtgtttttgaatacttatatttgtgttctactttgctgagattttttttattaatggtatgaacttacatgtcattactatcc

SEQ ID NO: 3392 - DNA, 665 bp, Eutrema halophilum
atcagctcgtctttataaatctgtgctgctttctccagaagccctagccgcaaggaagaaaggggatcgcagatcggcgaaaatgacgaccagattcaagaagaacaggaagaagagaggacacgtcagcgccgggcacggtcgtatcggaaagcaccgtaagcatcccggaggtcgtggtaacgccggaggtatgcaccaccacaggatcctcttcgacaagtaccatccaggttactttggtaaagtcggtatgaggtatttccacaagcttcgtaacaagttcttctgcccaatcgtgaacctggacaagctatggtcgctcgtgcctgaggacgtgaaggcgaaatcgacaaaggacaacgttccgttgattgatgtgacgcagcacgggttcttcaaggtgttgggtaaaggtcatttgcctgagaacaagccgttcgttgtgaaggcgaagcttatctcgaagactgctgagaagaagatcaaggaggctggtggtgccgttgtgctcacagcttaggttttcaaattttaccttccctttttgtttttttttggcctttgaatcttccctaaactttatctagttttatgaaccttgttggattttatattcggaatttcagatgtggtatgttattgggattttgaaatgtttccgc

SEQ ID NO: 3393 - DNA, 653 bp, Eutrema halophilum
aaaaaaccctagatctctgagagaaaatggcgacggcgttgaagaagaacaggaagaagagaggacacgtcagcgccggtcatggtcgtatcggaaagcatcgcaagcatcccggaggtcgtggtaacgccggaggaatgcatcaccaccgtatcctcttcgacaagtaccatccaggttacttcggtaaagtcggtatgaggtatttccacaagctccgcaacaagttcttctgcccaatcgtcaacctcgacaagctctggtctctcgttcccgaggatgtgaaggcgaaatccaccaaggacaatgttcctttgatcgatgtgacgcagcacggtttcttcaaggtcttgggtaaaggtcatttgcctgagaacaagccgttcgttgtgaaggctaagctcatttctaagaccgccgaaaagaagatcaaggaggctggtggtgccgtcgtgctcactgcctagtttaggtcgatttttccgttttcgttttaaattatcttcttcgttttgttggaacccgttgttgaactcagtttgttctgcttttggattcttgatgagagatatcttaatcaatattactggattatataattatcattttatagttgaggtttggtgttggtattgggatttctcgaatgcttg

SEQ ID NO: 3394 - DNA, 677 bp, Eutrema parvulum
tacctgtcctctttataaatttgttatgctttcttcagaaaccctagccgcaagagaaaagaaaaggtcaagagagagggaggttgcagatcggcgaaaatgactaccagattcaagaaaaacaggaagaagcgtggtcatgttagcgccggacacggtcgtatcggtaagcaccgcaagcatcccggaggtcgtggtaacgccggaggtatgcaccaccacaggatcctcttcgacaagtaccatcctggttacttcggtaaagtcggtatgaggtactttcacaagcttcgcaacaagtttttctgcccaatcgtcaacctcgacaggctatggtcgctcgtccctgaggatgtgaaggcgaaatccacaaaggacaacgttccgatgatcgacgtgacgcaacacggtttcttcaaggtcttgggtaaaggtcatttgcctgagaacaaacctttcgttgtgaaggcgaaactcatctcgaagactgcagagaagaagatcaaggaagctggtggtgctgttgtgctcacagcttaggtttatcacaattttcctttacttatttgcgttttttatttttgaatcttcactaaaacttatcctgttttggatcttaaaagagaggtctttctctaaagtagtagttttatgcaccttgttggattttataaatg

SEQ ID NO: 3395 - DNA, 712 bp, Eutrema parvulum
agccgtttggttccctatataaacaaaacctttctctagcttctcagaaaaaacctagatctgagaaaatggcgacggcgttgaagaagaacaggaagaagagaggtcacgtcagcgccggtcatggccgtatcgggaagcatcgcaagcatcccggaggccgtggtaatgctggtggtatgcatcaccaccgtatccttttcgacaagtaccatccaggttacttcggaaaggtcggtatgagatacttccacaagctccgtaacaagttcttctgccccatcgtcaacctcgacaggctctggtctctcgtccccgaggatgtcaaggcgaaatccaccaaggacaccgttccgatgatcgatgtgactcagcacggtttcttcaaggttctgggtaaaggtcatttgcctgagaacaagcctttcgttgtgaaggccaagctcatttctaagaccgccgagaagaagatcaaggaggctggtggtgccgtcgtgctcactgcctaggttaggtcgattttcgtttccttttaattattatcttcgaaatcgttgttgaactcaagtttgttgtttttttgggattttggaatgagagctttttatcaatataattgttattttggagctccatgttttgctatttgatattgtgattgtcgtatttgtgctatagattcctcactggtcattgtgctgttggtttgatt

SEQ ID NO: 3396 - DNA, 623 bp, Triphysaria pusilla
cgcagcactccaaaccaaactccgatcgccacaatgacgactcgattcaagaagaaccgcaagaagagaggccatgtcagcgccggtcacggtcgtatcggaaagcaccgcaagcatcccggaggtcgtggtaacgccggaggtatgcatcaccaccggatcttgttcgacaagtaccatccaggttacttcgggaaagtcggtatgcgctacttccacaggctaaggaacaagttccactgccccaccgtcaacatcgacactctctggtccatggtgccgcaggaggtgaaggacaaggcgactaaggacaacgcgccggtgatcgatgtcacgcagttcggttacttcaaggtgctaggcaagggtttgctgccggctgataagcctgttgtggtgaaggcgaagcttgtgtcgaggaacgccgagaagaagattaaggaggctggtggcgctgtggtgctcactgcttaattaggttttttttgtcgaattttatgtttttgaaatgtatgaatggttgaatgttatattttctggatctggtttttatgaatgttttttaatcaatcaaaatgaacctgtttttgttatttgcttatagttgagtttcatcattgctg

SEQ ID NO: 3397 - DNA, 649 bp, Valeriana officinalis
aacaggaagaagagagggcacgtgagcgccggtcacggtcgtatcggaaagcacaggaagcatcctggaggtcgcggtaatgccggaggtatgcaccatcaccggatcctcttcgacaagtaccatccaggttacttcggaaaggtcggtatgaggtacttccacaagctccgcaacaaattccattgcccgatcgtcaacatcgacaagctctggtccatggtgccgcaggacgtgaaggagagcgccgccacctctggaaaagcgccgttgcttgacgtgactcagttcggatacttcaaggtcctcggtaaaggtatgttgcctttgtcgcagccgattgttgtgaaggccaagcttgtgtcaaaaactgctgagaggaagatcaaggaggctggtggtgctgttgttctcactgcttagtaggtttgttctttttcatctacttactttatatgctagaactcgagagatcactttttgttctggatatttttgtttttcgtcattgctgtaatgaagttttgtttcattttgtttctgaatttgatcttctcatttcagtctctttgttttattaatcatgcttagatctcatctaaccatttaggcatttagcaatacatagaaacgattggactgtcgttgt

SEQ ID NO: 3398 - DNA, 586 bp, Raphanus sativus
agggcctctagtagatctgaagaaatggcgacggggttgaagaagaacaggaagaagagaggccacgtcagcgccggtcacggacgtatcgggaagcaccgcaagcatcccggaggtcgcggtaacgcgggaggtatgctcaccaccgcatcctcttcgacaagtaccatcccggttacttcgggaaggtcggtatgaggtacttccacaagctacgcaacaagttctactgccccatcgtcaacctcgacaagctctggtcgctagtccccgaggacgtgaaggcgaaggcgagcaaggataaggtgccgatgatcgatgtgacgcagcacgggttcttcaaggttttgggcaaaggtcatttgcctgagaacaggccttttgttgtgaaggcgaagcttatttcgaagactgctgagaagaagattaaggaggctggtggggctgtcgtgcttacagcctaatggggttaggtcgagtttcgttttggtttttgtttgttatgtcttctttgttgttgaactcatcgctttttggatattttggaatgagacatcttttaattaatattaatggattatataat

SEQ ID NO: 3399 - DNA, 609 bp, Picea glauca
taaaaccccagaaacgctcgagggaaaccctattgaaggaggcagggcctgaggggaaggagaaggcaaggcaggacagagcagaggttggcaggatgacgaccagattgaagaagaacaggaagaagagagggcacgtgagcgcaggtcatggccgtatcggcaaacacaggaagcatccgggtggtcggggtaacgctggaggtatgcaccaccaccgtattctcttcgacaagtaccatcctggctacttcggtaaggttggtatgaggcatttccacaagctcaggaatcactatcattgtcccatcgttaatattgaaaagctgtggtctctggttcccgaggatgtcaaggccaaggccaccgctgacagtgtcccgctcatagacgttacccagttcgggtattttaaggtcttgggcaaaaggcgagctaccctcgcagcctatcgtagtcaaggccaagcttatttctaagctaggccgagaaaagatcaaggaggctggaggggcagtcatgttgactgcctgattgcagtttaccattttgagtttagtactttattcgatataggttttaacctctgcttctaggattttacatctg

SEQ ID NO: 3400 - DNA, 573 bp, Fagopyrum esculentum
cgatcacaaatctctaaaatgacgacgggtctgaagaagaacaggaagaagaggggccacgtcagtgccggtcatggtcgtatcggaaaacaccgtaagcatcctggtggacgtggaaacgccggaggtatgcaccaccacagaatcctcttcgataagtaccatcccggttacttcggtaaggtcggtatgcgctacttccacaaacttcgcaacaaattcttctgccctaagattaacatcgaccagctatggtcactcgtccccgaggatgtcaaaaccaaatccaacaaggataacgcgcctttgatcgatgttactcagtttggatactttaaggtcctcggaaagggagttttgccgaatcagcctctcgtggttaaggcgaagcttgtgagcaagatcgctgaaaagaagattaaggaaaatggtggttctgttattcttactgcttaggttttcggtttctttctttcagatattttgattatggtagtctgatggatttggttgagacatgtttggatgatttttactttggattttgataaagaaatgcatattttcctgaat

SEQ ID NO: 3401 - DNA, 667 bp, Adiantum capillus-veneris
ctgatctaaaagttcttctttttcctggttcgagaggagagaggccgccatgactaccaggttgaagaagaacaggaagaagagaggtcacgtcagtgcaggccacggaagagttggcaagcacagaaagcatcccggaggtcgcggtaatgcaggaggtatgcaccaccatcgcattctgttcgacaagtatcaccctgggtacttcgggaaggtaggtatgcgctacttccacaagacaatgaacaggttccactgtcccattgtgaatgtggatcggctcttctcgcttctgcccgactctgcgaagtctgcgccggaaggaaaggggcccttgctggatgtcactcagttcgggtacttcaaggtgctaggtaaaggcgatgctccccccactcctctggtcgttaaagccaagttcttctctaagcttgcggagaagaagatcaaagaggctggtggtgctgtccttctcactgcttgagaggtcagatctgcccttctagtaacgtttaggcggataccgaggctttttttgcttctcaatttagttgtaaaggatttttatatgaggacttgcagagatgagttttgatgtccttacgatggtgaatgtagccgactcttccttaatgcgaaggctctccattttgccctccaattgtct

SEQ ID NO: 3402 - DNA, 844 bp, Marchantia polymorpha
cgctgcggttgcgcagctgaaggattttgcttctcgtcggtgggtcgaatttgagtcgcggcgggcacgatgacgacgagactgaaaaagaacaggaagaagagaggtcacgttagtgctggacatggaagagtcggcaagcaccgaaagcatcccggaggtcgaggaaatgccggaggtatgcaccaccaccgaattttgttcgataagtggcatcctggatatttcggaaaggtcggtatgaggtacttccacaagaccatgaacaaattccactgccctatcgtgaacgtggacaagttgtggtctttggtccccgaggacatcaaggctaaagcaaacggcgactctgccgctccattgttagatgttactcaacacggctacttcaaggttcttggcaagggaggtctccccacgcaacctatggtggtcaaggcgaagtttttctccaaacttgccgaaaagaagatcaaggatgccggaggcgccgtcatcctcactgcatagattgtcctgtgaatactgtactgagattcttggtgctgagtttttgtgcggcatatttttaatgatgaaacgagaaacagagtcagaatcttctctccactcttcaaaacgatttcatttacaatggttcccctagctccgaaatcttgcttatgatgcgtttgtgtttgattgcgtccattatatcgttgttgtcttatggatgaatatataagacatgagtttttagttagtgggtactcgacgggtagagcttgtactcgtcagttttcacgaaattattgatggacggaatgcagttggttatgagatgcgtcaaatgaatcgacgttac

SEQ ID NO: 3403 - DNA, 791 bp, Marchantia polymorpha
  misc_feature (31)..(31): n is a, c, g, or t
gtagagttctctcatcccctttctctctagntcgcgatccgtgtcgagggtgtggtgtcgttgtgattttcagcagtcaagatgacgacgagactgaaaaagaatcgtaagaagagaggacatgtaagtgctggtcacggaagggttggcaagcataggaagcatcctggaggtcgtggtaatgccggaggtatgcaccaccaccgaatattgttcgacaaatggcatcctggttacttcgggaaggtcggtatgagatatttccacaagactatgaacaagttccactgccccatcgtgaacgtcgacaagttgtggtctttggtgcccgaggatgtgaaggcaaaggctaacggcgaatccgccgctccattgttggatgtaactcaacacggatacttcaaggtgctcggaaagggaggtcttcctactcagcctatggtcgtcaaggccaagtttttctcgaagctcgccgagaagaagatcaaggacgccggtggtgccgtcattttgactgcctagaaagcctggaagccagcttaactgattacaagcaggtagcagccccggagctcaaatttcagtggggttgaagatatgtagacatacaggtcaattgaaagtttgcttgttcgaggacgaattctcaatcgaggttattcgaacaggtcattaatttccatctcaccagctcacgctgctttcttgatcctctgtatgcctgctgaattaaatgaaactatatcatatggatccaaaagtagacccatttcgatcttcagtcaaaaaaa

SEQ ID NO: 3404 - DNA, 745 bp, Taxus baccata
aaatcgtcggcggaagcagaaggggaagcagaaggagaagcagaagggcaggatgacgacccgattgaagaagcacaggaagaagagaggccatgtgagtgcagggcacggtcgtattgggaagcacaggaagcatccaggaggcaggggtaacgccggaggtatgcatcaccaccgcattctcttcgacaagtatcatcctggttatttcggcaaggtcggtatgcgtcatttccacaagcttaaaaatcactatttctgccccattattaatatcgacaagctctggtcactcgtaccggaagatgtcaaggaaaaagccactcctgacaatgttcccctcctagatgttacacatcacggctattttaaggttttggggaaaggggaattacctccccagccacttgttgtcaaggccaagcttatttctaagctggccgagaaaaagatcaaggaggcaggcggcgctgttctgttgactgcttgatcagggttttgaggaaccagggtttaagctgaatttcatgctttaagaactatttaatacgctttaatagtttaggttttattgaagttcgaatcttgcatggaatgtcaatctcttttgatattttcaaagcacgatttaagattttggaaactttatttttacgaagatttgttcttaactcagatgcataacagttatttgaagtattggttcgatggtttttgactttattaaatatgattttgctctatt

SEQ ID NO: 3405 - DNA, 681 bp, Curcuma longa
gcacgaggtagaaaccctaatcggtattagggcggagccgccgtcgtcgccatgacaacccgcttcaagaagaaccggaagaagaggggccacgttagcgccggccacggacgtatcggcaagcaccggaagcatcccggtggtcgcggtaacgccggaggcatgcaccaccatcgcatcctcttcgacaagtatcacccgggttacttcgggaaggtcggtatgcgctacttccatcgcctccgcaacaagttccactgccccatcgtcaacatcgacagcctctggtccctcgtccccgaaggtgtcaaggacgaggcctccaagagcggcagcggcccaaatgctccgctcatcgacgtcacccagtttgggtacttcaaggtcctcggcaaaggggcgttgcctccgggccgccccatcgtcgtgaaggccaagcttgtgtcgaagattgctgagaagaagatcaaggcagcgggcggcgctgtcgtgctcactgcttgatcctgtcggttagtgctccatagctcgagtgctggtctaggtttcatttgaatttctggcgtttgtttggatttggatctggatctgatgaattcattgctaaattgctgtggtcgtcaagtgtttgtgtcttccattaaacgttttggtcaatttgaatgcttattattagtcaaa

SEQ ID NO: 3406 - DNA, 691 bp, Zingiber officinale
  misc_feature (14)..(14): n is a, c, g, or t
gcccggggaaaccntaatcggtattagggcggagccgccgtcgtcgccatgacaacccgcttcaagaagaaccggaagaagaggggccacgttagcgccggccacggacgtatcggcaagcaccggaagcatcccggtggtcgcggtaacgccggaggcatgcaccaccatcgcatcctcttcgacaagtatcacccgggttacttcgggaaggtcggtatgcgctacttccatcgcctccgcaacaagttccactgccccatcgtcaacatcgacagcctctggtccctcgtccccgaaggtgtcaaggacgaggcctccaagagcggcagcggcccaaatgctccgctcatcgacgtcacccagtttgggtacttcaaggtcctcggcaaaggggcgttgcctccgggccgccccatcgtcgtgaaggccaagcttgtgtcgaagattgctgagaagaagatcaaggcagcgggcggcgctgtcgtgctcactgcttgatcctgtcggttagtgctccatagctcgagtgctggtctaggtttcatttgaatttctggcgtttgtttggatttggatctggatctgatgaattcattgctaaattgctgtggtcgtcaagtttttgtgtcttccattaaacgttttggtcaatttgaatgcttattattagtcaaatatgtcctcgtgc

SEQ ID NO: 3407 - DNA, 591 bp, Trifolium pratense
  misc_feature (32)..(32): n is a, c, g, or t
  misc_feature (60)..(60): n is a, c, g, or t
  misc_feature (101)..(101): n is a, c, g, or t
gagaaggagagagagcaacaaccacaatgacnaccagattcaagaagaacaggaagaagngaggccacgtcagtgccggacacggtcgtatcggaaaacanagaaagcatcccggaggtcgtggtaacgccggaggtatgcatcaccaccgtatcctgttcgacaagtaccatccaggttacttcggtaaagttggtatgcgttacttccacaagcttcgtaacaaattctattccccaatcgtcaacatcgacaagctttggtcacttgttcctgaagatgttaaggaaaaagctgccaaatctaagagcactgcacctgtgcttgatgttactcagcatggtttcttcaaggttcttggtaagggtgttttgccgactaatcagcctcttgttgttaaggctaagttgatttctaagattgctgagaagaagattaaggaagctggtggtgctgttattcttactgcttaggtttttttttcaattttcaagttatttgtttttcctagatttgtattgttggttttgttttggttgaaatttggaaaactatatatttcaggttataacaatattatatgcttttggg

SEQ ID NO: 3408 - DNA, 768 bp, Vaccinium corymbosum
aaatgacgacccgattcaagaagaaccgtaagaagcgcggccacgtgagcgccggccacggccgcatcgggaaacaccgaaagcatcccggcggcaggggaaacgccggtggcatgcaccaccaccgcatcctcttcgacaagtaccacccggggtacttcggtaaagtcggcatgcgatacttccacaggctacgcaacaagttccactgcccaatcgtcaacgtcgacaagctctggtccttgattccacaggaggtgaaagaccaggctacccctgacaaagcgccgatcatcgacgtgacgcagttcgggtacttcaaggtgcttgggaagggcgtgttggcaaagtctggtcagccggttgttgtgaaggctaagttggtgtcgaaggctgcggagaagaagattaaggaggctggaggagctgttttgctcaccgcttaggttagaatttagatttcaatcgatttgaatgttcgaattttgttggagtattttggttttgaaatttgaagtatgttggatcttgttatgttttcgttgttagtaatatgattttgatttgtttggatctgttggttgagttcatttcgattggaaaatgctatcgatatataatcttcttgcgattagggctgcaactgaaacgagctgaggtgaggtccttttttaataggaaatgctatcggtatgttatcttctcacaatgtattgattcccaagtcacattggcagagtgagtgcaaaaagtgtcttttaagaaaat

SEQ ID NO: 3409 - DNA, 674 bp, Solanum melongena
aatctgtcactgccgcacttcccctttgcccgtttctcccatttcgccgccgacgagaaaatgacaaccagattcaagaagaacaggaagaagcgtggccacgtcagcgccggacatggtcgtatcgggaagcacaggaagcatccaggaggacgaggtaacgccggaggtatgcaccatcaccggatccttttcgataagtaccatcctggttacttcgggaaagtaggtatgcgttatttccacaagcttcgtaacaaattctactgccctactgtgaacatcgacactctatggtctctccttcctcaagaggttaaggacaaggccgctgccaataagggtactgctccgttgattgatgttacccagtttgggtacttcaaggttttgggtaaaggtgttttgcctacgggacagcctgttgttgtgaaggctaagttggtgtcgaagaacgcagagaagaagattaaggaaaatggaggtgctgttgttcttaccgcttaggtttgagattttagttgctttttgatgttaaagttactgtttttgattagttaatggagatttgaactttgggattacttgtttgaaatacttttgagatgtttcaatttaatgagttattgcctgttaaagcacctattgatataaattggcatataatttttctg

SEQ ID NO: 3410 - DNA, 580 bp, Ipomoea batatas
ctcccccagtctgctcgaagctccggagatccagaaatgacgacccgctttaagaagaaccggaagaagcgcggtcacgtgagcgccgggcacggccgtatcggcaagcacaggaagcacccaggaggccgcggaaacgccggaggcatgcaccaccaccgcatcctcttcgacaaataccacccgggctacttcgggaaggtgggtatgcgctatttccacaagctgaggaacaagttcttctgccccaccgtcaacatcgacaagatctggtctctgctcccgccggaagttcaagaaaaggcggccaagagcaaggacaccgcccctgtgatcgatgtcacccagttcgggtactttaaggttttgggtaagggtgtcttgccgccgtcgcagcccgtggtggtcaaggccaagctcatctccaagattgctgagaagaagatcaaggaggccggtggcgccgttgttctcacggcttaggtttatttctgttttgttttactgtttccctgatttattaatagtgactggattttgggatatttgagttttattatataaattgttctgagatatt

SEQ ID NO: 3411 - DNA, 885 bp, Cajanus cajan
ccagcaaaccctaatcggtaacgcggaagtgacagagagcagaagagcgatgacgacgcgattcaagaagaacaggaagaagcgcgggcacgtgagcgccggccacggccgtatcggaaaacaccgcaagcatcccggcggtcgcggaaacgccggcggcatgcaccaccaccggatcctgttcgacaagtaccatcccggttacttcgggaaggtgggtatgcggtacttccacaagctccgcaacaagttccattgccccatcgtcaacatcgacaagctctggtcgctgctgccacaggaggctaaggacaaagccctcaaatccaaggacgccgctcctttaatcgacgtgacacagcacggttacttcaaggttctcggaaaaggtgtgctcccccttaatcaacccatcgtcgtcaaggccaagctcgtttccaagatcgccgagaagaagattaaggaagccggtggcgctgttcttctcaccgcttaggtttaattacttttgcttttcgtttcatacatttgaggcgtcgttttttgttttgttttgtttcgggtacttttttacattacatgttgcagcttatattgataatatgtgtttttgcatttttagtgtcttgttttggatggatttaggttaattaattaaatatttatgcgaaaaaattaagcccgtggaaactttgttttaataagttgttatagaagaaattattggaggaaaaataaattttggggaatgatgaattatattttaatcagtccttagaggaaccattttttgttaactagtcttggcgattgtacaatgttggtgactgtgttcttcgaaagtaatgagtgacgttatgttgtgtgattgagggcgtttggttg

SEQ ID NO: 3412 - DNA, 875 bp, Cajanus cajan
ctaacctctgtcttccgccgcagcaagggctcaagacagagagagaagatgacgactcggttgaggaagaaccggaagaagaggggtcacgtgagcgccggacacggccgcatagggaagcaccggaagcaccccggagggcggggaaacgccggaggcatgcaccaccaccgcatcctcttcgacaagtaccaccccggctacttcggaaaggttggcatgcgctacttccacaagctccgcaacaagttccactgccccatcctcaacatcgacaagctctggtccctcgttccccaacacgtcaaggacagcgcctccaccgacggcagcaaaacgcccttgatcgacgtcacccagttcggctactttaaggttttggggaaaggccttttgcctcacaaccagcccctcgttgtcaaggccaagctcgtttccaagatcgccgagaagaagatcaaggaggctggtggcgccgttctcctcaccgcttgattcagatggtattattttaatcaatttagggttttttttttctcgatggacctttcacattgttgtttagtctcctatttttgagggtttaagcttattgttttagttttagtgtttcagacacgtgcttactaatggtattattgtcaaattgcgaatcagatagaatattaaaatcgactttggcttcggtttgttcgacctgtgtcatttaaaatgagattttgggcttgttccttcgattgggtaatggttttaatttcaatttctctctcaaatgtcttgtgcggaccattatcaaatgtatctaatcaaatttgaagttattagcttctttcgttgtaatgcaagttttactttttatatgaggtgaaataggg

SEQ ID NO: 3413 - DNA, 720 bp, Solanum lycopersicum
tggcaaaaattgctattgggcccaatccatcgatcttccatctataaatgtctgaaaaccctagacttaccattctctcactgccgcactttcccttttccccattttgccgccgcagccgaggagaaaatgactaccagattcaagaagaacaggaagaagcgtggtcacgtcagcgccggacatggtcgtatcggaaagcacaggaagcatccaggaggaagaggtaacgccggaggtatgcaccatcacaggatccttttcgacaagtaccatcctggttacttcggtaaagtaggtatgcgttatttccacaagcttcgtaacaaattctattgccctactgtcaacatcgacactctatggtctctccttcctcaagaggtgaaagacaaggctgctgccaataagggtactgccccgttgattgatgttacccaatttgggtatttcaaggttttgggtaaaggtgttttgcctacgggacagcctgttgttgttaaggctaagttggtctcaaagaatgcagagaagaagatcaaggaaaatggtggtgctgttgttcttaccgcctagatttgatttgagttgttagttacttttttttgtgttaaagttactgtttttggattagttaatggagatttgaacttggaattgtttgaaatactttttacaacaaattggcgtataattttttctggatccttgactttctgc

SEQ ID NO: 3414 - DNA, 457 bp, Olea europaea
catctcagccgcctcaatgacgacccgtttcaggaagaacaggaagaagcgcgggcacgtcagcgccggccacggccgaatcggaaagcaccggaagcaccccagtggccgtggaaatgccggaggtatgcaccaccaccgtatcctcttcgacaagtaccatccgggttatttcggtaaagtcgggatgcgctactttcacaagctccgcaacaagttccattgcccaattgtcaacatcgacaagctctggtccatggtacccaaggaagccaaagatgctgcatcaaaggaaaaagtgcccgtgattgatgttacgcagttcgggtacttcaaggttttgggcaagggagttctgccagaaaatcaaccggtggttgttaaggctaagctcgtgtctaaaattgctgagaagaaaattaaggaggccggtggggctgttttactcactgcttag

SEQ ID NO: 3415 - DNA, 573 bp, Arnica chamissonis
atcaccggagttttcctttcagggtaaaatgacgaccagattgaggaagaatcgcaagaagcggggacacgttagtgccggacacggtcgtatcggaaagcaccgaaagcatccaggaggtaggggtaacgccggaggaatgcaccaccaccgtatcctcttcgataagtaccatccaggttacttcggtaaagtcggtatgcggtactttcaccggctccgaaacaagttctattgtccgatagtcaacgtcgacaagctctggtcattggtcccgcaggaggcaaaggacagcgcctcagccgataaggtccctgtggttgacgtcacgcaactcggttacttcaaggtgttgggtaaggggacggtgcctctgtcgcatccgttggtggttaagacgaagcttatttcaaagacagctgagaagaagattaaggaggctggtggtgctgtattgctcacagcttaggtttgtttcaatttctgagttttcaattttataattacttgcattattaggctgaatattatttgattcatcctgagtttgttctaaaagactatatctatgaa

SEQ ID NO: 3416 - DNA, 565 bp, Fagus grandifolia
ctggaccttggctgtcactcagttgattccctcttctctcagcggccgaaaaccctagccactcacagaggtaaaaaaatgacgacccggttcaagaagaacaggaagaagaggggtcacgtgagtgccggacatgggcgtatcggcaagcacaggaagcatccaggaggtcgcggaaacgctggaggcatgcaccaccatcggatcctattcgacaagtaccatcccggcttcttcggtaaagtcggtatgcgttacttccacaagctccgtaacaagttctattgcccaatcgtcaacgtcgacaagctctggtctctgatccctaacgaggtcaaggacaaggctaccaaggataacgctcccttgatcgacgtcactcagtttggctacttcaaggtcttgggcaagggtgtcctgccggagaaccagcctttcgtcgtcaaagccaagaccgtgtctaagatcgccgagaggaaaatcaaggaggctggtggtgctgttgtactcactgcttagggtttggaatcttttgcttattagggtttttatttgtttgttgtaa

SEQ ID NO: 3417 - DNA, 730 bp, Manihot esculenta
agcagctcatccatttctctcacagccccccaaatatccgtctttaagccaagagggccaaaatgaccactagattcaagaagaaccggaagaagcgcggccacgtgagcgctggccatgggcgtattggcaagcatcggaagcatccaggaggtcgcggtaacgccggtggcatgcaccaccaccggatcctttttgacaagtaccatcctgggtattttggaaaagtcggtatgcgatatttccacaagttgcgtaacaagttctactgccccatcgtcaacatcgacaagctctggtcgttgatcccccaggaagtgaaggataaggcgagcaaggacaatgtgcccataatcgatgtcactcagcatggctacttcaaggtattggggaagggcgccctgccagagaataagccgattgtcgtgaaagcgaagctggtttccaagattgccgagaaaaagataaaggagaatggtggagctgttgttcttactgcttaagctgttctattctgatcactttagatattatttttcaagtgtttacagtttgatgttaatgggtactttttatggttgatgatgatactttttggtttaaatggatatgaatcactttcccagagcttagatctatgacttttacgcttttggttcttattgattgagccattctggtgatgtgtttgatgtttgtgctttccattgaaatgtgctatttttccttg

SEQ ID NO: 3418 - DNA, 2906 bp, Ceratodon purpureus
gtcgatcactggagccgagatacagaattcagctcgtggactcggaacatgggtgaagagatgacaggttagaattatgacatttacggtagaattcctcggtggataccatatatgccacttcacacaggacaatcaattttggtgatgcatcactatccggtcaaacatatacgattatagtgtcgaattggtgatgaacgggagatccaggttcgttactagtatgttctgtcttacaaccctttcttcgacatggcttaatcccggcgattgcagcactgagataaatacgaagattctagaagtacacagtcgtttcaatagtgtacagcacaacctgttgactgactgactaaggaatgaaaaattatgtgaaattggtcaagatattgcaaacgggctatcactcacggcgcatgggttacacacattagccctatatctcgatgctgctagcaaaacgaaacactacgagctgtaaatcaaagctgataaatgtatatatacatatttgaacagtgcgccttacaattgtcacaactgtctataatcacaattgtctgtaaaaaataaaatgagatcgcccactaaggaacggcatcccacccaagttcaaacatggttaacttcttgggaccacactcttcgaggggaagaccagatattgcttgccactcacctttcccaaactcatacagccatgcgaggttgtgttcaaaactacctcgtccattattgtttgcagtcaccagcaagaagttgttgcaggcgtacagatgcaaatgatactttgcatcatctggagggttctcaaattcagtacatctgtagtgctgcaatttacgccaatgtggccgttgcctctccacaataccgttgtctctccacaacaccatctcccaaaagtgtatcttgataggtcacttcataggtctctttgtgcaggacaaagagcctatctttcacaagcgcataggaacttgcacctggcagtgttttccacggactgctttcatcctcaagactgatttttgcaccatttgcacaatcataaacacaaggaatcggtcgactcatttcataatagaatagggtttcaccttcaagctctgaatcacttccatcatcgtcccaaaaatggtgatacccaaagacgaggtctgtagaagcctctgtggagctccactgcccggttacagagctgtaaatagcagctgcctcccctccaaaagtgtactttcctctagcatcctttctcatactcgcttcgcttggacccacaataagcactttgtatgttgctgattccctgtccatcaccagctgcagcatgctcggctgaaaagagctcaaggcatgtggcaaattgggaagcactctacgctgttttgtcaatggattgaacacctcaatgaccacggggttttccgtcttgtctatgtcaagagacacaacgcacaccagccctccgtccccagcattcattgtcacaataaactgatcttcaaatacggtattgtgcttaaaccgatgccacctcttagaaccgttgtcatgaatcctcactgccattacccctgctatatcatagtcaaaagcttcacagagtagcccaaataactttggattgacttgggcacataccttcgaaaacccttggagcactccagtcacatatccgttccaagccttcgaaaggactcgtaggcggaggatgtggcgcaacggtaaatgagcaaagatgcgctgctctagctccagtggcaatttgctccatatagcaggattcaaaatgtgtttacaagtgccacgcccttgctgaagaagaccctgtactcgcttcttccggtgatcttgctgttgggtcataccttcaggtacaaactgcaattgacgagaagtcctctctagaacttctggcctcctatctgcactagcgctcgcaagcaaatgtgcagtattctccagctgtgcgaggtccattcttgctccactccgctctacactggccaggctccagtcaatgattcttatgtcactgccttctgcctctaaagctagtttgttttgcctgtggtcgcctcggaggagctccgagacaacgcaaggaacagcaccatgacgacccgcctgaagaagaacaggaagaagagaggacacgtcagtgccgggcatggacgtgtgggcaagcaccgcaagcatccgggaggtcgcggtaacgctggaggtatgcaccaccacaggatcttgttcgacaagtaccatcctgggtacttcggcaaggtcggtatgaggtacttccacaagacgatgaacaagttccactgccccattgtcaacattgataagttgtggtctttggttccggaggccgtgaaggagaaggtggacggagacaagagcgctcccctcttggacgtcacgcagcacgggttcttcaaggttctcggcaagggtgacttgcctacgcagcccatggttgtgaaggccaagttcttctccaagctcgccgagaagaagatcaaggaggccggcggtgcggtcattctcaccgcttagggtttttaatttgaactttgattagggttgtaatcagagccgtggcattgttctcgtgcttatcggtattccctggaatggaagttatgcttttaagcgacggtttttctgttgttgtactctacccctaatgtccttgttattaggtcaatatatgttctcgcagtctatatgcattgatgattcctagaggtgttctgagttggttgtgtttgaggtggacacacattctgtttagaactattttctctggtcacgttaatcagtatgcgatatttctggattggtagtgctcgtcatttgagccgttttggattggagtttaggtttatttggctcttatt

SEQ ID NO: 3419 - DNA, 678 bp, Ceratodon purpureus
aggcgcgcccaacgccatcgccatcgccacccccgcagcagcagcagcgcagcggaccatccccagcagccatgacgacccgcctgaagaagaaccggaagaaaagaggccatgtgagcgccgggcacgggcgtgtgggcaagcaccgcaagcatcccggaggtcgtggtaacgccggaggtatgcaccaccaccggatcctcttcgacaagtaccatcctgggtacttcggcaaggtcggtatgcgttacttccacaagaccatgaacaagttccactgccccatcgtcaacatcgacaagctgtggtccttggttcccgaggccgtgaaggagcagactgacggcgccaagtccgccccgctcttggatgtcacccagcacggttacttcaaggttcttggaaagggtgaccttccaactcaacccatggtagtcaaggctaaattcttctcgaagctcgcggagaagaagattaaggaggctggaggagcagttattcttactgcttaagttaattcgccgttcacagacctgtatgcatttttgctgtagaatggttcagaaatgtgctcgtcatggtggtgtaggtgtttcgcagcatggactgcagagaccatccttgtgctgagactgtatctgctaacacatcagaaatgaagaactctccatattttcc

SEQ ID NO: 3420 - DNA, 902 bp, Ceratodon purpureus
gtttgttttccctgtggtcgcctcggaggagctccgagacaacgcaaggaacagcaccatgacgacccgcctgaagaagaacaggaagaagagaggacacgtcagtgccgggcatggacgtgtgggcaagcaccgcaagcatccgggaggtcgcggtaacgctggaggtatgcaccaccacaggatcttgttcgacaagtaccatcctgggtacttcggcaaggtcggtatgaggtacttccacaagacgatgaacaagttccactgccctattgtcaacattgataagttgtggtctttggttccggaggccgtgaaggagaaggtggacggagacaagagcgctcccctcttggacgtcacgcagcacgggttcttcaaggttctcggcaagggtgacttgcctacgcagcccatggttgtgaaggccaagttcttctccaagctcgccgagaagaagatcaaggaggccggcggtgcggtcattctcaccgcttagggtttttaattttaactttgattagggttgtaatcagagccgtggcatcgttctcgtgcttatcggtattccctggaatggaagttatgcttttaagcgacggtttctctgttgttgtactctacccctagtgtccttgttattaggtcaatatatgttctcgcggtctatttgcattgatgattcctagaggtggcctgagttggttgtgtctgaggtggacacattttgttatgaaccattttctccggtcacgttaatcagtatgcggtatttctggattgatagtgcttgtcgtttgagccgctttggattggagtttaggtttattaggctcttattgtaggaaaatgttgcaaaacctaacaaaactttttgattatgtgtttctgttatgttcttc

SEQ ID NO: 3421 - DNA, 600 bp, Cleome spinosa
acgaggttcaagaagaacaggaagaagcgcggccacgtatccgccggacatggtcgtatcggcaagcacaggaagcatcctggaggtcgcggtaacgccggaggcatgcaccaccaccgtatcctcttcgacaagtaccatcccggttactttgggaaggtagggatgaggtactttcacaaactgaggaacaagttctactgccccatcgtgaatttggacaagctgtgggcgctggtgccacaagaggtgaaggacaaggccagcaaggacaacgttccattgatcgatgtcactcagtttggatacttcaaggtgttggggaaaggtgtgttgccggataacatgcctgtcgttgtgaaggcgaagctgatctccaagaacgcggagaagaagatcaaggaggccggtggagccgtcatcctcaccgcatagggtaggcattttttttctcatttcgtatcccatttttattttttgttttgaagtggagatctttaattgtgggatttgatttgatggtacatctcgtttgtcgaagttgcgaagtgatatgatgtattttggatctatggaagtatgagtttcgtcggttatgat

SEQ ID NO: 3422 - DNA, 687 bp, Gossypium hirsutum
tcggcttctcccagatcttcaccaacctcccaaaatgacaacccgcttcaagaagaaccgcaagaagcgcggccatgtgagcgccggtcacggtcgtatcgggaagcacaggaagcaccccgggggtcgcggtaacgctggaggcatgcaccaccacaggatcctcttcgacaagtaccatcctggttatttcggtaaggttggtatgaggtacttccacaggctccgtaacaagttccattgccccatcgtcaacatcgacaagctctggtctcttatcccggaggacgtgaaagccaaggccaccaaggatgccgctccgatgatcgacgtgacacagttcgggtactttaaagtcctcggcaaaggtgttttgccggagaatcaaccggtggtcgtcaaggctaagttggtgtcgaagaccgctgaaaagaaaattaaggaggctggtggtgctgttgtgctcaccgcttaggttagggttcttggttttattggatctgaatgacatttctgttagattattgttatgtttcgttttttttgagttaaacttgaaatgagatttttaatatcgtttaattttggatcaaactatatgttttatgtgataagttttttgccttaatgcttatttttgctgtgttttggcattgttgcaatttaagttttataaagaattaatta

SEQ ID NO: 3423 - DNA, 732 bp, Gossypium hirsutum
cgaacactcggcctctcccagatctacaccaacctcccaaaatgacaacccgcttcaagaagaaccgcaagaagcgcggccatgtgagcgccggtcacggtcgtatcgggaagcacaggaagcaccccgggggtcgcggtaacgctggaggcatgcaccaccacaggatcctcttcgacaagtaccatcctggttatttcggtaaggttggtatgaggtacttccacaggctacgtaacaagttccattgccccatcgtcaacatcgacaagctctggtctcttatcccggaggacgtgaaagccaaggccaccaaggatgccgctccgatgatcgacgtgacacagttcgggtactttaaagtcctcggaaaaggtgttttgccggagaaccaaccggtggtcgtcaaggctaagttggtgtcgaagaccgctgagaagaaaattaaggaggctggtggtgctgttgtgctcaccgcataggttagggttcttggttttattggatctgaatgacatttctgttagattattgttatgtttcgtttttttttgagttaaacttgaaatgagatttttaatatcgtttaattttggatcaaactatatgttttatgtgataagttttttgccttatgcttatttttgctgtgtcttggcattgttgcaatttaagttttataaagaactaattaagccatggatatgggtttaatgaatcactattgggttc

SEQ ID NO: 3424 - DNA, 1421 bp, Gossypium raimondii
attttaattattaaaaatcaaaataagataattttattaggacggagatttattaacccaaaggccaaaatggcctttcattagtagggcaaaacacacagacacacacacaagccgcagcaatccgaaagggcacatccgtaaaatggaaaaaccctagagggtaaaaccggaaacctaattttatcccacaaccatataatccccacaaaccctaactctcattgtctcccatctcagccgcctacaaacactcggcttctcccagatcttcaccaacctcccaaaatgacaacccgcttcaagaagaaccgcaagaagcgcggccatgtgagcgccggtcacggtcgtatcgggaagcacaggaagcaccccgggggtcgcggtaacgctggaggcatgcaccaccacaggatcctcttcgacaagtaccatcctggttatttcggtaaggttggtatgaggtacttccacaggctccgtaacaagttccattgccccatcgtcaacatcgacaagctctggtctcttatcccggaggacgtgaaagccaaggccaccaaggatgccgctccgatgatcgacgtgacacagttcgggtactttaaagtcctcggcaaaggtgttttgccggagaatcaaccggtggtcgtcaaggctaagttggtgtcgaagaccgctgagaagaaaattaaggaggctggtggtgctgttgtgctcaccgcttaggttagggttcttggttttattggatctgaatgacatttctgttagattattgttatgtttcgtttttttttgagttaaacttgaaatgagatttttaatatcgtttaattttggatcaaactatatgttttatgtgataagttttttgccttaatgcttatttttgctgtgttttggcattgttgcaatttaagttttataaagaattaattagccatggatatgggtttaatgaatcactattgggttcgctaagtacgtgttataagccttttgttttcgggtgtaattgggctgagtcgtgcatgaatattggtaagcccgacttgaaattcaaggttcaatgcttgatttgagcttgattgaacatcaacttctcagaattacccaagctggattatgtttgtgtatcaattttagcaattagtttaagcttgattagactctgaacataatcgagctacctgagctctcttgagcttgattaagcaaacaaagataaatgtaatttcataatacaagttatattaaaatgaaaagcttgacctggtttgtgagctgcttgaattcagtgtaatcaatggcttgagcttaatttagttcaactcaataattattaaattgaattcggtttaaattttttagatttagaactcaaatagcttgtgagcattgatgttttatttacactc

SEQ ID NO: 3425 - DNA, 597 bp, Hevea brasiliensis
aagagagagctaaaatgaccacccgattcaagaagaaccggaagaagcgcggccatgtgagcgctggccatgggcgtatcggcaagcacaggaagcaccctggaggtcgcggtaacgccggaggcatgcatcaccacaggatcctcttcgacaagtaccatcctgggtattttggaaaggtcggtatgcgatatttccacaagttgcgcaacaagttctactgccccatcgtcaacatcgacaagctttggtcgttgatccctcaggaagtgaaggataaggctagcaaggacaatgtgcccatgatcgatgtcactcagtatggctacttcaaggtattggggaagggcgctctgccagagaacaagccgattgtggtgaaagcgaagcttgtctccaagattgccgagaaaaagataaaggagaatggtggagctgttgtgcttacggcttaagctgttttgctcttatcactttgagtctttcagttttttatttttcaagtgttgagtttcttattaatgggtactttattatgcttctagttgctacttttttggtttaaatagatatgaattgctttcccagtgcttaaac

SEQ ID NO: 3426 - DNA, 539 bp, Humulus lupulus
atagggtttggttgcaggagggttcgaaatctcgaggaggagaagatgactacccgattcaagaagaaccgcaagaagagaggccacgtcagtgccgggcatggacgagtggggaagcacaggaagcatcccggaggaagaggtaacgccggaggcatgcaccaccaccggatcctgttcgacaagtaccatcctgggtacttcggcaaggtcggaatgaggtacttccacaagctcagaaacaagttctactgccccattgtcaacatcgacaagctctggtctatggtccctcaagagatcaaggacaaggccaccaaggacaacgtgcctatgatcgatgtctctcaattcggctatttcaaggtcttgggcaaagggaccctcccagaggatcggcccttcgtcgttaaggccaagctcatttccaagattgcagagaagaagatcaaggaggctggtggtgctgtcgttttgacggcttaggttgtcgttttgagagctataagtcggcctttcccttttctttgtaatgtttt

SEQ ID NO: 3427 - DNA, 692 bp, Lotus japonicus
ccctaattcttgttctgcggccgaaaccagagggaggagcagcaaagcaggtagagatgacgacccgtttcaagaagaacaggaagaagcgcggccacgtgagcgccggtcacggccgtatcggaaagcacaggaagcatcctggaggtcgcggtaacgccggtggcatgcaccaccaccgcatcttgttcgacaagtaccatcctggttacttcgggaaagtgggtatgcgttacttccacaagctccgcaaccagtttcactgccccattgtcaacatcgagaagctctggtctcttctccctcaggatgtgaaggacaaggcctccaaggacgctgcacctgtggttgatgttacccagtatggatactttaaggtgcttggcaagggtgtgttgccttccaaccagccccttgttgttaaggccaagcttgtctccaagatcgctgagaagaagatcaaggaagctggtggtgctgttgttcttacagcttagttttaaattttgtttgtttatccattttgcggttgtttgcatacatcagatattgttggttttgttttgttaacattttataatcttaagggatattgatgttatgcttttcagtattgttggtttatgaaactgattttgagttacatgtttttgttgcctcaatgttcaattgttatagtttatcatgtcaaa

SEQ ID NO: 3428 - DNA, 753 bp, Physcomitrella patens
gggtttagggtttggcgctcacaaaggctgagggcgttgctcacagttgccctctttgttgtaatccctgttgctgctttggagaagttccggattgacgcgggaagagcggcaccatgacgacccggctgaagaagaacaggaagaaaaggggtcacgtcagtgccggacatggtcgtgtgggaaagcaccgcaagcatccaggaggtcgtggtaatgctggaggtatgcaccaccaccggatcttgttcgataagtaccatccagggtactttggcaaggtcggtatgcgatacttccacaagacgatgaacaagttccactgccccattgtcaacattgacaagttgtggtctctggtgcctgaggctgtgaaggagaacgctgacggagaaaagagtgcgcctctgttggatgtgacgcaacacgggttcttcaaggttcttggaaagggtgacttgcccgcgcaacccatggttgtgaaggctaaattcttctccaagctcgcggagaagaagatcaaggaggccggtggtgctgtcattttgactgcttagtgtgtcgaaaagactgtcacgtttaggagattgttacgaaagcattattttggcgtacaatcagttttactgaaattaatgttccatcgtgaaggatgggttccgtctcgtttcaggcctcatgtcttggtatccctactctaatgacggatttcacttcgaatatttctttctctgttacttaaatacattctta

SEQ ID NO: 3429 - DNA, 714 bp, Physcomitrella patens
ctttttagcagtgctgagttgtttcccaggctcagggcatctctgagactgcgctagaggaacggcagcatgacgacccgtctgaagaagaacaggaagaaaaggggacatgtgagcgctggtcatgggcgtgttggcaagcaccgcaagcatcctggaggtcgaggtaatgctggaggtatgcaccaccaccggatcctgttcgataagtaccatccaggatacttcggcaaggtcggtatgcggtacttccacaagacgatgaacaagttccactgtcccatcgtgaacatcgataagttatggtcgttggtgcctgaggccgtgaaggagaaggctgatggagacatgagcgcacctctcttggacgttacccagcacgggttcttcaaggtgcttggcaagggtgacttaccgtctcagcctatggttgtgaaggccaagtttttctccaagcttgcggagaagaagatcaaagtggccggcggtgctgtcatcctgactgcttagatttacatgtgcgaggtttatttgcgggatgtgaggagggccgtagcattgacttggtggttaatagcgtcacctgaaatgaacttcctgtttttaggaacggccgcacacttgtttcattctccttctgaggattttgcttatggaacgaaaggattactctcgaaatttttaggctggtggaaatcacagctatttcatcaa

SEQ ID NO: 3430 - DNA, 707 bp, Physcomitrella patens
ctcttttgcttgcttgctagcttgcttgcgttgagctgctcgacacttcctctatccggcaaccatgacgacccggctgaagaagaaccgcaagaagagaggccatgtcagtgccgggcatggacgtgttggcaagcaccgcaagcatcctggaggtcgcggtaacgctggtggtttgcaccaccaccgcatcctcttcgacaagtaccatccagggtacttcggcaaggtcggtatgcggtacttccacaagactatgaacaagttccactgcccaattgtcaacgtggacaagctctggtcgcttgtgcctgaggctgtgaaggagaagaccgatggggacaagtgtgcccctctcttggacgtcacacaacacggcttcttcaaggtgcttggaaagggtgatcttcccactcaacccatggtggtcaaggctaaattcttctctaagctcgctgagaagaagatcaaggaggccggaggagctgttatcttgactgcctaagttcaagtcaacgttcgacaacctatgcacctgtgtgttgtagtatgattttgaaacgttctcatcatggttttgtaggtgtttgtcatacccttgtcatggaacttgtttgtactaacatatcagaaatgcaaagttcttttctgttcatacctatattcaatgtcgaatcgttatcacactgatctcgttgtggactaaa

SEQ ID NO: 3431 - DNA, 657 bp, Physcomitrella patens
acaaagcctggagtccatgccgatgagagtctctttggttgtttaggtttgcttgccgctctctctctgcaggggagtgcgcgcgaaggaacggcatcatgacgacccgcctgaagaagaacaggaagaagagaggacacgtgagtgccggtcatgggcgtgtaggcaagcaccgcaagcatccaggaggtcggggtaatgccggaggtatgcatcaccatcggatcctgttcgacaagtaccaccctgggtacttcggcaaggtcggtatgaggtactttcacaagacgatgaacaagttccactgtcccattgtgaacattgataagttgtggtcgttggtgcctgaggccgtgaaggagaaggccgacggggagaagagcgcgcctctcttggacgtcacccagcacgggttctttaaggtgcttggcaagggcgatttgccgtcccagccgatggttgtgaaggctaagtttttctctaagctcgcggagaagaaaattaaggaggctggtggtgcggttatcctcactgcctaagccccttgagaagagttctgttcaggaaatgtgaaggggatccatgcatttgttcggtgtctagatgcatctaccgaaatgaaaattccgttttttcgagacgattacattcctgttt

SEQ ID NO: 3432 - DNA, 736 bp, Glycine max
gctgcagcaagggctcaacgcacgcaggaggaggagattgatcgagagaagagaagatgactacacgcttcaagaagaacaggaagaagagaggccacgtgagtgccggccatggccgcatcgggaagcaccggaagcaccctggaggacgcggtaatgccggaggcatgcaccaccaccggatcctctttgacaagtaccaccctgggttcttcggcaaggtcggaatgcgctattttcacaagctccgcaacaaattctactctccgatcctcaacatcgacaagctctggtccctggttccgcaagaagtgaaggacaaggcctccaaggagaacaaggcgccgctgatcgacgtcacgcagttcgggtactttaaggttctcggaaagggtgttttgccgcagaaccagcccgttgttgtcaaagctaagcttatttccaagatcgctgagaagaagatcaaggaggctggcggtgctgttgttctcaccgcctgattttattgacggtatcgctttttcaacgatttagggttttttttttgttttgttctgatacgtttcgttttggatgacgttgttgtttagtctatgctacatttcaggatttaatttaaggttttatttttttaatttgcgcgttttagacttcggcttaattttaattgaatattatcgcgtttaacggtgttttgaaattgggaatctatcgaaattgttaaaattgcgcgtgt

SEQ ID NO: 3433 - DNA, 1211 bp, Glycine max
ccgatttttgagtgtgaaattagagattcaaacaaatcgagttgaaataaatacagaatgtaatgctcaaaaccacaaaataaaaggcctttcgttcatgggccggaccgaaaatgaaaaaaaaaaaaaagactaaacacacacgcgagggttaaaacagtaaaactagcagcagaagtctcacatactataaattctgaaaccctaatcctcctctagccgctgcagcaagggctcaacgcacgcaggaggaggagattgatcgagagaagagaagatgactacacgcttcaagaagaacaggaagaagagaggccacgtgagtgccggccatggccgcatcgggaagcaccggaagcaccctggaggacgcggtaatgccggaggcatgcaccaccaccggatcctctttgacaagtaccaccctgggttcttcggcaaggtcggaatgcgctattttcacaagctccgcaacaaattctactctccgatcctcaacatcgacaagctctggtccctggttccgcaagaagtgaaggacaaggcctccaaggagaacaaggcgccgctgatcgacgtcacgcagttcgggtactttaaggttctcggaaagggtgttttgccgcagaaccagcccgttgttgtcaaagctaagcttatttccaagatcgctgagaagaagatcaaggaggctggcggtgctgttgttctcaccgcctgattttattgacggtatcgctttttcaacgatttagggttttttttttgttttgttctgatacgtttcgttttggatgacgttgttgtttagtctatgctacatttcaggatttaatttaaggttttatttttttaatttgcgcgttttagacttcggcttaattttaattgaatattatcgcgtttaacggtgttttgaaattgggaatctatcgaaattgttaaaattgcgcgtgttacccttgtttcgttgaacatgcggtatttgaaattaggtttttacgtgatgaattgaacttcactagggaattttttcttttcgtgtgattcatcttacttctggtatatggcttgtgtcgttaatttcaattttccaaactcattttcattgaatcttttcgcagtatatctaattccatttgatgctattagatttttctttctggaataatacacgtgagtgtttcaaaaaactatggttttggaatgag

SEQ ID NO: 3434 - DNA, 623 bp, Glycine max
agagctgcaagggatcaactgaggagagtgagagaaaagagaagagaagatgacaacacgcttcaagaagaacaggaagaagaggggccacgtcagcgctggccacggtcgaatcggaaagcacaggaagcaccctggaggacgcggtaacgccggaggcatgcaccaccacaggatcctcttcgacaaataccaccctgggttcttcggcaaggtaggaatgcgctattttcacaagcttcgcaacaaattctactctccgatcctcaacatcgacaagctgtggtccctggtcccgcaagaagtgaaggacaaggcctccaaggagaacaaggcgccgctcatcgacgtcacgcagttcgggtactttaaggttctcggaaagggcgttttgccgcagaaccagcccgttgtggtcaaggccaagcttatttccaagatcgctgagaagaagatcaaagaggctggcggcgccgttgttctcaccgcttgaatttgacggtatcacttttttgaacgatttaggttttgttctgatacgttttgttttggattatgttgttgtttagtctctgctatatttcaggattaaattgaaggttttattattttaatttgcgcga

SEQ ID NO: 3435 - DNA, 1084 bp, Glycine max
ttcatgggccggggcccgaaaagaaaaaggcttaacacgcacacgggagggtcaaaacagtaaaactagcagcagcttcacatattataaattttgaaaccctaatcctcctctcagagctgcaagggatcaactgaggagagtgagagaaaagagaagagaagatgacaacacgcttcaagaagaacaggaagaagaggggccacgtcagcgctggccacggtcgaatcggaaagcacaggaagcaccctggaggacgcggtaacgccggaggcatgcaccaccacaggatcctcttcgacaaataccaccctgggttcttcggcaaggtaggaatgcgctattttcacaagcttcgcaacaaattctactctccgatcctcaacatcgacaagctgtggtccctggtcccgcaagaagtgaaggacaaggcctccaaggagaacaaggcgccgctcatcgacgtcacgcagttcgggtactttaaggttctcggaaagggcgttttgccgcagaaccagcccgttgtggtcaaggccaagcttatttccaagatcgctgagaagaagatcaaagaggctggcggcgccgttgttctcaccgcttgaatttgacggtatcacttttttgaacgatttaggttttgttctgatacgttttgttttggattatgttgttgtttagtctctgctatatttcaggattaaattgaaggttttattattttaatttgcgcgattaactatgccagcctgatgacattagaatctatcgaaattgttaaaattgagcatgttagctttcgtattattggacctatgacatttgaaattaggttttttgctatggattgaacttcaccctaggggttttgttcttttcgtgtgattcattttacattcggtaaatgacaacggaaacaagtgattagagagtaaggatgtgttttgctcttctggaaacttgtttgatttagctagtttttaatacatgggacttagaacacagagtgagttgttgtagtgcgactgcaactttctgcacccaaaaaaactcaagcaataccatctttcaatttgttgct

SEQ ID NO: 3436 - DNA, 761 bp, Camellia sinensis
gttcctccctccaataaacacccctccaaaaccctacctagcttctcctccacatctctcctccgccgctcaaacctctacacagagagttctagagagagtgagagagagagagagagagagcgcaacaatgacgacacggttgaagaagcacaggaagaagaggggccacgtcagcgccggccacggccgcattggaaaacacagaaaacatcccggcgggcgaggaaacgccggaggaatgcaccaccaccgcatcctcttcgacaagtaccatccaggttacttcggcaaagtcgggatgaggtacttccacaggctccgcaacaagttctattgccccatcgtcaacatcgacaagctctggtctctcgttcctcaggaaatcatggccaaggcttccccaaccaatgctccgatgatcgatgtcactcagtttggttacttcaaggttcttggtaagggcgtgttgcctcaatctatgccgatcgttgttaaggctaagattgtttcgaagactgctgagaagaagatcaaagaggctggtggtgccgttgttctcaccgcttaggtttgcttttgttttttgaaatttagggttttgagttttactacactttgggcgtattcaagatgacatttctatgattaccatgtttagcttttaatgatgcaatgcaatattattgttttttgtttctgttctgagcacagaaagaaaaaatcatgtcggccgcctcggcctatgtgcggccgcccac

SEQ ID NO: 3437 - DNA, 659 bp, Triphysaria pusilla
attcaccaagcctcgcagcactccaaaccaaactccgatcgccacaatgacgactcgattcaagaagaaccgcaagaagcgaggccatgtcagcgccggtcacggtcgtatcggcaagcaccgcaaacatcccggaggtcgtggtaacgtcggaggtatgcatcaccaccggatcttgtttgataagtaccttccaggatacttcgggaaagtcggtatgcgctacttccacaggctgaggaacaagttccactgccccaccgtcaacatcgacactctctggtccatggtgccgcaggaggtgaaggacaaggcgaccaaggacaacgcgccgttgatcgatgtcacgcagttcggttacttcaaggtgctcggcaagggtttgctgccggctgataagcctgttgtggtgaaggcgaagcttgtgtcgaggaacgccgagaagaagattaaggaggctggtggcgctgtggtgctcactgcttgattaggttaattttgttgaattttatgtttttgaaatgtatgaatggtctactgttatattttctggatctagtttttatgaatgttttttaatcaagcaaaatgaacctgtttttgttatttgcttatagttgagtttcatcattgctacctcaaaaaaaaaaaaaaaaaag

SEQ ID NO: 3438 - DNA, 912 bp, Valeriana officinalis
tctagagtctgaaagagtgcgagaatgacgacgagattgaagaagaacaggaagaagagaggtcatgtgagtgccggacatggacgtatcggaaagcacaggaagcatccaggaggtcgtggtaacgccggaggaatgcatcaccacaggatcctgttcgacaagtaccatcctggttacttcggtaaggttggtatgagatactttcacaagctccgcaacaagttccactgccccatcgtcaacatagacaagctctggtcacttctccctcaggaggccaaggataaggccacagctgataacgttccgttgatcgacgttactcagcacggttacttcaaggttctcggaaagggaatgttgcctatctctcagccggttgttgtcaaggccaagtttgtttcaaagacggccgagaagaagatcaaggaagccggtggtgctgttcttcttactgcttaggtttgagcttctgctttaaaactcttttatcattattattatcgttagggttttgttttgtgattggtgatattatgatacattttggatgtttgagatagtttttgttataatcttatgattgattgaagttggtttgtcattttgatagttttcatctactatatcctgcatttggtgtgtgttagattagagtgcctttgtagagtcaagccttggagtgcatatgaatgtagggtataggagtattatccaactgaaattcttgcattacaatgacccaatcaagcatacagattcatcgctgaagtcctctaattgatttgttcttgattagatactcaatttatagtgtataaaatattagttggtgacttctggagaactctctcagttgtatacggattcttctatgatcaaaaactgttttttcagctaaaaataatt

SEQ ID NO: 3439 - DNA, 646 bp, Tropaeolum majus
cttctccgccgctcagaacacgggagtgttagaaagagtgcagccatgaccacccgcttcaagaagaaccgaaagaagagaggtcacgtcagtgccggacatggtcgtattggaaagcatcgcaagcatccaggaggtcgcggtaacgccggtggtatgcaccaccaccgtatcctcttcgacaagtaccatccaggttacttcggtaaagtcggtatgaggtactttcacaagctacggaacaagttccattgcccaatcgtcaacctcgacaaattgtggtcgcttgtaccccaggaggctaaggacaaggccaacaaggacagtgcccctgtgattgatgtcactcagttcgggtacttcaaggttcttggaaagggagtgttgccatccgatcaacccgtggttgttaaggctaagctgatttcaagatcgcggagaagaagatcaaggaggctggtggcgctgttgttctcactgcttaggtcttttttcatcagtattatagttatttcacatcgattatctcacttttaacagatattttatatttgctttgtttaattttgaattgttgaaatggatgataccttttttatattagcggttcccatatttaagattatcaggattttatactagagtt

SEQ ID NO: 3440 - DNA, 455 bp, Thalictrum flavum
actcgattcaagaagaacaggaagaagagaggacacgtgtcagctggacatggacgtatcgggaagcatcgaaagcatccaggaggaagaggaaatgcaggaggaatgcatcatcatcggatcttgttcgacaaataccatccagggtatttcgggaaagttggtatgaggtatttccataagcttcgtaataagttctattgccctactgttaatatcgataagctttggtctttggttcctcaagaaatcaaagataaagcttctgccgataatgcccctttgattgatgttactcagttagggtttttcaaagttttggtaaggtatgttgcctccttctcaacctgttgttgttaaagctaaactcatttcaaagaatgctgagaagaagattaaggaagctggtggtgctgttctacttactgcttagttgtttgtttaggggtttatgg

SEQ ID NO: 3441 - DNA, 478 bp, Triticum aestivum
gcaggggctagcagtagatctaacgaaatggcgacggcgttgaagaagaacaggaagaagagaggccacgtcagcgccggtcacggacgtatcgggaagcaccgcaagcatccaggaggtcgcggtaacgcgggaggtatgcatcaccaccgtatcctcttcgacaagtaccatccaggttacttcggaaaggtggggatgaggtacttccacaagctccgcaacaagttctactgccccatcgtcaacctcgacaagctctggtctctcgtccccgaggacgtgaaggcgaagtccaccaaagacaaggtgccgatgatcgatgtgacgcagcacgggttcttaaggttcttggaaaaggtcatttgcctgagggcaagcctttcgttgtgaaggctaagcttatctccagactgctgagaagaagatcaaggaggctggtggcgccgtcgtgctcactgcttaagttaggtcgtag

SEQ ID NO: 3442 - DNA, 993 bp, Amborella trichopoda
atcatagaaattaatgccattttcgacctttcgccgacctatatattcatctcttctttagcgcccaaaaccctaaccctaatttccctccgccccttcttctcctaaaaccagagagagaagctcacccgccccctacaaccagagaggctcactcgccctctaatcctaaacccaatttctccgccatgactactcgattcaagaagaacagaaagaagcgcggccatgtaagcgcaggccatggccgtatcggcaagcaccggaagcaccctggtggtcgtggaaacgccggaggattgcaccatcaccgaatcctcatggacaaataccatcctgggtattttggaaaggtgggaatgaggtatttccacaagctcaggaacaagttctattgccccattgttaatgtggataagctctggtctctgttacctgaagaggccaagaagagtgctggttctggatcagaggcgccattgctcgatgttactaagtatgggtacttcaaggttttggggaagggtgaggttccaaatcagccgctcgtcgtgaaggcaaagctgatctcgaagagggcggagaagaagatcaaggaggctggtggggctgtgatgctcactgcttgaaatcgagaggttagggtttcattctcattgcttctagattacttagatttttatcctttttttgtgtgttccttttagccttcgattataaggattttgggatatctgcttgaacgatgttttgtttaatggagaatattgaggtgagttttggatccaagattttgattatgtggagtgatttggacagcaatcttaataccatggtttcttggtctaaagtagtgtataattttggcttttagtaatggatggttctgaatttagggttttgattgtgatcgagaagtgcttgtattgacaacccaaatgggttttccgccttaatttaattttataaattgtcttaaaataatgatactat

SEQ ID NO: 3443 - DNA, 706 bp, Coffea canephora
cggccggggggcccttcccccgccgccgtccacctgccaacaatgacgactcgattcaagaagaccaggaagagcaggggccacgtgagcgccggccacggccgcatcgggaaacaccgcaaacacccaggaggacgaggaaacgccggaggaatgcaccaccatcgaatcctcttcgacaaataccaccctggatacttcggcaaggtcggaatgaggtattttcacaagctccgtaataaattccattgtccgatcgtcaacatcgataagctctggtcacttgtcccatccgacctgaaagaaaaagccgtctccgagggtaaatctggaaaagcgcctctgattgacgtcacccagtttgggtattttaaggttttgggtaaaggagtcttgccggagaatcaacctgtggtagttaaggctaagcttgtttctaagactgctgagaagaaaattaaggaggccggtggtgctgtattgcttactgcttagattgatttaaatctcgatttagtttaagttttggatactaattttgggtttagataagtgttggaatagtttgaggattcgaattttgttccgttgaattgcttatctggatactgttactattatggtctaaatttggttaatcccacattttgcactttttacattaattttgttgggaatgttaatttatcatacaattttatgttgg

SEQ ID NO: 3444 - DNA, 607 bp, Fagopyrum esculentum
acgcgggggccgctcccggcacaatcacaaaactctaaaatgacgacgggtctcaagaagaacaggaagaagagaggtcacgtcagcgccggtcatggtcgtattggaaagcaccgtaagcatcctggaggacgaggaaacgccggaggtatgcaccaccaccgaatcctcttcgataagtaccatcccggttactttggtaaagtcggtatgcgctacttccacaaacttcgcaacaaattcttctgccctaagattaacatcgaccagctgtggtcgctcgtccccgaggatgtcaaagccaaatccaacaaggataacgcgcctttgatcgatgttactcagtttggatactttaaggtccttggaaagggagttttgccgaatcagccgctcgtgatcaaggcgaagcttgtgagcaagatcgctgagaagaagattaaggaaaatggtggttctgttattcttactgcttagtttttcggtgaggagtttttcgtttctttcttttagatattttgattatgttagtctatgacgaattttggttgaaacatgtttggacgccttttactttggaacgcgttaattaaatgcatattatcct

SEQ ID NO: 3445 - DNA, 750 bp, Adiantum capillus-veneris
ttgcctggtttgatagcagcgaggccaccatgacgaccaggttgaagaagaacaggaagaagagaggtcacgtgagtgcaggccatggaagagttggcaagcacagaaagcatcctggaggtcgcggtaatgcaggaggtatgcaccaccatcgcattctgttcgacaagtatcaccctgggtatttcgggaaggtaggtatgcgctacttccacaggacaatgaacaagtttcactgtcctattgtgaatgtggatcggctcttctcgcttctgcccgaatctgcgaagtctgctccagaaggaaaggggcccttgctggatgtcacacagttcggatactttaaggtgctaggtaaaggcgatgctccccccactcctctggtcgtgaaagctaagttcttctccaagcttgcggagaagaagatcaaagaggctggtggtgctgtccttctcactgcttgagagggtagatctagacagatatcgaggccttctttttttgctgctctatttagttgtaagaggattttatatgaggatttgcaagatgaattttgatgtcctggtgacgattgattgaagcagaatctttgttaatgcgaaggctctccattattaccttctgattgcctacaccggtcaggagggatgacttggggggttaacttaattttgggtttcaaaaattggggcatttttttgcctgggggccccttttaaagattttttttgggaaaaatttgggatg

SEQ ID NO: 3446 - DNA, 767 bp, Zamia vazquezii
  misc_feature (359)..(359): n is a, c, g, or t
  misc_feature (362)..(364): n is a, c, g, or t
  misc_feature (736)..(736): n is a, c, g, or t
gattgagagtcgctagggtttggtcgagtcctacaattagctgaagtgcacaagaccggttagggtttgggtgagcagcaaagcgcaggatgacgacgagattgaagaagaacaggaagaagagagggcacgtcagtgcaggccatgggcgcattggcaaacacagaaagcatcccggcggcagaggaaatgctggaggtctgcaccaccaccgaattctcttcgataaattccatcctggatactttggaaaggttggtatgcgacatttccataagctgaggaaccactatttttgccccattgtcaatgtagacaaattatggtcgctggttcccgaaggcgttaaggccaaggcnacnnnagataatgttcccctcttagatgttactcagtttggttacttcaaagttttgggcaaaggagaattgccttcacagccccttgttgtcaaggccaagcttgtttccaaattggccgagaagaagatcaaggaggccggcggtgctgttgttttgactgcctgatcggggttccgatcctcggagacttgcttcctttgcggatttttatttgactattcgaacagaaattttctgttaatgttttattgaaaggcggacctgaatcttgccgtagggttttcattttacaattccggtgattcccttgttctgctgtttgagtaggaagaaccctaacatttggggttttcttttttttttttgtttcttcnattcgtggtaattatcttgtttggatgtttc

SEQ ID NO: 3447 - DNA, 710 bp, Lotus japonicus
gaaccctgcagagagagactccctatcagagagagagagagagagagagagatgacaacccgcttcaagaagaaccgtaagaagcgtggccacgtgagcgccggccacggccgtatcggaaagcaccgcaagcatcccggaggaaggggaaacgccggtggcatgcaccaccaccgcatcctcttcgacaagtaccatcctggttacttcggcaaggtcggtatgcgctacttccacaagctccggaaccagttccattgcccgatcgtcaacgtcgagaagctctggtctctcctgccgcaagaggcgaaggacaaggccgcgaaatccaagggcaccgcacctgtcgtcgatgtcacgcagtatggtttcttcaaggttctcggcaaaggtgtcctccctgagaatcagccacttgttgtgaaggctaagctgatttccaagatcgctgagaagaagatcaaagaggctggtggcgctgttcttcttactgcttagggtttgtgttgaatctgtttttgttcatttttgattaaggattttgagctgtttgaattcccatttctataaacctggtgtttatttatggtttttgatattttgaagtagtgacatgaatggttggttttaattagcattaatctatgaacaaattttgttgctgcattgtttgggttctttgatgaattttggagttttgatggatttga

SEQ ID NO: 3448 - DNA, 2548 bp, Panicum virgatum
tattccatcaatttgttcgcctcgccaattagcaggccttcttccgatagctggtgccacacgaaagatgatacgttagtttcctttgcgtcgacggatcaagcgtgaacaggcagcaacagaatagccgccgccacgcctattggagccaggtcagcaaaccctaaccagcaacggctacattcagcgccggtctcgtctccccctcggcgtactagccgttgcgttccccttccctccccgtccccgacctcctcctacaaataatcctcagcggccgatccctaaatcccacagctcaagcagcttctctttctctctctttctctccctctcctcgcctccccacgccgatctctcgaacgcttggggagacgagactctgcgatcttccgcctcgctcatcagagctcacgaagttctacgcatttttttcgctgtttaatccgcttgtttaattattccatcttcttcgcgttgttaatctgtgatcgattctaccctgctagtttacagttcgtgtttaatctaattgattctgctgttgctattactgttccgtgtcgtgcttgtcttgttcgtttgctgctgctaaccatggacgcaggttcccactcgatctcctccgagaagagccgcgccgccgccgcgccgccgccgccgctgcaggaggcgggctcccgcccctacatgccgtcgctgagctcgggatcgcgcaacccgtcggccaagtgctacggcgacaggttcatcccggatagatcggcgatggacatggacatggcgcactacctgctaacggagcctaggaaggataaggagaacgcggcgggtgtggcggcgtccccgtccaaggaggcgtaccggaggctgctcgcggagaagctgctcaacaaccggacgcggatcctcgccttcaggaacaagccgccggagcccgagaacgtctcctgcgccgaggcagcttccaacctgcaggccaagccggccaagcagcggcgccacattccccagtctgccgagcggactctggacgcaccagagctcgtcgatgactactacctcaacctgcttgactgggggagcaacaacgtgctgtccattgctttgggcgacacggtgtacctgtgggacgcatcgagcggatccacatctgagcttgtgaccgtcgacgaggacagcggtcctattactagcgttagctgggctcccgatggtcgacacattgctgttgggctcaactcgtctgacgttcagctctgggacaccagctccaaccgactgttgagaactcttaggggtgtgcatgaggcaagagtcggctcgctggcatggaacaacagcatcctaacgaccggcagcatggacggcaagatcgtgaacaatgacgtgaggatcaggaaccacgttgtgcagacgtatgaggggcacagccaggaggtgtgtggcctcaagtggtctggatcagggcagcagctggccagcgggggcaacgacaaccttctgcacatttgggatgcgtcaatggcatcctccatgccatctgctggccgcaaccagtggctgcacaggctcgaggaccacatggctgctgtgaaggcgctcgcctggtgcccattccagagcaacttgctggccactggcggcggtggcagcgatcggtgcatcaagttctggaacacacacactggtgcatgtctgaactccgttgacaccggatcacaggtgtgcgctcttctctggaacaagaatgagagagagctgctgagttcacacggattcacacagaaccaactgactttgtggaagtatccatcaatggtgaagatggctgaactcactggccatacttctcgtgtccttttcatggctcagagtcctgatggttgcacggtagcatcagctgctgcagatgagaccctccggttctggaacgtttttggagcccctgaagcgcccaaacctgcagccaaggcttctcacactgggatgttcaacagcttcaaccatatccgttaggagagtcatgaagaatttctcttctgttggatatggtcctgctgtcccagtgtcctagtttacatagatcgcttctcattgatgagatctacctaattggctaagcaggcggcgtgatgggaagcattgcaatctcctaatgcattattttttgctttcaggagggtcagaaattaatgacacagggttggcttcattgacgtcttcatcaagaagctatctgcaaccatctatgatctatctgcaacaccacaggcgtacaaatgacaggaaaagtaacaaaacagctggttctctgaggctcaggtgctgttcaatgtagaatgtttttccccttttggatgcaacatgctagcatcaagagaatatgtttgatgtggcagcaattgtaaatcaagcacgaccattcttttcattatgtataatgaaatatttgtcctcattttcctcttccataagtactccgtgtttgaagttgaagctcactagttcagttcagacttcagagacgagtttcctctgcagttca

SEQ ID NO: 3449 - DNA, 2297 bp, Panicum virgatum
ctcgtctccccctcggcgactagccgttgcgttccccttccctccccgtccccgacctcctcctacaaataatcctcagcggccgatccctaaatcccacagctcaagcagcttctctttctctctctttctctccctctcctcgcctccccacgccgatctctcgaacgcttggggagacgagactctgcgatcttccgcctcgctcatcagagctcacgaagttctacgcatttttttcgctgtttaatccgcttgtttaattattccatcttcttcgcgttgttaatctgtgatcgattctaccctgctagtttacagttcgtgtttaatctaattgattctgctgttgctattactgttccgtgtcgtgcttgtcttgttcgtttgctgctgctaaccatggacgcaggttcccactcgatctcctccgagaagagccgcgccgccgccgcgccgccgccgccgctgcaggaggcgggctcccacccctacatgccgtcgctgagcacgggatcgcgcaacccgtcggccaagtgctacggcgacaggttcatcccggacaggtcggcgatggatatggacatggcgcactacctgctaacggagcctaggaaggataaggagaacgcggcgggtgtggcggcgtccccgtccaaggaggcgtaccggaggctgctcgcggagaagttgctcaacaaccggactcggatcctcgccttcaggaacaagccgccggagcccgagaacgtctccttcgccgaggcagcttcctccaacctgcaggccaaggcagccaagcagcggcgccacattccccagtctgccgagcggactctggacgcaccagagctcgttgatgactactacctcaacctgcttgactgggggagcaacaacgtgctgtccattgctttgggcgacacggtgtacctgtgggacgcatcgagtggatccacatctgagcttgtgaccgtcgacgaggacagcggtcctattactagcgttagctgggctcccgatggtcgacacattgctgttgggctcaactcgtctgacgttcagctctgggacaccagctccaaccgactgttgagaacccttaggggtgtgcatgaggcaagagttggctcgctggcatggaacaacagcattctaacgaccggcagcatggacggcaagatcgtgaacaatgacgtgaggatcaggaaccacgtcgtgcagacgtacgaggggcacagccaggaggtgtgtggcctcaagtggtctggatcagggcagcagctggccagcgggggcaacgacaaccttctgcacatttgggatgtgtcaatggcatcctccatgccatctgctggccgcaaccagtggctgcacaggctcgaggaccacatggctgctgtgaaggcgctcgcctggtgcccattccagagcaacttgctggccactggtggcggtggcagcgatcggtgcatcaagttctggaacacacacactggtgcatgtctgaactctgttgacactggatcacaggtgtgcgctcttctctggaacaagaatgagagagagctgctgagttcacacggattcacacagaaccaactgactttgtggaagtatccatcaatggtgaagatggctgaactcactggccatacttctcgtgtccttttcatggctcagagtcctgatggttgcacggtagcatcagctgctgcagatgagaccctccggttctggaacgtttttggagcccctgaagcgcccaaacctgcagccaaggcttctcacactgggatgttcaacagcttcaaccatatccgttaggagagtcatgaagaatttctcttctgttggatatggtcctgctgtcccagtgtcctagtttacatagatcgcttctcattgatgagatctacctaattggctaagcaggcggcgtgatgggaagcattgcaatctcctaatgcattattttttgctttcaggagggtcagaaattaatgacacagggttggcttcattgacgtcttcatcaagaagctatctgcaaccatctatgatctatctgcaacaccacaggcgtacaaatgacaggaaaagtaacaaaacagctggttctctgaggctcaggtgctgttcaatgtagaatgtttttccccttttggatgcaacatgctagcatcaagagaatatgtttgatgtggcagcaattgtaaatcaagcacgaccattcttttcattatgtataatgaaatatttgtcctcattttcctcttcgaaaaaaaaaaaacaaa

SEQ ID NO: 3450 - DNA, 4208 bp, Sorghum bicolor
ttgtcggaaacggttacggaccaattttcccctctctcgcggcctgcgtatccctcttccctcggctgcttcctcctccctccgcatccacaccatggaatcctagcgctagctcggctaaatcgaggggcaaccagtggtgcaaacaaatcgggtgatgctgcaggcgtacagccgctcctgcgcgcatggcagcacgtggcgcgcgccgtgctcgtgcagccggacagccgccgaccggcattggcggctttgcgtgctgctggtgagtggtgactggtgagtgctactaatctcatatgggctaggcggctggccgtctcacggaaactcgaaagcacatcagggtctgcgattggcgcacggcagctgcttgtatcgatttacttttttgttgatgccttctgaagtctcaatctcccaatctggcaagtggcaaatccccatgagtccatggaatatcatacttcttcatctctatttcaattgcataaattgaaatcgacgattatatatttgtaccgaatttttatagacttgcacaaactgaattggttaaatgggatcatcatttaatcattcctaaatactactttagttgtcttttgtgaaaaatacatctctgatttcttgtaagtgtccaacttttgtgtgttaattcaagttcagtgactattctgatgaagatacaggaggcaaggacgaaccaaatcaccatcagttaggaacataccgtgtcctttttcaattttgactgcaaatgaacacctcatccaacagaagggtcaagagaaacaccctgcagcccatctcaaatccatcttcaagagggagggaacacctatgagaaaacaacagagtgatggagctcaactgccaaggctcgtctgcgcttagctttgtgactttggtgatggatcttatggccatccttgaatttgttcatggcagcattcatgacagcctgttctaaccatgtgagctgtattacagtggcaaattcaattagcaataggaggcaaattgagctggaagttgaaaaacagtgaaattcgaaagttttagtattaaacttcgaattggggaggtgattccaacgggaggtaggttgaattaatcgcctctgaagggtgccaactcttctgatggataccggtgaagtaaactgaaagattaatcgcctctgactctgaatgccaatgccaagtcttgtgatggatatccaggtgaagtaaaccggaaacatggatggtctggtacttcgagttaaacacgttttgatatttgttttgtacgtagtacttttgtctgcggcttcaggatatgagccaacaccggttctcttttccttttttttttttgttttgacaacaccgattccgtgcttgaaagttggacttggatacgccatcctgtccttatcactactccttacaggggaatcgaaaaaaaaaagaagagatggcaatacgagcatggctggaaacctcgacacaagtcacagcgtggtaataaaataacacacgtataatgccccgggcaaatccattcagtctcgtacaaggaaggtgttatttgccgaaatgactgacgcaatgacgctgccgtacagcaagcatgtctcaactcctccaatcaagatccaacaacaacatcgagacttctcaaaaaaaaaaaaaaacgagaccctaggaacgcacggtcgggccgaaacgcggagaccctaacgggctggaccggagccgtccacgccgccacgagcccacgagggtagagcctcgcaccagccagccctagagcccgcaacggctattttctcctaccctgccctccggcggcggctcggcgtactagccgttggccgtggccgtgtggtgcggcgggcgttcccctcttccctcctcctcttcctcctacaaataatctttcgtggccgatccctaaaccccacaaagcaaagcatcaattctctctccttcgcgcattctcctcgcctccccacgacgatctcaagccgctcgccggggagtcgagacacgcgcacttctcgcctcgttcataagctcgtctctttgttctttccgctgttaatcttcttgtttgattattttctgtgcttgattctaacctgctattattttagttcgcgtttaattccatcgctactgctgttgttatttctctgttgtgcttgccctgttcttttgtttgctctctaaccatggacgcaggatcccactcgatctcctcggagaagagccgcgccgccgccgcgccccggccgccgctgcaggaggcggtctcccgcccctacatgccatcgctgggctcgggatgccgtaacccgtcggccaagtgctacggcgacagattcatcccggacagatcggcgatggacatggacatggcacacttcctgctcactgagcccaggaaggacaaggagaacgcggcggcgtccccgtccaaggaggcgtaccggaggctgctcgcggagaagctgctcaacaaccggacacggatcctcgccttcaggaacaagccgccggagcccgagaacgtatctttcgccgatgcggcttcctccaacctgcaggccaagcctgctaagcagcggcgccacattccccagtctgccgagaggaccctagacgccccagagcttgttgatgactactacctcaacctgcttgactgggggagcaacaatgtgctgtccattgctctgggagacacactgtacctgtgggatgcgtcgagtggatccacatccgagcttgtgaccatcgatgaggacagcggtcctattaccagtgttagctgggctcctgatggtcggcacatcgccgtggggctcaactcgtccgacgtccagctttgggacaccagctccaaccgactgttgagaacactcagaggtgtgcatgaggcaagggtaggttcactggcatggaacaacagcatcctaaccaccggtggcatggatggcaagattgtgaacaatgacgtgaggattagagaccacgttgtgcagacttacgaggggcacagccaggaggtgtgcgggctcaagtggtctggatcagggcagcagctggccagcggaggcaacgacaaccttctgcacatttgggatgtgtcgatggcatcatccatgccatctgctggccgcaaccagtggctacataggctcgaggaccacacggccgccgtgaaggcactcgcgtggtgcccgttccagagcaacttgcttgccactggcggtggtggcagcgatcgttgcatcaagttctggaacacacacactggtgcgtgcctgaactcagttgacaccggatcacaggtgtgcgctcttctctggaacaagaatgagagggagctgctgagttcacatggattcacacagaaccaactgactttgtggaagtacccatcgatggtgaagatggctgaacttactggccatacctctcgtgtccttttcatggctcagagtcctgatggatgcacagtagcgtcagctgctgcagatgagaccctccggttctggaacgtttttggagcccctgaagcgcccaagcctgctgccaaagcttcccacactgggatgttcaacagcttcaaccatatccgataggatgagtcatgaggatagtctctttctaaagcagatgatatctgcctaccatcgctaagcaggtggcatgagggagcactgcaatcctaatgcatcattttttgctttcaggagggtcagaaatcaatgacagttcgcttcgtagacgtcgtcttcatcaagtagatatctgcaatgatactggaaccagaacctcgaaatgcagagtcttagagattgaattgcagagtcggtgacttcaggaatcagaagaaaaagatgtatacccctagcctcagaggttgatagcaaatttgttacttgtcctgtgttgtgtatgctgatcattaacagtaacactctgtacaaagtataatgttttcctcctctttattgaacatcaatagcgcctatttgatgtgccaattattgttaatcaagacagcgattcttttttgcaatttttaatggaatatttgtcggttgtaaatcaagacaaccattatttttgcaaattataatttgccattttggttgcaacatcaagagaacctgtgtcagataatggaataccatgtcatttctcattaaa

SEQ ID NO: 3451 - DNA, 2198 bp, Panicum virgatum
acagctcaagcagcttctctttctctccctctcatcgcctccccacgcccatccgagcgcttggggagacgagactctgcgatattccgcctcgctcatcaaagctctcgaagttctccgcattttttttggcttaatccgcttgtttaattgtattccatcttcttcgcgtattaatctgtgattgattctaacctgctagtttacagttcgtgtttaatctcattgattctgctgtttctattactgttccgtgtcgtgcttgtcttgtacgtttgctgctgctaaccatggacgcaggttcccatccgatctcctcagagaagagccgcgtcgccgccccgcggccgccgctgcaggaggctggctcccacccctacatgccgtcgctgagcatgggatcgcgcaacccgtcggccaagtgctacggcgacaggttcatcccggacaggtcggcgatggatatggacatggcgcactacctgctaacggagcctaggaaggataaggagaacgcggcgggtgtggcggcgtccccgtccaaggaggcgtaccggaggctgctcgcggagaagttgctcaacaaccggactcggatcctcgccttcaggaacaagccgccggagcccgagaacgtctccttcgccgaggcagcttcctccaacctgcaggccaaggcagccaagcagcggcgccacattccccagtctgccgagcggactctggacgcaccagagctcgttgatgactactacctcaacctgcttgactgggggagcaacaacgtgctgtccattgctttgggagacacggtgtacctgtgggacgcatcgagtggatccacatctgagcttgtgaccgtcgacgaggacagcggtcctattactagcgttagctgggctcccgatggtcgacacattgctgttgggctcaactcgtctgacgttcagctctgggacaccagctccaaccgactgttgagaacccttaggggtgtgcatgaggcaagagttggctcgctggcatggaacaacagcattctaacgaccggcagcatggacggcaagatcgtgaacaatgacgtgaggatcaggaaccacgtcgtgcagacgtacgaggggcacagccaggaggtgtgcggcctcaagtggtctggatcagggcagcagctggccagcgggggcaacgacaaccttctgcacatttgggatgtgtcaatggcatcctccatgccatctgctggccgcaaccagtggctgcacaggctcgaggaccacatggccgctgtgaaggcgctcgcctggtgcccattccagagcaacttgctggccactggtggcggtggcagcgatcggtgcatcaagttctggaacacacacactggtgcgtgcctgaactctgttgacactggatcacaggtgtgcgctcttctctggaacaagaatgaaagagagctgctgagttcacacggattcacacagaaccaactgactttgtggaagtatccatcaatggtgaagatggctgagctcactggccatacctctcgtgtccttttcatggctcagagtcctgatggttgcacggtagcatcagctgctgcagatgagaccctccggttctggaatgtttttggagcccctgaagtgcccaagcctgcagccaaggcttcccacactgggatgttcaacagcttcaaccatatccgttaggagagtcatgaataatttctcttctgttggatatggtcccgctgtcccagtgtcctagtttacatagatcgcctctcattgatgagatctacctaattggctaagcaggcggcgtgatgggaagcattgcaatctcctaatgcattatttttcgctttcagaagggtcagcaattaaagacacagggttggcttcattgacgtcttcatcaagaagtagatgctatcctatctgcaaccatctatctgcaacaccaacaccacaggcgtgggggcaccagagcctcggagaatcaattttgttacttttcctgtcatttgtatgcccgttcactagttctgttcaatgtagaatgttttcccccttttggatgcaacatgccaacatcaagagaacatgtttgatgtggcagcagcaattgtaaatcaagacacgaccattcttttcataatatataatgaaatatttcattttcctctgccataa

SEQ ID NO: 3452 - DNA, 2404 bp, Setaria italica
gagagagaggagcgcgggggaggaaagaggagaagggtaccggtggaaaaatggaggagggggaccacttttagcacttctagtcaattttagcacctcttggagggctaatggattatggggggctaaaatttagcccctccattttagcctaggtgtttgggaggaggaggggctaaaagtgactaaaatgggggtgctaaaatttagcaccccctcccaaacacccctatattctcctccccttgcgccttggcacaatagccgttgctgtgcggcggcgttcccctccccgtctctcccctcctcgccctacaaatactcgccggcggccgatccctaaaccccacagcgcaagcgcgcagctctgctctctctttctccctctcccgtcgctcctctccgcctccccacgccgatctcgatcgctcggggagaccacgagacgcgcgcccttctctcgctcgctcatcaaagctctcgacttttttctttgagttaatcttcgcgtttcctttcgtgttcgattcactaacctgcgattaatccctgttttttttttgctgagttccattgtttctcctgttattattattattattactgttttgttgccctgtttcttctaaccatggacgtaggctcccgctcgatctcatctgtcaagagccgcgcggcggcggcgccgcggccgccgctgcaggaggctggatcccggccctacatgccgccgctgagctcgggatcgcgcaacccttcagccaagtgctacggcgacaggttcatcccggacaggtcggcgatggacatggacatggcgcactacctgctcacggagcccaagaaggacaaggagaacgcggcggcgtccccctccaaggaggcgtaccggaggctgctcgccgagaagctgctcaacaaccggacgcggatcctcgccttcaggaacaagccgccggagccggagaacgtcacgggtgctgacgcggcttcctcccaccacgccaaaccggccaagcagcggcgccacattccccagtctgcggagaggactctggatgcaccagagcttgttgatgactactacctcaacctgctcgactgggggagcaacaacgtgctgtccattgctctgggcgacacggtgtacctgtgggacgcctcgagcggatccacttctgagcttgtgactgtcgatgaggacagcggtcccatcaccagcgtcagctgggctcccgacggtcggcacattgctgttgggctcaactcgtctgatgtccagctctgggacaccagctctaaccgattgttgaggactctcagaggtatgcatgaggcaagagttggttcattggcatggaacaacagcatcctgacgaccggtagcatggatggtaagatcgtgaacaatgatgtgaggattaggaaccacgtcgtgcagacatacgagggacacagccaggaggtctgcgggctcaagtggtctggatcaggacagcagctggccagcgggggcaacgacaaccttctgcacatttgggatgtgtcgatggcatcctccatgccttctgccggccgcaaccagtggctgcacaggctcgacgatcacatggccgctgtgaaggcactggcatggtgcccattccagagcaacttgctggcaactggtggtggtggtagcgatcggtgcatcaagttctggaacacacacaccggtgcatgtctgaactctgtcgacactggatcacaggtttgcgcccttctctggaacaagaatgagagagagctgctgagttcacacggattcacacacaaccagctaaccttgtggaagtacccatcaatggtgaagatggctgaactcactggccatacctcccgtgtccttttcatggctcagagccctgatggttgcacagtagcctcagcagctgcggatgagaccctccggttctggaacgtgtttggagcccctgaagcgcccaagcctgcagccaaggcttcccacactgggatgttcaacagcttcaaccatatccgataggatgagtcccaggaacatgcacttctatcggacatggtcctgcatcaatctaatgcatcataatgaaggtcaaaattcaatggcagaattggctttgttgacgtcttcatcatcacgtcgatgatatctgcagagtctcaacgccagaacattgggatccagaacctctaatattgaattgttgcgggaggattatgtaaataccagtgattagtgttgttccatgtacatcaaagtacagtgtgttcttcccatttggacgcagcatcaataagtctgtttgatgcggcagtttgtaaattaagaaataaccattcttttcaaaaattaatggaatacttggttcttttctttcaatca

SEQ ID NO: 3453 - DNA, 2298 bp, Setaria italica
ccagctctaaacccctaaccagcaacggctatattctccgccgtctcctctccccctcgcgtactagccgttgcgctgcggtggcgttcccctcccccaactcctgctacaaatactcctcagcggccgattcctaaaccccacagcgcaagctgctcttctctctctctttctttcattctcctcgcctccccacgccgatttcaagcgcttggggggacgagatcgcgctcatcaaagctctcgacgttctttgcattttttttcgctgttaatctgctcgtttaattattctcgtattaatttgtgctcgattctaacttgctagtttttagttcgcgtttaatttcgttgcttctgctgttgctattactattctctgttgtgcttgtcttgttcgtttgttgctgctataaccatggacgcaggttccctctcgatctcctccgagaagagccgcgccgccgcgccgcggccgccgctgcaggaggcgggctcccgcccctacatgccgtcgctgagcacgggatcgcgcaacccgtcggccaagtgctacggagacaggttcatcccggacaggtcggcgatggacatggacatggcgcactacctgctcacggagcccaagaaggacaaggagaacgcggcgggtgtggtggcgtctccgtccaaggaggcgtaccggaggctgctcgcggagaagctgctcaataaccggacgcggatcctcgccttcaggaacaagccgccggagccggagaacgtctccttcgccgacgcggcttcctccaacctgcaggccaagccggccaagcagcggcgccacattccccagtctgcagagaggactctggacgcaccggagctcgttgatgactactacctcaacctgctcgactgggggagcaacaacgtgctgtccattgctttgggcgacacggtgtacctgtgggacgcatcgagcggatccacatccgagcttgtgaccgtcgacgaggacagcggtcctattactagcgttagctgggctcctgatggtcggcacattgctgtcgggctcaactcgtctgacgttcagctctgggacaccagctccaacagactgttgagaactctcagaggggtgcacgagggaagagtcggctcgctggcgtggaacaacagcatcctgacgaccggcagcatggacggaaacatcgtgaacaatgacgtgaggatcaggaaccacgtcgtgcagacgtacgaggggcacagccaggaggtgtgtggcctcaagtggtctggatcagggcagcagctggccagcgggggcaacgacaaccttctgcacatttgggatgtgtcaatggcatcctccatgccatctgctggccgcaaccagtggctgcacaggctcgaggaccacatggccgctgtaaaggcgctcgcctggtgcccgttccagagcaacttgctggccactggcggtggtgggagcgatcggtgcatcaagttctggaacacgcacactggtgcatgcctaaactctgttgacaccggatcacaggtgtgcgctcttctctggaacaagaatgagagagagctgctgagttcacacggattcacacagaaccaactgactttgtggaagtatccatcaatggtgaagacggctgaactcactggccatacctctcgtgtccttttcatggctcagagtcctgatggttgcacagtagcatcagctgctgcggatgagaccctccggttctggaatgtttttggagcccctgaagcacccaagcctgcagccaaagcttcatacactgggatgttcaacagcttcaaccatatccgataggatgagatgattactgatgatcttcttttggatatggtcccagtgttcttctagttcatatagatcgcctctcactgatgtgatctaccaaattggctaagcaggcagcttgagggaagcattgcaatccaaatacatcatttttagttttccggagggtcagaaatcaatgacacagggttgccttcgttgccgtcttcatcatcacaacatcacaggcacggagcagcataacctccacatgtagagcctgagattgaaatgcagaatcgcagagcccttgacttcggacaagacacgctgcggcctagcctcagagattacaatgcagagtccgacaattttgctacttctcctgtcatttgtaatttgtatgccagtcattagtgctgttcgatgtagaatgttttcgccttttgatgcaacatcaagagagcttgtttgatgtggcattaatt

SEQ ID NO: 3454 - DNA, 2046 bp, Pennisetum glaucum
tcgtttattctgctgttgctattactgttatctgttgtgcttgtcttgttcgtttgttgcttctaaccatggacgcaggttcccactcgatctcctctgagaagagccgcgccgccgcgccgcgaccgccgctgcaggaggcgtgttcgcgcccctacatgccgtcgctgagcacgggatcgcgcaacccgtcggccaagtgctacggagacaggttcatcccggacaggtcggcgatggacatggacatggcgcattacctgctcacggagcccaagaaggacaaggagaacgcggtgggcgtggtggcgtccccgtccaaggaggcgtaccggaggctgctcgcggagaagctgctcaacaaccggacgcgtatcctcgccttcaggaacaagccgccggaaccagagaacatctccttcgccgacgcggcttcctccaacctgcaggccaagccggccaagcagcggcgccacattccccagtctgccgagaggactctcgacgcaccggagctcgttgatgactactacctcaacctgctcgactgggggagcaacaacgtgctgtccattgctttgggcgacacggtgtacctgtgggacgcatcaagcggatccacatctgagcttgtgactgtcgacgaggacagcggtcccatcactagcgttagctgggcacctgatggtcggcacattgctgtcgggctgaactcgtctgacgttcagctctgggacaccagctccaaccgactgttgagaactctcagaggggtgcacgaggcaagagtcggctcgctggcgtggaacaatagcattctgacgaccggcagcatggacggcaagatcgtgaacaatgacgtgaggatcaggaatcacgtcgtgcagacgtacgaggggcacagccaggaggtgtgtggcctcaagtggtctgggtcagggcagcagctggccagcgggggcaacgacaaccttctgcacatttgggatgtgtcaatggcatcctccgtgccatctgctggccgcaaccagtggctgcacaggcttgaggaccacatggccgccgtgaaggcactcgcctggtgcccctttcagagcaacttgctggccaccggtggtggtggcagcgatcggtgtatcaagttctggaacacacacactggtgcatgcctgaactctgttgacaccggatcacaggtgtgcgctcttctctggaacaagaatgagagagagctgctgagttcacacggattcacgcagaaccaactgactttgtggaagtatccatcaatggtgaagatggctgaactcactggccatacctctcgtgtccttttcatggctcagagtcctgatggttgcacagtagcatcagctgctgcggatgagaccctccgtttctggaatgtatttggagcccctgaagcacccaagcctgcagccaaagcttcacacactgggatgttcaacagcttcaaccatatccgataggatgagggatgattatctcttattctcttttctgtcggatatggtcccagtgtcctaatttatgctgatcgcctctcattgtcattgcagatgtaatttccacttggctaagcaggtggcttgaggggaggattttcaatcctaatacgtcattttttaggaggagagtcagaaatcagtgacacagggttgccttcgtttgatgtcttcatcatcagagccagtgacactgacacagggtagtatagccacagggcaacataatctcgacattcagtgactgagattgaaatgcagagtcggtggctttattgacaatctgctacttctcctgtcgtatgtatgccggtcaggcggcggtcatttgtaatttgtatgccggtcaggaggtggtcagtggggttccatgtagaatgttttcccttttttggatgcaacgtcaaaaagagcttgtttgatgtggcatcaattgtaagtcaagtcacagcctttcgtttcgaaattatataaatatttattctcattttcagacaaaaaaaaaaaaaaataaagtact

SEQ ID NO: 3455 - DNA, 2154 bp, Saccharum officinarum
ctcgttcgctcactctcctcgcctccccacgacgatctcaagcgccgctcgcggggagtcgagacacgcgcacttctcgcctcgttcataagctctcttagttctccgtgtcttttttttttcgctgttaatcttcttgtttgattattacaccatcttattttgtgcttgattctaacctgttattatttagttagcgtttaatttcatcgcttccgctgttgttacttctctgttgtgcttgccctgctcttctgtttgctctaaccatggacgcaggctcccactcgatctcctcggagaagagccgcgccgtcgcgccccgcccgccgctgcaggaggcggtctcccgcccctacatgccatcgctgggctcgggatgccgtaacccgtcggccaagtgctacggcgataggttcatcccggacagatcggcgatggacatggacatggcgcactacctgctcactgagcccaagaaggacaaggagaacgtggcggcgtccccgtccaaggaggtgtaccggaggctgctcgcggagaagctgctcaacaaccggacacggatcctcgccttcaggaacaagccgccggagcccgagaacgtatctttcgccgacgcggcttcctccaacctgcaggccaagccggccaagcagcggcgccacatcccccagtctgccgagaggaccctagacgcaccagagcttggtgatgactactacctcaacctgctcgactgggggagcaacaacgtgctgtccattgctctgggagacacactgtacctgtgggatgcatcgagtggatccacatccgagcttgtgaccatcgatgaggacagcggtcctattaccagcgttagctgggctcctgatggtcggcacatcgccgtcggtctcaactcgtccgacgtccagctttgggacaccagctccaaccgactgttgagaacactcagaggtgtgcatgaggcaagggtaggttcactggcatggaacaacagcatcctaaccaccggtggcatggatggcaagattgtgaacaatgacgtgaggattagagaccacgttgtgcagacgtacgaggggcacagccaggaggtgtgcgggctcaagtggtctggatcagggcagcagctggccagcggaggcaacgacaaccttctgcacatttgggatgtgtcgatggcatcatccatgccatctgctggccgcaaccagtggctacataggcttgaggaccacatggccgccgtgaaggcactcgcgtggtgcccgttccagagcaacttgctcgccactggtggtggtggcagcgatcggtgcatcaagttctggaacacacacaccggtgcgtgcctgaactcagttgacaccggatcacaggtgtgcgctcttctctggaacaagaatgagagggagctgctgagttcacatggatttacacagaaccaactgactttgtggaagtacccatcgatggtgaagatggctgaacttactggccatacctctcgtgtccttttcatggctcagagtcctgatggatgcacagtagcgtcagctgctgcagatgagaccctccggttctggaacgtttttggagcccctgaaacgcccaagcctgcagccaaagcttcccacactgggatgttcaacagcttcaaccatatccgataggatgagtcaggaggatagtctcttctattggatatggttccagcggcctactgtttatactggatggcctgtcattgatgaaatctggctaccatggcttaagcaggtggcacgagggagcactgcaatcctaatgcatcatttttcgctttcaggagggtcagaaatcaatggtactggaaccagaacctcgaaatgcagagtcttagagattgaattgcagagtcggtgacttcagaaatcagaagtgcagataagatatatactgcccctagcctcagaggttgatagcaattttattacttgttctgtgttgtgtatgctggtcattaacagtaacactctgtacaaagtataatgttttcctccttttgattgaacatcaagagcgcctatttgatgtgccaattattgtaaatcaagacagcaattctttttgcaattcttaatggaatatttgtcagttggatgc

SEQ ID NO: 3456 - DNA, 2671 bp, Oryza sativa
atttctcccctcctcatcgctgcgcactagccgttgcgacttgcgagttgcgatcgccgccgccgcccacctcccatgtcccatcggccatcgcttcctacaaatacgctcccctgtcgagaccctaaaccccacaaagcaagcatcgcatctctcttcttctccccccctcctcgccgcctctcccctctcgtcgatccgacgcgcttgggggagtcgacgctttctcttctcgcttgctaatcaaagctctcgcataattcccgtctctgtttcgttaatttccgcttgtttcatttaattacatagtcttcttagcgtgttgatttttctgtttgatcctgtgattgatctagtttacttctagtgatctttattgctgctggtattactgctgtttgtttccttgttatttgcgtgcttgtgctcttctgtttctgctaaccatggacgcaggctcccactcgatctcgtcggagaagagccacggactcgcgccgcggccgccgctccaggaggccggctcccgcccgtacatgccatcgctgagcactgcctcgcgcaacccgtcggccaagtgctacggggataggttcataccggacaggtcggcgatggacatggacatggcgcactacctgctcacggagcccaagaaggacaaggagaacgcggcggcgtccccgtccaaggaggtgtaccggaggctgctcgccgagaagctgctcaacaaccggacacggatcctcgccttccggaacaagccaccggagcccgagaacgtctctgccgcggatactgcttctacccaccaggccaagccggccaagcagcggcgctacattccccagtctgccgagaggactctggatgcaccggacctcgtcgacgattactatctcaacctgctggactggggaagcaagaacgtgctgtccattgcgctgggcgacacggtgtacctgtgggacgcctcgagcggatccacatctgagctcgtgaccgtggacgaggacagcggcccgatcaccagcgtcagctgggctcctgacggccagcatgtcgccgttggcctcaactcttccgacatccagctctgggacaccagctccaaccgactgcttagaactctgagaggtgtgcacgaatcaagagtcggttcactcgcatggaacaacaacatcctgaccactggcggtatggacggcaacatcgtgaacaatgacgtaagaatcaggaaccatgtcgtgcagacataccaggggcacagccaggaggtgtgcgggctcaagtggtctggttcagggcagcagctggccagtggtggcaacgacaaccttcttcacatttgggatgtgtccatggcatcgtccgtcccatctgcaggccgcaaccagtggctgcacaggctcgaggatcacacggccgctgtgaaagcgcttgcatggtgcccattccagagcaacctgcttgcaactggaggtggtggtagcgaccggtgcatcaagttctggaacacacacaccggtgcatgcttgaactctgtcgataccggatcgcaggtgtgcgctcttctatggaacaaaaatgagagagagcttctgagttcacacggattcacgcagaaccagctgacattgtggaagtacccgtcgatggttaagatggctgaactcactggccatacttcccgtgtccttttcatggctcagagtcctgatggttgcacagtagcatcggctgctgcagatgagaccctgcggttctggaatgtgtttggtagtcctgaagcccccaagcctgcagccaaggcttcccacactgggatgttcaacagcttcaaccatctcagataaggatgaaccaggtgaacaaattcgtctatttgatctggtcctttggacagcttaaaaatgatcgtgctgattgagatggccttggcacaataggctgtgcaagaagagcattgcagtgcttctcatgataatgatccaatcgtttcgctttcaaacggaagatcgcaagtgagatttggcttcatcgatatcttcatctttgattggtagatactatcttcgacttcaagttcacaaagagcaccaaaaagaacctggaaatgtgcaaaaccttatcacttatcggggaatgaaatgctgagttggtgacttgagataggaatatatacttctggcaatttagttagttattctgtacattatctaaaaaaaagttagttcttctgtagagcatatgtaaagcacacacatagtatctaaaaaaattgatcttgttttaattgcgccaaaagatcaatttttgaagaatcttttggtggaaacatcaaatgatcggtttgatgtaacaaaacaagaggtgtagttcaaatatttatgtacgttcttcctccgtttcatatcatactattcaaaactagtcgtttgaccttttttagtcaaattttatctagtttgatcaatttttcaatacaaaacaaacatatttgtagtagtagtattttttgttagttcatccagagtacggacacatttgaccaaggttctaacttctcttgacagatagtagcacttgcaatttttggtcatctgaagcagtagtaaggctgaggtgccgtagtaggggataccaaaattggaaatttgattgaatttgg

SEQ ID NO: 3457 - DNA, 2443 bp, Zea mays
tcggagccgttcaggcggccacccgcaggccgcaacgcagcacaacggctttctctccctgcttccctctccctgcttccctcctgctacaaataaaaattcgtggggcggccaaaccctaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaaccatggacgcaggaacctactccatctcatcagagaagagccacacggcggcagcggcgcggccccctcttcaggaggccggcactcggccctacatgccgtcgctgagcacaggatcgcgcaacccgtcggccaagtgctacggcgataggttcatcccggacaggtcggcgatggatatggacatggcgcactacctgctcacggagcccaggagggacaaggagaacgcggtggcagcgtccccatccaaggaggcgtaccggaggctgctcgccgagaagttgctcaacaaccggacacgcatccttgccttcaggaacaagccgcctgtgtctgagaacgtctcggcagccatcacagcttcctctcaccatgccaagctggtcaagcagcgtcgacatattccccagtctgcagagaggactctggacgcaccagagcttgttgacgactactacctcaacctgcttgactgggggagcaacaacgtgctatccattgctctgggcgacacggtatacctgtgggatgcctccagtggatccacgtctgagcttgtgaccattcacgaggacagtggtcccatcaccagcgtcaactgggctccagatggccaccatatcgctattgggctcaactcatccgatatccagctctgggacaccagctccaaccgactgttgagaactctcagaggtgtgcatgaggaaagagttggctcactggcatggaacaacaacatcctcaccactggcagtatggatggcaagatcgtgaacaacgacgtgagaattaggaaccatgttgtacagacatacgaggggcacagccaggaggtgtgtgggctcaagtggtctggatcagggcagcagctggctagtgggggtaatgacaaccttctgcacatttgggatgtgtcgatggcatcccccatgtcaaccgctggccgcaaccagtggctgcacaggctcgaggaccacatgtccgctgtgaaggcactcgcgtggtgtcctttccagagcaacttgctggcaactggtggtggcggcagtgatagatgcatcaagttctggaacacacacactggagcatgtctgaactctgttaacactggatcacaggtctgtgcccttctatggaacaaaaatgagagagagctgctgagctcacacggattcacacagaaccaactaaccttgtggaagtacccatcaatggtaaagatggctgaactcagtggccatacctctcgtgtccttttcatggctcagagccctgatggttgcacagtagcatcagccgctgcggatgagacccttcggttctggaacgtatttggagaccctgaagtggccaagcctgcagccaaggcttcccacactgggatgttcaacagcttcaaccatattcgataggaacaagtcatgagaacgatcccttctgttggaaatggccgtgcatcatatgtgaggtcgattcctattgatgagatctatccacattgagtaagcacacaacatcagcgagcattgccatcatatgcatcattcagcgatgctaatcagaaatccaggatcagggccgtaaaagggttggactatatgtatctgcaacatcgcaagcaacagggaggctgtctcttcagaaattttcaagaggacgtgtcagaaacatactcaggaggccgtctcttcattcaaagagtatcttttacacgacttcttgagtataaaaaactcatttgtacaatcctacctgtctattgaattgtctttagaaaaaaaaaagagactttattgtatgtactttttttatcttttatgcctgaagaactgttttccccttttcttttagaagtaggagccggtaaagctactctttcaatttgtcacaagcattatttatttttataatttgtcctctgtttccttgatttcacatcctcttatgacatgtttggctgaagagcagaggaaaatggagcagaatcattactattttctggatgtttagg

SEQ ID NO: 3458 - DNA, 2220 bp, Zea mays
aaatcggacccaaacgcggagacgctggccggagccgtccacgccgccacgggccacggcctactacgatggtagggattccctagaggccttgaccggttgaccccgcaacggctatttttttctcctccctgacctaatgggcgtactagccgttggtcctgcggtgcggcgggcgttccggcttcgctcttgcctcttgctacaaataaccattcacggccgatccctaaaccccacaaagcaaagcagcctctctctctctgtctctctctctcgcctctctctcgcctccctctcgacgacgatctcaggcgctcgcggggagtcgagtcgagaccagcctcgttccttcataaaaagctcacttagttgttgtccccgcctctttttttcgctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgtcgccgccgcgccccggccaccgctgcaggaggcgggctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcgggcatggcggcgtccccgtccaaggaggcgtaccggaggctgctcgcggagaagctgctcaacaaccggacacggatcctcgctttcaggagcaagccgccggagcccgagaacgtttcttttgcggacacgacttcctccaacctgcaggccaagccggccaaacagcggcgccacattccccagtctgccgagaggaccctagacgcaccagagctagttgacgactactacctcaacttgcttgactggggaagcaacaacgtgctatccattgctttgggagacacggtgtacctgtgggatgcatcgagcggatccacatccgagcttgtgaccgtcggcgaggacagtggtcctgttacaagcgttagctgggctcctgatggtcggcacatggccgtcgggctcaactcgtctgacgtccagctctgggacaccagctccaaccgactgttgagaacactcagaggtgcgcatgaggcaagggtaggctcgctggcatggaacaacagcgtcttgaccaccggttgcatggacggcaagatcgtgaacaatgacgtaaggattagagaccacgtcgtgcagaggtacgaggggcacagccaggaggtctgcgggctcaagtggtccggatcagggcagcagctggccagcggaggcaacgacaaccttctgcacatttgggatgtgtcgatggcatcatccatgccatctgctggccgcaaccagtggctgcataggctcgaggaccacatggccgccgtgaaggcactcgcgtggtgcccgttccagagcaacttgctggccaccggcggcggtggcagcgaccgctgcatcaagttctggaacacgcacaccggtgtgtgcctgaactcggttgataccggatcacaggtgtgcgctctgctgtggaacaagaacgagagggagctgctgagctcacatggattcacacagaaccaactcaccttgtggaagtacccatcgatggtgaagatggctgaacttaatggccatacctctcgcgtcctcttcatggctcagagtcctgatggatgcacagtagcgtcggctgctgctgacgagaccctccggttctggaacgtttttggaacccctgaaacgcccaagcctgcagccaaagcttcccacactgggatgttcaacagcttcaaacatatccgataggatgagtcaagactattattggatattgtctatacttgacttgatgatggcctgtcgttttcggaaggtcagaaatcaatgacacagggtttgcttcagaaatcagatgtaatgttttttcctcatttttggttggaacatcaagggcgcttgtttgatgtaccaattattgtaaatcaagacagcaatatatataaattgatattttgtcggttggatttggaaattgttgtaaatcaaggcaaccgtttgtttcaacatcaagagcacttgt

SEQ ID NO: 3459 - DNA, 2286 bp, Brachypodium distachyon
cccccccccctctccctacaaatacatctcgcaatcaaatctcaaagctcacaagtcacaaagcaatctgtgtctttctctctctctctccctccctctgctcgccgccgccgaatttctagagatccctcgctgttcctcgtttcatcagatcatcttgttcgcgtgttaatttttgttcgatcgatcttaatccgcgtttaattcttcgtcttctttcgtgttgcccttacttttttgtttgctatcgtgttctgtacttctgtttcttctaaccatggatgcaggatcccgctcgatctcttccgagaagagccgcgccgccgtgcagcggccgcccctccaggaggccggatcccgcccctacatgccatcgctgagcacctcctcgcgcgacccgtcggccaagtgctacggagacaggttcatcccgaacaggtcagcgatggacatggacatggcgcactacctgctcaccgagcccaagaaggacaaggagaacatggcggcgtccccatccaaggaggcgtacaggaggcttctcgcggagaagctgctcaacaaccggacacggatcctcgccttcaggaacaagccgccggagcctgagaacaccttggctgctgacacggtttcttctcaccaggccaagccggccaagcagaggcgctacattccccagtctgccgagaggactctggacgcaccagacctcgtcgatgactactacctcaacctaatggactgggggagcagcaacgtactgtccattgcgctgggcgacacgatgtacctgtgggatgcctcgagtggatccacatctgagcttgtgacagtcgacgaggacaacggacccatcaccagcgtcagctgggcccctgatggccggcatcttgccattgggcttaactcgtctgacatccagctctgggacaccagctccagtcgactgttgagaactctgaagggtgtgcacgagtcacgggttggttcactggcatggaacaacaacatcctgacgactggcggcatggacggtaggatcgtgaacaatgacgtaaggatcagggaccatgctgtgcagacgtaccaggggcacagccaggaggtgtgtgggctcaagtggtctgggtcggggcagcaactggcaagcggtggcaacgacaaccttctgcacatttgggatgtgtctatggcgtcctccatgccatctgcaggccgcaaccagtggctgcacaggctcgaggaccacacggctgctgtcaaagcgctcgcatggtgcccattccagagcaacttgctggcaactggcggtggtggtagtgatcggtgcatcaagttctggaacacacacaccggtgcatgcctgaactctgttgataccggatcacaggtgtgcgctcttctttggaacaagaatgagagggagctgctgagttcacacggattcacgcagaaccaactgaccctgtggaagtacccttcgatggtcaagatggctgaactcactggccacacctcccgtgtccttttcatggctcagagtcctgatggttgcacggtggcatcagctgctgcagatgagaccctccgcttctggaacgtgttcggcactcctgaagtagccaagcctgcagccaaggcttcttcccacactgggatgttcaacagcttcaaccatatccgataagatgaacagcgacattctcttgaactggaagtgatcctcatgggcagctctgttgtgtacagaaatataaatgtagatgagctaaacgtacatgagctaaatgtagatgtacaaactgtggataaagaatatacggatggagccgccgcaattcggctcccggggacgtaggcacacatcgccgaacctcgttaacaaatgccccgtgtctttgttggttgtgattgctctcactttgtgcacctctgctccaaaatctttgctagctttcaggtgacatggacacttcgatatattgtgctaggcaggggagctggaggttatatatgggacatggacactcgatttatggaagtggctttccttgtcttagtgatcctgtgcaatcatcaatggatccagagttgtggcacaagtcttgcaagagccccttgaatcttaacaattttccaaatctggaaggttcaattcttccgactgcccaggataaaattgctgatcttggctgtacacatgtcattttgttagcatgttgaggaccgttgtttttattcaattaattaaattatttaccctgcctgaaattattattgcta

SEQ ID NO: 3460 - DNA, 5113 bp, Brachypodium distachyon
cctgaaagctagcaaagattttggagcagaggtgcacaaagtgagagcaatcacaaccaacaaagacacggggcatttgttaacgaggttcggcgatgtgtgcctacgtccccgggagccgaattgcggcggctccatccgtatattctttatccacagtttgtacatctacatttagctcatgtacgtttagctcatctacatttatatttctgtacacaacagagctgcccatgaggatcacttccagttcaagagaatgtcgctgttcatcttatcggatatggttgaagctgttgaacatcccagtgtgggaagaagccttggctgcaggcttggctacttcaggagtgccgaacacgttccagaagcggagggtctcatctgcagcagctgatgccaccgtgcaaccatcaggactctgagccatgaaaaggacacgggaggtgtggccagtgagttcagccatcttgaccatcgaagggtacttccacagggtcagttggttctgcgtgaatccgtgtgaactcagcagctccctctcattcttgttccaaagaagagcgcacacctgtgatccggtatcaacagagttcaggcatgcaccggtgtgtgtgttccagaacttgatgcaccgatcactaccaccaccgccagttgccagcaagttgctctggaatgggcaccatgcgagcgctttgacagcagccgtgtggtcctcgagcctgtgcagccactggttgcggcctgcagatggcatggaggacgccatagacacatcccaaatgtgcagaaggttgtcgttgccaccgcttgccagttgctgccccgacccagaccacttgagcccacacacctcctggctgtgcccctggtacgtctgcacagcatggtccctgatccttacgtcattgttcacgatcctaccgtccatgccgccagtcgtcaggatgttgttgttccatgccagtgaaccaacccgtgactcgtgcacacccttcagagttctcaacagtcgactggagctggtgtcccagagctggatgtcagacgagttaagcccaatggcaagatgccggccatcaggggcccagctgacgctggtgatgggtccgttgtcctcgtcgactgtcacaagctcagatgtggatccactcgaggcatcccacaggtacatcgtgtcgcccagcgcaatggacagtacgttgctgctcccccagtccattaggttgaggtagtagtcatcgacgaggtctggtgcgtccagagtcctctcggcagactggggaatgtagcgcctctgcttggccggcttggcctggtgagaagaaaccgtgtcagcagccaaggtgttctcaggctccggcggcttgttcctgaaggcgaggatccgtgtccggttgttgagcagcttctccgcgagaagcctcctgtacgcctccttggatggggacgccgccatgttctccttgtccttcttgggctcggtgagcaggtagtgcgccatgtccatgtccatcgctgacctgttcgggatgaacctgtctccgtagcacttggccgacgggtcgcgcgaggaggtgctcagcgatggcatgtaggggcgggatccggcctcctggaggggcggccgctgcacggcggcgcggctcttctcggaagagatcgagcgggatcctgcatccatggccagcggagggtgtggggaaggagcagaggaggaggagggggaggagggggaggaggaggacgacgacgaggaggctctaggagtctcgcgggagaagcttctagaagctgccggaggcggagcgagggcgagggctgcgcgatctcgccggaactagcagcctgaggaggaggcgctggggagggagtctcccagatgccggcgccctccttgatttgaatggaaggcagatctcgagggcgagggaagcttctagaagcgggttgaggagacacggttagccgttagggtttgccttggcggtaggaggcggcggggcgggatggggggaggctcggagggaggaggagacggggaggagggctgctgcagcgtcggggacacctcgccggggaccatcgtttgggtgcggcggaggaacgggtcgtggtggccgggcaggatcctggggcaagacgagctaccaccgtcacagatcatgtctccaaggtccggcacgccggtcaagcttctcggccgcgaggacgccagcgttgactggtacaaccttgagaaatcaaagcgtgttaaagcttttcggtgtggggagtttgatgcctgtattgaaagggcagaggctactcaaggtactcttgcaaagaaaagagagaaatatgcacggagggaagatgctatccttcacgctcttgaattagagaggaaactgcttgcgtctaagcatcagactcaaggtttcagacctgcctacttttctgcctgcacaaaacatcgcaaagaccttggaagtactcgctacaagagcaaaaagaggaaaaggaaagatgtatctgctctccctgatacaaaaaaagaagccgaccagtattttctgcatgctggttcaaagaaaaacttttcagggtctctttctcagggaactactgagaatcttaccagtaatcacctcggcgacttatccaatgcgagacatattcagggaggggccagttcagagagcaaggagaaatatacagttgtgaaaaagaacaggtcggatggaagcgattttgatgaatctattgaaaaaggtgtcaggcgccggccacttgttcaagttctgcagagtagtacaaaattaccgcagcactcacggcacaatgatgattatggggccatcttaattggggcagataaggatccatcacctgccacctaccgggctaaaagaagtagatacacatacctgcctagtgattctggtgaaactcatagtcttagtgatctaccttctgcacaaatagcttctacaggaaccgattttgagacggaaagttatctccagcatccaaattgttcttctgaggagcatacatcttcagactttgttgagaagcacatatccgagtcttcagagagggaatgctcagaaagtgagacagaagatgatgccgagcttttgcaaagtgctaatatgattctgcctccagagttacgtccccgtgatccttatttccttcgggcttctgacaagtttggacatgcggataataatggtgatgaggcgaactattctacgtattcacatcaattgaatgaatcagaagaagaggatggttattctgagcatggtgtctctcagtggcatatgaaaggtaaacgtaataaccgtggtgcagtgaagagatcaatgcctatgacagatggaaattcttgtttggacaaacccaatggtctcacaaaaggatctgtgtacaagacaaatggtataaatcatagaaaagagagtgtgcaaacatccaatcagcaattgcttaggcaccaaatcaaagaggagtccaactatgattctgatgaaacagatttatttgaggacacgagccgtacagaggttaacttgtatcatagtagaacgtacccgtcctccttgaaggctactagggatcttagccggagctacatttattatgatgactacgaaaatgattcttccaagatttctcctgttaactgtgatgcaggtcagatatttcgtgttgatcggaatgcatactgggacagaccttcattttaccaaagaaattacagttcacgccttggtggcttgggcccaatgttgtttgatgttgacttgaaggtccaagccagctaccatggagagcatgttcctcttgtttccttgatgagcagactggatggcaaagcaattgttgggcaccccatccaaattgaaatacttgaagacggtaccactgatcacctggtttctggtggtgatattagtatggaagagagtacaggaactccgcctgcttggcgtacaggcaggaggactgccatgcaaagagttccccgttctaatccttcaggagcatcattggatggtgacaatgaaggcgggcttgcatatccagactgggagatgaaaccagtagtcagaaaatactcaacatcaaatcaccaggttaaggttaataagaaaatcgtgtcaaatcctaggagagcatcggtgtccaagtctcagaagaaaccatctaagaaagcaagcttatcaagccaaaaggtcagaaccatctcttccatttctactggaagaaggcaaaacagaggtggtggtcagcatagccgcagcagcatttttggtggcttgatcaaagcagagggaacaattcccctagtaacatgtgtccctgcaaaggttgtgttcactaggatactggaagcagttggcaggccacttctgactgttactcaccgtgttagaatggatagtcatgcagtacaagatccatcataggcatcaactgcaatgcaaaatatgtttggtactggtgtcctcaagtttcatgtacatttatgttaactgaagagacaagttattcagtcatttggaatacaccagtgaggaggacgattgacatggttgtttcatgataacacgtaacagctgcactcatcaacattggtgagtagtgacaacatgtaaagagcaatggcacttatatactgttaactggaggttgagatcaattaggctctcaacacgagtacttcttggttctcgcacagcagtcgagccagcgactccaccaagcggggcatccttggaagggtgactagtggtagtgaccaccgcttttggcattgctgtctcctgtaaagtactaacctacgcattttaggatgtctatctatataaatttatgcatcatctaatagtcaataggccataggtttcctgatgtcatgtataattcctcaattgtaatctgatcaaatctacctgttattttgttgtggaggattaatcggttcatcaagtgtaactgtgtaagttcagaagaatgtgtagcaaatcgatgtaatatactaccagagaacaattacaccagatgatgtcaacagtgtggttttctttgtgaagtttctgtgattactatgttcaaa

SEQ ID NO: 3461 - DNA, 1940 bp, Secale cereale
atccgggggagacgaatccctctcgctctcgaaagatccgctcgttcaatcgcggcatcccgttcttgtgctaattttcgcccgatcgatccgccgatccgcgtttgcttctgcagttccgcgccggcttttcttgttgcgattactgttattatttgtttgcctgttctttttcttctgttctaaccatggatgcaggctcccgctcgatctcctccggcaagagtcgcgccgccgcgcagcgcccgccgctgcaggaggccggatccgcccctacatgccgtcgctgagcacgcgcaacccgtcggccaagtgctacggagacaggttcatcccggaccggtcggcgatggacatggacgtggctcactacctgctcacggagggcaagaaggacaaggagaacgcagcggcatccccgtccaaggaggcctaccggaggcttctggccgagaagctgctcaacaaccggacgcggatcctcgccttcaggaacaagccgccggagcccgagaacgtgtttgctgccgacacggtttcttctcaccaggccaagccggccaagcagaagcgctacattccccagtctgcctagaggactctggatgcaccggacctcgtggacgactactacctcaacctcatggactgggggagcagcaacgtgttgtccattgcgctgggcgacaccatgtacctgtgggacgcctcaagtggatccacatctgagctcgtgacagtcgaggaggacaacggccccatcaccagcgtcagctgggctcctgatggccggcatcttgctattgggctcaactcgtctgacatccagctctgggataccagctccagccgcctgttgagaactctgaaaggtgtgcacgagtcaagggtcggttctctggcatggaacgacaacatcctgacgactggcggcatggacggcaggatcgtgaacaacgacgtgaggatcagggaccatgccgtgcaggcgtaccgaggggcacagccaggaggtgtgcgggctcaagtggtctggctcagggcagcaactggcgagcggtggcaacgacaaccttttgcacatttgggacgtgtcgatggcatcctccatgccgtccgccggccgcaaccagtggctgcacaggctcgaggaccacacggccgccgtgaaggcgctcgcatggtgcccattccagagcaacctgctggcaactggcggtggcggtagcgaccggtgcatcaagttctggaacacacacaccggtgcatgcctgaactctgttgataccggatcgcaggtgtgctctcttctgtggaacaagaatgagagggagctgctgagctcacacgggttcactcagaaccagctgacattgtggaagtacccttccatggtcaagatggctgaactcactggccatacctcccgcgttctcttcatggcacagagtcctgatggttgcacggtagcgtcggcttctgcggacgagaccctccgcttctggaacgtgtttggcactcctgaggtggccaagcctgcacccaaggcttcccacaccggcatgttcagcagcagcttcgcccatatccgatgagacagcaacgaggacaatctcttgaactggatatggtcctatgggcagctgtgtacagaaaataggctaaatacctgggtatatatactgccgatgtactgactttactgtggataaaggaaatatacggatggagccgccgcaatccggctcccggggacgtaggcacattgccgaacctcgttaacaaatgctttgtgtcttttgttggctgtgtttgcttttactttgtgtgcatccagaataggcttccggaatcgccctctgcttagccgacggccatcgagctcatatgcttctttcctgtaattaggaactgaacctgaatcttatttgactttaaac

SEQ ID NO: 3462 - DNA, 3081 bp, Brachypodium distachyon
taatcatttggttccaaggcaaacggtggttctaaatgtttggttactaaaacacaaagagatagaacagtttcgttacattccactccaattaaaatagaacaattacattctttcaccttattcatcaaccaaaccctaccttaatcagaaacaaacactagaccagcagcaaccctggaactttgcctgcaacggctgtactcctctcttcctcggaatatttagccgttgcgagctttacggctgccatccctacaaatacatctcgcaatcgaaacctaaagctcacaagtcacaaagcaatttgtgtctttctctccttctctccccccctgctcgccgccgcctcccctcgccgatccgggggagacgagactctctagatccctcgctgttcctcgtgtttgaccagatcctcgttaatttctgttcgatcgatcttaatacgcgtttcaattcttcgtcgtctttcctgttaccgttagttttcttcttgttattttgttctgctctgtttcttctaaccatggatgcaggataccgctcgatctcttccgagaagagccgcgccgtgcagcggccgcccctccaggaggccggatcccgcccctacatgccatcgctgagcacctcctcgcgcgacccgtcggccaagtgctacggagacaggttcatcccgaacaggtcagcgatggacatggacatggcgcactacctgctcacggagcccaagaaggacaaggagaacatggcctcgtccccatccaaggaggcctacaggaagcttctcaccgagaagctgctcaataacaggacgcggatcctcgccttcaggaacaagccgccggagcctgagaacatcttggctgctgacacggtttcttctcaccaggccaagccggccaagcagaggcgctacattccccagtctgccgagaggactctggatgcaccagaccttgtcgatgactactacctgaacctaatggactgggggagcagcaacgtgctgtccattgcgctgggcgacacgatgtacctgtgggaggcctcgagtggatccacatctgagcttgtgacagtcgacgaggacaagggacccatcaccagcgtcagctgggcccctgatggccggcatcttgccattgggcttaactcgtctgacatccagctctgggacaccagctccagtcgactgttgagaactctgaagggtgtgcatgagtcaagagttggttcactggcatggaacaacaacatcctgacgactggcggcatggacggtaggatcgtgaacaatgatgtaaggatcagggaccatgccgtgcagacataccaggggcacagccaggaggtgtgtgggctcaagtggtctgggtcagggcagcaactggcgagcgggggcaacgacaaccttctgcacatttgggatgtgcctatggcgtcgtccatgccatctgcaggccgcaaccagtggctgcacaggctcgaagaccacacggctgctgtgaaggcgctcgcatggtgcccattccagagcaacttgctggcaactggcggtggcggtagcgatcggtgcatcaagttctggaacacacacaccggtgcatgcctgaactctgttgataccggatcacaggtgtgtgctcttctttggaacaagaatgagagggagctgctgagttcacacggattcacgcagaaccaactgactctgtggaagtacccttcgatggtcaagatggctgaactcactggccacacctcccgtgtccttttcatggctcagagtcctgatggttgcacggtagcatcagctgctgcagatgagaccctccgcttctggaacgtgtttggcactcctgaagtagctaagcctgcagccaaggcttcgcacactgggatgttcaacagcttcaaccatatccgataaggtgaacaacgagaacaaccataggatcctcagcagcttgtgtatatggccggctatatgctatttagacaatctgaggccaaaaaccttctccaccagcttgtgtatatgctcgtgtacaagtagacgatgtccaaattcacctcaacgacgtccaaatccatcgcgcttgccacgggggagtccgaggagggagggggtgccgctgattccggagcgcagccccagggttgggggaggcaggggcgccgctgcctaggagatggaggaggagagggggcgccgccacgggagagatggaggaggggaggggtgctgctgccgctgctcttggccggtgaggaagaaggggctgcttgagggagatggaggatgggagggaggccgccgatgggaggatgtgccggtgctgtgctgctcgtgggaggaagggggtggaggagggcaggggcactgccgatgggaggaaggagtattatgacataggagagataatatacacaacctagatatagacaagctgatggaaaattagaagatgttgagaaagaatctttttagacattgtctatatgaaccaaatatacacaatgtgctgaggatgctctgagttcaacagcttcaactatatccgataaggtggacaacgagaacaatctgagatatgatcccacggactactctgctctctgctgtgtacagaaaatatatgtagatgggctaaacgtcctgagactgatgatgtacaaactgtggataagagaatatacggatggagccgccggctcccggggacgtaggcacctcgccgaacctcgttaacaaatgctctgtctctttgttggttgtgattgctttcactttgtgctctgctccaatcctggtgttcgggactggaccaaaatctttcctagctttcagattcaaggcctcaaaccaaattacagagacttatgtgttcctacttagtacatgcttcctcggagatctgcttcattccggctattttggcagttatttcttctgtaaagtagtgtatatattgaggcctgaaaccaaacaaaggatcagtttgatgccagccatttgaacgtttctgttgtcacacagagagatgtaaaccgcagcacattttctattgcctc

SEQ ID NO: 3463 - DNA, 1912 bp, Triticum aestivum
tgttcatccgatcgatctgctgatccgcgttcctgttgcagttcctgttgcgatttctgttgtttgtttgtttcttctgtttcttctaaacatggacgcaggatcccactcgatctcttccggcaagaacagcgccgccgcggtgcagcgcccgccgctccaggaggccggatcccgcccctacatgccaccgctcagcacaacctcgcgcaacccggcggccaagtgctacggggacaggttcatcccggaccggtcagcgatggacatggacatggcgcactacctgctcacggagaccaagaaggacaaggagaacgcggcggccatcgcggcgtccccctccaaggaggcgtaccggaggcttctcgcggagaagctgctcaacaaccggacgcggatcctcgccttcaggaacaagccgccggagccggagaacgtcttcgctgccgacacggtttcttctcaccaggccaagccggccaagcagaggcgctacattccccagtctgccgagaggactctggatgcaccggacctcgtcgacgactactacctcaacctgatggactgggggagcagcaacgtgttgtccattgctctgggcgacaccatgtacttgtgggacgcatccagtggatcaacatctgagcttgtgacagttgaggaggacaatggccccatcaccagcgtcagctgggctcctgatggccgccatcttgctattgggctcaactcgtctgacattcagctctgggacaccagctccaaccgcctgttgaggactctgaaaggtgtgcatgagtcaagggtcggttcgctggcatggaacaacaacatcctgacgactggcggcatggacggtaggattgtgaacaacgacgtaaggatcagggaccatgccgtgcagacgtaccaggggcacagccaggaggtgtgcgggctcaagtggtcaggctcagggcagcaactggcgagcggtggcaacgacaaccttttgcacatttgggacgtgtcgatggcatcctccatgccgtccgcaggccgcaaccagtggctgcacaggcttgaggaccacatggctgcggtgaaggcgctcgcatggtgcccattccagagcaacctgctggcaactggcggtggcggcagcgaccgctgcatcaagttctggaacacacacaccggtgcatgcctcaactctgttgatactggatcgcaggtgtgctcccttctgtggaacaagaatgagagagagctgctgagctcacacggattcacccagaaccagctgacattgtggaagtacccttccatggtcaagatggctgaactcactggccatacctcccgtgtcctcttcatggcacagagtcctgatggttgcacggtagcatctgctgctgcagacgagaccctccgcttctggaacgtgtttggcactcctgaggtaaccaagcctgcacccaaggcttcacagtccggcatgttcagcagcagcttcgcccatatccgatgaagacaacaacgtgaacaatctcttgaactggatatggttctatgggcagctgtgtagtgtacagaataataggctaaatacgtgggtatatactgctgatgtactgacttcactgcctcctgtgtcttttgttggcctgtgtttcctttactttgtgtgcattcatctcatccagaaaaggtttagaggtcatgttcttccagaatcgccctttgctgagcagagggcctttccgtaattaacctccactcttcagaaactgaacataagtacacatcgtataagatcgatctcattctcatcgttgctggttacctgtaacttgagataagatccattcgtttgatgtaaaaattctcttataactgacctaatttgttgtcattcggttgaatc

SEQ ID NO: 3464 - DNA, 2937 bp, Triticum aestivum
cgattactgttatttgtttgcctgttctttttcttctgttctaaccatggatgcaggctcccgctcgatctcctccggcaagaaccgcgccgccgtgcagcggccgccgctccaggaggccggatcccgcccctacatgccgtcgctgagcacgcgcaacccgtcggccaagtgctacggagacaggttcatcccggacaggtcagcgatggacatggacgtggcgcactacctgctcacggagggcaagaaggacaaggagaacgcagcggcatccccgtccaaggaggcctaccggaggcttctggccgagaagctgctcaacaaccggacacggatcctcgccttcaggaacaagccgccggagcccgagaacgtgtttgctgccgacacggtttcttctcaccaggccaagccggccaagcagaggcgctacattccccagtctgccgagaggactctggatgcaccggacctcgtcgacgactactacctcaacctaatggactgggggagcagcaacgtgttgtccattgcgctgggcgacaccatgtacctgtgggacgcctcaagtggatccacatctgagctcgtgacagtcgaggaggacaacggccccatcaccagcgtcagctgggctcctgatggccggcatcttgctattgggctcaactcgtctgacatccagctctgggacaccagctccagccgcctgttgagaactctgaaaggtgtgcatgagtcaagggtcggttcgctggcatggaacaacaacatcctgacgaccggcggcatggacggcaggatcgtgaacaacgacgtgaggatcagggaccatgccgtgcagacttaccaggggcacagccaggaggtgtgcgggctcaagtggtctggctcagggcagcaactggcgagcggtggcaacgacaaccttttgcacatttgggacgtgtcgatggcatcctccatgccgtctgcaggccgcaaccagtggctgcacaggctcgaggaccacatggccgctgtgaaggcgctggcatggtgcccattccagagcaacctgctggcaactggcggtggcggcagcgaccgatgcatcaagttctggaacacgcacaccggcgcatgcctgaactctgttgataccgggtcgcaggtgtgctctcttctgtggaacaagaatgagagggagctgctgagctcacacgggttcactcagaaccagctgacattgtggaagtacccttcgatggtcaagatggctgagctcactggccatacctcccgcgttcttttcatggcacagagtcctgatggttgcacggtagcgtcggcttctgcggacgagaccctccgcttctggaacgtgtttggcactcctgaggtggccaagcctgcacccaaggcttcccactccggcatgttcaacagcagcttcgcccatatccgataagacgaacaatgcgaacaatctcttgaactggatatggtcctatggaccgctgtgttgtgtgtacagataacaggctaaatacctgggtgtatataccgctgatgtactgcctaaactgtggataagataatatacggatggagccgccgaaattcggctcccggggacgtaggcacattgccgaacctcgttaacaaatgcctgtcatttcaattctgagttgtgctgtctttgtgtctgacttgggttatatagaacagaaaaaatcgtcaacagattgaagactgctaatggtgttgtcgtgaactacaggttatggctgggtagtgcaccaccagatcggatgccatgcccttccagaatgagtgctatggagaagtcgatccgcaaatacgcggaggagccaacaaagagtgtaataaggcctgagcttggactgaattgaaacggcggcgtacaatgtcactgaaatagagaagatgaggaagtatgtcatagtgcccaacaatgcagcaaaaagggagaaatggagcagggttgagtatgaggtgaacataagtgaagacaaagaagaatttacgtgtgaatgtggacagttcaagcacactgggatgttatgctgccatgttctaagggtgatggaaatacttcatgctgaggaaatcccggctaatcatatattgaagcggtggacaaacgacgtgagggacatactaccccaacatctggttcagtaccagagagatgatccagttaacctgtcattcacgtgtaggcactccaccttgtacttgaaagccatggatgtagaggctttcgatcacacttatgttggtttggatgctttaatggtgagtggagcacctttcgccgagaggagggatggtctgggttttgaagaccgcatggcctgcttagttcctggtacattacctgggaacggagagattgcttgtgttggcaagcaacgaaattgccgaaaaatgcattagcactgcgaactctgtcagtgtgaatgctctgcatgggctaacagtaccagagaagcagagaggggtcgggagaccgacaaactgcagggagaaggcaccgtatgaggggctgagcaagcgtacaagattctgcaacatatgtagtcgagagggcgataagcggactatgtgtcctgaaagaggggatgcacccaaaaaaccgcggaggcctaggaagtgcgagaattgtggcatggaaggacatcgtcggaccacttgcactaggcggatgggtgttgctgaaacatgaaaactgaattttgataatctgtagttccgaggattttctggtgtgtttttgtgagctttgctccacgcttgttcctcagtttgaagagacacgtcatagactgtaaatataggtttgtttcttaataatttgtggcatgcatttggcacactgtaacttaagtgtcaaattaaaatatttggtaggacatgttcaatgtgcca

SEQ ID NO: 3465 - DNA, 1823 bp, Hordeum vulgare
gatccccgtttctcgtcggcgtgctgatttgattgttcttcctgttgcgattttctgctgtttgtttgtttgtttgtttcttgtttcttctaaccatggacgcaggctcccactcgatctcctccagcaagagcagcgccgccgccgtgcagcgcccgccgctccaggaggccggctcccgcccctacatgccaccgctcagcaccacctcgcgcaacccgtcggccaagtgctacggagacaggttcatcccggaccggtcagcgatggacatggacatggcgcactacctgctcacggagaccaagaaggacaaggagaacgcggcggccatcgcggcgtccccgtccaaggaggcctaccggaggcttctcgcggagaagctgctcaacaaccggacgcggatcctcgccttcaggaacaagccgccggagccggagaacgtgtttgctgccgacacggtttcttctcacctacaggccaagccggccaagcacaggcgctacattccccagtctgccgagaggactctggatgcaccggacctcgtcgacgactactacctcaacctgatggactgggggagcagcaacgtgttgtccattgcgctgagcgacaccatgtacttgtgggacgcctccagtggatcaacatctgagcttgtgacagtcgaggaggacaacggccccatcaccagcgtcagctgggctcctgatggccgccatcttgctattggactcaactcgtctgacattcagctctgggacaccagctccaaccgcctgttgagaacactgaaaggtgtgcatgagtcaagggtcggttcgctggcatggaacaacaacgtcctgacgactggcggcatggacggtaggatcgtgaacaacgacgtaaggatcagggaccatgccgtgcagatgtaccaggggcacagccaggaggtgtgcgggctcaagtggtctggctcagggcagcaactggcgagcggtggcaacgacaaccttttgcacatttgggacgtgtcgatggcatcctccatgccgtctgcaggccgcaaccagtggctgcaccggcttgaggaccacacggccgctgtgaaggcgctcgcgtggtgcccattccagagcaacctgctggcaactggtggtggcggtagcgaccgctgcatcaagttctggaacacgcacaccggtgcatgcctgaactctgtcgatactggatcacaggtgtgctcccttctgtggaacaagaatgagagagagctgctgagttcgcacggattcacgcagaaccagctcacattgtggaagtacccttccatggtcaagatggctgaactcactggccatacctcccgtgttcttttcatggcacagagtcctgatggttgcacggtagcatctgctgctgcagacgagaccctccgcttctggaacgtgtttggcactcctgaggtagccaagcctgcaccaaaggcttcacactccggcatgttcagcagcagcttcgcccatatccgataagacgaacaatgcgttctcttgaactcatggcttcacactccggcatgttcagcagcagctttgcccatacgataagacgaacaatgccaacaatctcttgaactcatggtcctatgggcagctgtgtgtgtacagaaaataggctaaatacctgggtatatactgctgatgtactgactttactgtggataaggaaatatacggatggagccgccgcaattcggctcccggggacgtaggcacattgccgaacctcgttaacaaacgcttgcgtcttttgttggctgtgattgctacttt

SEQ ID NO: 3466 - DNA, 2192 bp, Setaria italica
accaagaagccctccccgccgcctaagcaaaatcctcccccctccctcctctcggctcccgatctcatcgtcctccgtcgccgccagcgaatccagcgagcgatcggggggacgacgccgtctcgcgaccaaagctctccgagatcccaggctcctctcctcccccttttcgagtctctttgattggattgtctgctgcgtgtgccggtctagtagaagaaaaaaaatctgattgtttctctgagttgaatcgttagtttcgttctggtttcttgttctttggtactagagtagaatctttgcggtaggatacttttgcgtgaatcctgtttctgtgtagttacattgctcgtgttgatttctgcgttgatcttgttcgtggcggtagtagtagatcccttctactagctgcggcgtgctctgtttacttgttcttgttgctcctagttctaacccatggacgcaggatccaactccatctcgtcgcagaagtgcggcagccgacgcgcggcgccgccgcggccggcgctccaggaggcagggtccaggccgtacatgccgccgctcagcacggggccccgcaacccgtcggccaagtgctacggcgacaggttcatcccggagcggtcggcgatggacatggactttgcgcattacctgctgacggaaccgaggaagggcaaggagaacccggcagcggcggtgtccccggccaaggaggcgtaccgcaagctgctggccgagaagctgctcaacaaccgcaccaggatactcgccttccggaacaagccgccagagcctcagaacgtgctcacggatctccgttctgatgtggtccaagccaagccggcgaagcagcgccgacacattccccagtcttcagagaggactctggatgcgccagagctcgctgacgattactacctcaacctgctagattggggaagcagcaatgtgctgtccattgcgctaggcagcacggtgtacctctgggatgcctccagtgggtctacttctgagcttgttaccattgatgaggactttggtcctgtcacaagcgttagctgggctcctgatggccggcacattgctgtaggactgaactcctctgatgtccagctttttgacactacctcgaaccgactgctgaggacactgcgaggtgtgcatgagttgagggttggttctatggcatggaacgacagcatcttgacaactggtggcatggacggcaagatcgtgaacaatgatgtgaggatcaggaacagtgttgtgcagacataccatggacatgagcaggaggtgtgtgggctcaaatggtcaggatcagggcagcaactggccagtggtggaaatgacaacctcctacacatctgggatgtgtccatgtcatcctctgtgcagtctgcagggcgtacgcaatggttgcacaggcttcaggatcacttggctgccgtgaaggcactggcatggtgcccattccaaagcaacctgctggcttctggcggtggtgggggtgatcgctgcatcaagttctggaacacccacactggtgcatgcctcaactcagttgacactggatcgcaagtgtgcgcactgctctggaacaagaatgagagggagctgctaagctcacacgggttcactcagaatcagctcaccctgtggaagtacccatcgatggttaagatggccgaactcaatggccatacctcccgcgtcctgttcatggctcagagccctgatggatgcactgtggcatctgctgcagcagatgagacattacggttctggaatgtgtttggaactcctgaagcggcgcctaaggctgcagccaaggcttcccacactgggatcttcaatagcttcaaccatatccgatgaagaaatggcatcattgttccaaagagaccttccagaacctccagacctgttaataggaacgaggcccttcaacgtcatcgccaaaacaccatcgagctgatgtccaatagaagagagcatcatacacatttacagtagttgacatgtgtacagtagttgactattttgggttttctagcgctataatcacatttacattatatgtctccttggtatgctggtaacactggttgctggtccataatattgtacatacagttttatataaaaaaaacttctataatatttccgtgttttacacttaacag

SEQ ID NO: 3467 - DNA, 2222 bp, Panicum virgatum
cctcccgtataatctcccccacggatccaaccaaaaaaaccccacctgaaagaaaacctccccgccgcctaagcaaaatcctccccttctctcggctcccgatctcgtcgtccttcgtcgccgccagcgaatccaccgggcgataggggggacgacgccgtctcgcgaccagagctttccgagatcgcccgcgctttctcttcttcccttttcgactctctttgattgaattgtctgctgcgtgtgccgatcttgaaaaaaaaatctatttgatttcctagttgaatcgttggtctcgctttggtttcttgttctttggtactagatagaatcgttgcggtagggtacccttgcgtgaatcctgtttctcgctcgtggtggtagtattagatcccttatactagctgcggtgtgctttgtgtttcctggttcgtgttgcttctggtgaaagatctagcccatggacgcaggatccaattccatctcgtcgcagaggagcggcagccggcgcgcggcgccaccgcggcctgtgctccaggaggccgggtcgaggccgtacatgccgccactcagctcggggccccgcaacccgtcggccaagtgctacggcgacagattcatcccggagcggtcggcgatggacatggacttggcgcactacctgctgacggagccgaggaagggcaaggagaacccggtggcggcgtcccctgccaaggaggcgtaccggaagctgctggccgagaagctgctcaacaaccgcaccaggatcctcgccttccggaacaagccgccggaacctgagaacatgctcacggatctccgttctgatgcggtccaagccaagccggcgaagcagcgccgacacattccccagtcttcagagaggactctggatgctccagacctcgttgacgattactacctcaacctgctagactggggaagcagcaatgtgctgtccattgcgctgggcagcacggtgtacctctgggatgcctctagtggatctacgtccgagcttgttaccgttgatgatgactatggtcctgtcacaagcgttagctgggctcctgatggccggcacattgccgtaggcctaaactcctctgatgtccagctttgggacaccacctcgaaccgactgctgaggacacttcgacgtgtgcacgaattgagggtcggttctctggcatggaacaacagcatcctgacaactggtggcatggacggcaagatcgtgaacaatgatgtgaggatcaggaacaatgttgtgcagacatatcatgggcatgagcaggaggtgtgtgggctcaaatggtcaggatcagggcagcaactggccagtggtggaaatgacaaccttctacacatctgggatgtgtccatgtcatcctctgtacagtctgctgggcgtacccaatggttgcacaggcttcaggatcacttggctgccgtgaaggcactggcatggtgcccattccagagcaacctgctggcttctggcggtggtgggggtgatcgctgcatcaagttctggaacacccacactggtgcatgcctcaactcagttgacactggatcgcaagtgtgcgcgctgctctggaacaagaatgagagggagctgctgagctcacacgggttcactcagaatcagctcaccttgtggaagtacccgtcgatggttaagatggccgaactcaatggccatacctcccgcgtcctgttcatggctcagagccctgatggatgcactgtggcatctgctgcagcagatgagacattgaggttctggaatgtgtttggaactcctgaagcggcgcctaaggctgcagccaaggcttcccacactgggatcttcaacagtttcaaccacatccgatgaagaaatgacattattgttctaaagaagaccttccagagactccagacctgttgataggaatgtgccctttaatataccaccaaaacaccatcgagctgatgttccacaaaagagatcatcatacactatagcaataatcttgtgttgacatgtgtacatctgttgactatttcgggttactagcgttgtaatcagatttacattacatttctctttggtatgctggtaacgctggttgctggtccataatattgtacgttgctgatccgtaatactgtacataaagttttgatataaaaagcttatataatatttatgtgtttcatacttagcagtt

SEQ ID NO: 3468 - DNA, 2186 bp, Panicum virgatum
ccaaaaaaaccccacctgaaagaaaacctccccgccgcctaagcaaaatcctccccttctctcggctcccgatctcgtcgtccttcgtcgccgccagcgaatccaccgggcgataggggggacgacgccgtctcgcgaccagagctttccgagatcccccgcgctttctcttcttcccttttcgactctctttgattgaattgtctgctgcgtgtgccgatcttgaaaaaaaaaatctatttgatttcctagttgaatcgttggtctcgctttggtttcttgttctttggtactagatagaatcgttgcggtagggtacccttgcgtgaatcctgtttctcgctcgtggtggtagtattagatcccttatactagctgcggtgtgctttgtgtttcctggttcgtgttgcttctggtgaaagatctagcccatggacgcaggatccaattccatctcgtcgcagaggagcggcagccggcgcgcggcgccaccgcggcctgtgctccaggaggccgggtcgaggccgtacatgccgccactcagctcggggccccgcaacccgtcggccaagtgctacggcgacagattcatcccggagcggtcggcgatggacatggacttggcgcactacctgctgacggagccgaggaagggcaaggagaacccggtggcggcgtcccctgccaaggaggcgtaccggaagctgctggccgagaagctgctcaacaaccgcaccaggatcctcgccttccggaacaagccgccggaacctgagaacatgctcacggatctccgttctgatgcggtccaagccaagccggcgaagcagcgccgacacattccccagtcttcagagaggactctggatgctccagacctcgttgacgattactacctcaacctgctagactggggaagcagcaatgtgctgtccattgcgctgggcagcacggtgtacctctgggatgcctctagtggatctacgtccgagcttgttaccgttgatgatgactatggtcctgtcacaagcgttagctgggctcctgatggccggcacattgccgtaggcctaaactcctctgatgtccagctttgggacaccacctcgaaccgactgctgaggacacttcgacgtgtgcacgaattgagggtcggttctctggcatggaacaacagcatcctgacaactggtggcatggacggcaagatcgtgaacaatgatgtgaggatcaggaacaatgttgtgcagacatatcatgggcatgagcaggaggtgtgtgggctcaaatggtcaggatcagggcagcaactggccagtggtggaaatgacaaccttctacacatctgggatgtgtccatgtcatcctctgtacagtctgctgggcgtacccaatggttgcacaggcttcaggatcacttggctgccgtgaaggcactggcatggtgcccattccagagcaacctgctggcttctggcggtggtgggggtgatcgctgcatcaagttctggaacacccacactggtgcatgcctcaactcagttgacactggatcgcaagtgtgcgcgctgctctggaacaagaatgagagggagctgctgagctcacacgggttcactcagaatcagctcaccttgtggaagtacccgtcgatggttaagatggccgaactcaatggccatacctcccgcgtcctgttcatggctcagagccctgatggatgcactgtggcatctgctgcagcagatgagacattgaggttctggaatgtgtttggaactcctgaagcggcgcctaaggctgcagccaaggcttcccacactgggatcttcaacagtttcaaccacatccgatgaagaaatgacattattgttctaaagaagaccttccagagactccagacctgttgataggaatgtgccctttaatataccaccaaaacaccatcgagctgatgttccacaaaagagatcatcatacactatagcaataatcttgtgttgacatgtgtacatctgttgactatttcgggttactagcgttgtaatcagatttacattacatttctctttggtatgctggtaacgctggttgctggtccataatattgtacgttgctgatccgtaatactgtacataaagttttgatataaaaagcttatataatatttatgtgtttcatactt

SEQ ID NO: 3469 - DNA, 4499 bp, Oryza sativa
gttgacttataaaaaaattgaaaagaagcattgtactactccagtagttaaagaggctgtaccgctgtactactaagcaggcggctccgcctggccggtgacggtgagatactccagtaaaccccacgaaaaccctcaccctgaccctgctgctcccccgcggtgggctccccgtaaattctcccccgaaaccgcccgagatggcggctgcggcggcgcggctgttggagagggcgacgagaaccgcggcatcctgctcctccgctcttctccgcagtcctctggattctttctccggacgcttcccaagcttccggtcgcccctcctacggccggctccggcgccgtcgaccgtcttcccccggggcctctccgacacggccttcgacgcgcaggcgctggacacccgcgtacccgccaccgtcatcaccggcttcctcggctccggcaagacaaccctcctgaatcacattttaacttcacagcatgggaagagaatcgctgtaattgagaacgagtttggtgaggtggacattgatagctcactcgttgcaagtcattcatcagttgccgaggacattgtaatggtgaacaatggttgcttgtgttgtactgtccgaggggatcttgtaaagatgcttctgaagttggtaaagcaaaagggggacaagtttgatcatattgttattgaaacaacaggtcttgcaaagcctggtcctgtcattgagacattctgttctgatgaactggtctctagatatgtgaagcttgatggtgtggttactatggttgattgtaagcatgccatgaaacatttgaatgaagtaaaggccaggtgggttgtaaatgaggctgtagagcaagttgcttatgcagacaggattatattgaacaagactgatttggttgataatgcagaactggaggtgttaattaacaaaattaagctcataaatgggatggcacagatgagaaaaacaaagtttggtgatgttgacatggattttgtgctaggaattgggggctatgatcttgataggattgagtctgaagtccagttgcatgaaagaaaagagacaggtcattgccatgctggagaagaacatgggcatcagcaccatcatggacatgtccatgattcagctgtctcaagtgttagcattgtttcggagggagtacttgatcttgatgaggtgaatgactggcttgagagactcgttgaagagaaaggggaggatctttatagattgaagggtgtaatctccgtaaatgagtcaactggacgtttcgtattccagggtgtgcactctatgttggagggatgcccagctaaaccatgggagccggatgagaaaagattcaacaaattagtatttattggaaggaatttggatgaagctgcactgcgaaaagccttcaaaggctgcttactgtgaacactctgatcacgtattgagtcctgggaagccatgcatatatcaaactgtacaagatgtttgccttgtgctcgctgataaaatgcttactgtttgtcaccaacgtattaggccaatctaaatgtgttgcatgtcatacgtgggtggtgggtcatggtttacgtttatttgtggtatcctcatctgtgccaggatcatacctgtgtatcatggacaatcagacaacagagtaaacttttttaagggaaaaccaagagttcatgtcccaatggtctgaatttctgaatgcgtggttctgcctcttgattgaatctcgagcataagtttatcttatcgagattgctctggccggaagatcgatttgcttcgatgaacatcggatccgatgcaaacagtgagctgacggttgattagtgaaagaacatcaccttacccaataagataagggttaaaattgataatcggtttcatgatctgctattagcccaatcacaattttgatctagtagcactagatgatgatgatcccagctaattttgctactgctaatactagtgcgattgtgtgtgaactagtgctaaagttgctaaccctaagttgcagctgccacatcccaacggctattttttttctcggacacactgctagccgttgcggccgccgttccgtataaatattttgacggatctaccagtaaccccacaaggatactactccgcgaggcacctctctctctctctctgtgagtttcgtgcgatctcgcgagcgaatccggcgcgcgacccaggctctccaagatccccgcgctctcctcttcggtttactgatctgaaatctctgcgtcgaatcacctgtttgttggcttgaattgcttgtccgcgtcgttgatttcgttgtggtttcttgatcttcggtggaatttctttgcgttggattgtctccacccctgttggtttcttgtcgattcccgatttgagttgttcgttggcgtgaaaaggattctttttttcccctgagatttcttgatttttggtgaaatttctttggtgttgaaatatcatcgccttttggtttcttatcgattccgtcgttccgattggagttgttcgtcggcgtgaatttttttttcctgattcatcgttgcttgttgattggggatcgaatttttcgtctacgatccatcttattcgtggtagcagtatctcttcttgttgctgcgctgtgccctgtttatttgtttctgcttgttgcttctgacccatggatgcaggttcgcactcgatctcatcggagaagagcagccggtacgtggcgccgcgacagccactccaggaggccggatccagaccgtacatgccatcgctgagcacggcgtcccgcaacccgtcagccaagtgctacggtgacaggtttattccggacaggtcggcgatggacatggacatggcgcactacctgctgacggagccgaggaaggacaaggagaacgcggcggcgtccccggccaaggaggcgtaccggaagctgctggccgagaagatcctcaacaaccgcaccaggattctctccttccgcaacaagccgccagagcccgagagcatcctcacggagctccgtgctgatgcggcttccatccaagccaagccggcgaagcagcgccgatacattcctcagtctgccgagaggactctggatgctccagagcttgttgatgattactacctcaacctactggactggggaagcagcaatgtgctatccattgcgctgggcaactcggtgtacctctgggatgccacgaacagttcaacttctgagcttgttaccgtcgatgaggacaatggccctgtcaccagcgtaagctgggctcctgatggccggcacatcgccgttggtctcaactcctccgatgtccagctctgggacaccagctcaaaccgactgctgaggacgatgcgaggcgtgcacgattcgagggtcggttcgctggcatggaacaacaacatcctcacaactggtggaatggatggcaagattgtgaacaatgatgtgaggatcaggaaccatgttgtgcagacataccaggggcatcagcaggaggtgtgtggcctcaagtggtcaggatcagggcagcagcttgccagtggtggcaatgacaacctcctgcacatatgggatgtgtccatggcatcctctatgccgtctgctggccgcacccagtggttacacaggcttgaggatcacttggctgctgtgaaggctctcgcgtggtgcccattccagagcaacctgctggcatctggtggtggtgggagtgaccggtgcatcaagttctggaacacacataccggcgcatgcctcaactcgatcgacactgggtcacaagtgtgctcgctggtctggaacaagaatgagagagagctgctaagctcacatggattcgctcagaatcagctcactttgtggaagtacccgtcaatggttaagatggctgaactcactggccatacctctcgtgtccttttcacggctcagagccctgatggtctcacagtagcatctgctgcagcagatgagaccctgagattctggaacgtatttggggctcctgaagcacccaagactgcaaccaagggttcccacactgggatgttcaacaattccaaccacattcacatccgttgaggaacacaatacccttggttctgtgatccagtcataacttacaaagaagcagacttggtgtgaagggtcatttgcaggagagatcatcttacattattagcagaagagttagattttgacatgttgtatataaggttttgtgctatgttgataacaattttatgtacatcaagaccggtttgatgtattgattggcgtagaaaaaatgtaaaaaaattgcttttctgccagtaatatacatttttatatacttgccaggcttttcttgtagtaagttcctctcgttgtgtagtaacttgtaatttgattgattttactctcgagccaattgagatgtctggtaaccaggaaattgctgagatgagtcttcctcttac

SEQ ID NO: 3470 - DNA, 1943 bp, Hordeum vulgare
ctacaaataccgctagcaatcaaatccccaaatctcacaagccatcgagcaatctgcgacttcctctctctcctccggtcctccgctctcgtgctcgccgccgccgcctccctcgccgatccgggggagacgaatccttctcgccctcgcaagatccccgtctctgctcgccaatccgctcgtcgttcaattgcagcatcctgttcttgtgctatttttttgctcgatcgatccatcgatccgcgtttactcctgtcgcgattactgttatttgtttgcctgttctgtttcttctgttctaaccatggatgcaggctcccgctcgatctcctccggcaagaaccgcgccggcgccgtgcagcggccaccgctccaggaggccggatcccgcccctacatgccgtcgctgagcacgcgcaacccgtcggccaagtgctacggggacaggttcatcccggaccggtcggcgatggacatggacgtggcgcactacctgctcacggagggaaagaaggacaaggagaacgcggcggcatccccgtccaaggaggcctaccggaggctgctcgccgagaagctgctcaacaaccggacgcggatcctcgccttcaggaacaagccgccggagccggagaaggtcttcgctgccgacacggtttcttctcaccaggctaagccgtccaagcagaggcgctacattccccagtctgccgagaggactcttgatgcaccggacctcgtcgacgactactacctcaacctaatggactgggggagcagggacgtgctgtccattgcgctgggcgacaccatgtacctgtgggacgcctcaagtggatccacatctgagcttatgacagtcgaggaggacaacggccccatcaccagcgtcagctgggctcctgatggccagcatcttgctattgggctcaactcgtctgacatccagctctgggacaccagctccaaccgcctgttgagaactctgaaaggtgtgcacgagtcaagggtgggttcgctggcatggaacgacaacatcctgacgaccggctgcatggacggcaggatcgtgaacaacgacgtgaggatcagggaccatgccgtgcagacgtaccaggggcatagccaggaggtgtgcgggctcaagtggtctggctcagggcagcagctggcgagcggtggcaacgacaaccttctgcacatttgggatgcgtcgatggcatcctctatgccatccccaggccgcaaccagtggctgcacaggctggaggaccacatggccgccgtgaaggcgcttgcatggtgcccattccagagcaacctgctggcgaccggcggtggcgctagcgaccggtgcatcaagttctggaacacgcacacgggcgcatgcctcaactcggttgataccgggtcgcaggtgtgctctcttctgtggaacaagaacgagagggagctgctgagctcacacgggttcacgcacaaccagctgacattgtggaagtacccttcgatggtcaagatggccgaactcagtggccatacctcccgtgttcttttcatggcacagagtcctgacggttgcacggtagcatcggcttctgcggacgagaccctccgcttctgggacgtgtttggcactcctgaggtggccaagcctgcgcccaaggcttcccacaccggcatgttcaacagcttcaaacatatccgataagacgaacaatgccaacaatcaatctcttgaactggaatatggtcctactcatatagggagacagccgtgctgtgtgtacagaaaacatgctaaatacagttcctgggtatgtaataccgctcatgtactgcctaaaatgtggataagataatatacggatggagccgccgaaattcggctcccggggatgtaggcacattgctgaacctcgttaacaaatgccgcgtgtctt

SEQ ID NO: 3471 - DNA, 2323 bp, Brachypodium distachyon
tctcggacagaccctcatcctgcttctcccccctcccggacaagtattttcatcacggatccaatcgctaaacccccaacccccgcaaagaaattcgccaagcaattctccctccgcaggtctcgcgagcgaacgaatccagcgctcgcgggaacgccgtctcgcgctcaaagctctccgacaagatccctgcgctcctgtttggttactgatctgatctcggtgttgaatttgttcctcgcgtgctagtctccgatcgattcttgactcgaggcgctcgtctccgctgttaatctagccgtgttttcttgttcttgttctttagtagagaattttgcactagggtgcctgcgcctgttggtttcagtctttcagatcggttaccgagttgatttatttatcggcctgcgaattcgtcgcgtgaattagggttccgtgttgattcctgttcgatttcttctctctgagtaaatcttgttcgcgtcaatactaccgctacttcttgtttgttcttgttgcttctgacccatggatgcaggctccaactcgatctcgtcggagaagagcagccggtacgcggcgccgcggtcgccgctcaaggaggccggatccaggccgtacatgccgtcgctgagcacggcgtcccgcaaccctaacgccaagtgctatggcgacaggttcattccgaacaggtcggcgatggacatggacatggcgcactaccttctgacggaaccgaagagggacgagaagaacgtggggacagcatccccgtccaatgagatgtaccggaaactattggccgagaagctgcttaacaaccgtaccagaattctggccttccagaacaagccgccggagcctgagaacatcctcacagaactccgtgctgatacagcttccatccaggcgaagccaacgaagcagcgccgacacatccctcagaccgcggagaggactctggatgcgccagaccttgttgacgattactacctcaacctactggactggggaagcagcaatgtgctgtccattgcgctgggcaacacggtatacctctgggatggctcaaatggatctacatctgagctcgttaccgttgatgaggacaatggccctgtcaccagtgttagctgggctcctgatggccgacacattgctgttggactcaactcgtcaattgtccagctctgggatcccagctctaaccgactgctaaggacactgcgaggtgtgcatgagtcgagggttggttcactggcgtggaacaacaacatcctgaccactggtgggatggatggcaagattgtgaacaatgatgtgaggattaggaaccatgctgtgcagacataccatgggcacgagcaggaggtgtgtggactcaagtggtcagggtcaggacagcacctggccagtggtggcaacgacaacctcctccatatatgggatgtgtctatggcatcctctgtacaatctgcaggtcgtacccaatggctgcacaggcttgatgaccacttggctgcagtgaaggccctcgcatggtgcccattccagagcaacctgctggcatctggtggtggcggaagtgaccggtgcatcaagttgtggaacacacacaccggcgcatgcctcaactctgtggacaccgggtcgcaagtgtgtgcactgctatggaacaagaatgagagagagctgctgagctcacatggattcactcagaatcagctcactttgtggaagtacccgtcaatggttaagatggctgaactcactggccacagctcccgtgtccttttcatgactcagagccctgatggttgtactgtagcatctgctgcagcagatgagaccctgcggttctggaatgtgtttgggactcctgatactcctaaggctacgaaagtcaaggcttctcatactgggatgttcaacagctacaatcatatccgataaggagaaatgacttcattggcgaccatcaggagttccagaactgtagatattaatggaagaccatagtccataaacagaactttacttaatatctgtgtgtacttcagtttgtacattgaagtagttctgtgtacttcagttttgttgtatgctggtaactctggttgctgttttacattgatccagatgaacatcaagaccattttgatgttcaacagatatgttgatatatttttatgaccaatgtagctttttaaattttgtgccagtttgagagtatttgacatgactattctttcttgcatgtgatgtgtcaaatacagtaattttactgattttgctgttgagatgaggtctggaggtgcttctc

SEQ ID NO: 3472 - DNA, 1328 bp, Panicum virgatum
atgccgccgctcagctccgggtcgcgcaacccgtcggccaagtgctacggcgacaggttcatcccggacaggtcggcgatggacatggacatggcgcactacctgctcacggagcccaggaaggacaatgagaacgcggtggtgtcaccctccaaggaggcgtaccggaggctgctcgccgagaagctgctcaaaaaccggacacgcatcctcgctttcaggaacaagccgccagagccagagaacgttgcagctgccaacccggcttcctcccaccacgccaagccggccaagcagcggcgccacattccccggtctgcggagaggacgctggacgcaccggagctcgttgatgactactacctcaacctgctcgactgggggagcaataacgtgctgtccattgctctgggcgacacggtctacctgtgggacgcctcgagtggatccacttctgagctggtgaccgtcgacgaggacagcggccccatcaccagtgtcagctgggctccagacggccggcacattgctttgagaacactcagaggtgtgcatgaggcaagagtcggatcattggcatggaacatcctgacgaccggtagcatggatggcaggatcgtgaacaatgacgtgaggattaggaaccatgtagtgcagacatatgaggggcacagccaggaggtgtgcgggctcaagtggtctggatcagggcagcagctgaccagaggggggaatgacaaccttctgcatatttgggatgtgtcgatggcatcctccatgccttctgctggccgcaaccagtggctgcataggctcgactatcacatggctgctgtgaaggcactggcatggtgcccattccagagcaatttgctggcaactggtggtggtggcagcgatcagtgcatcaagttctggaacacacacaccggtgcatgtctgaactctgttgacactggttcacaggtttgctcccttctctggaacaagaatgagagagagctgctgagttcacacggattcacacataaccagctaaccttgtggaagtacccatcaatggtgaagatggccgaactcactggccatacctctcgtgtccttttcatggctcagagccctgatggttgcacagtagcctcagcggctgcagatgagaccctccggttctggaatgtgtttggaacccctgaagcgcccaagcctacagccaaggcttcccacactgggatgttcaacagcttcaaccatatccgataggatttgttggagaacaagctcttctattggacatggtcttgcatcatatgctagatcgactcttattg

SEQ ID NO: 3473 - DNA, 1828 bp, Elaeis guineensis
ctgttaaccatggatgcaggaagtttctcttcttcgatctcttccgagaagacccggcctgcatcccgccatcctcttcaagaagtaggttcaaggccttacatgccttcgctccgctcctcatcgaaagatctttcttcccggcagagtggaggagatagattcattccggaccggtctgctatggattttgacatggcctactacctgctaacagagccaaggaaagagaaggagaacactgcagctgcatccccatccaaagagacatacagaaggcttcttgctgagaatcttctcaataatagaactcgaatccttgccttcaagagtaagcctccggcacctgccgaaggtgtcctccaagaagcctattccaatgcttcctcccatcaggccaagttggcaaagccacggagatacattccccagtctgctgagagaactctagatgcaccggaccttgttgatgactactatctgaatctgctggattggggaagcagcaatgttctatcgatcgccctcgggaacacggtgtatctttgggatgcttcggatggttctacatctgagcttgtgaccgtggatgaagatgttggtcctgtcactagtgtaagttgggctcctgatggacggcatattgctgttggtttgaactcctctgacatccaattgtgggactcgagttccaaccgcctgctgagaactttgagaggagtccatggatctcgagtcggatctcttgcttggaacaacaacatactcacaacaggggggatggatggaaagatcgtcaataatgatgtgagagtaaggtctcacatggtgcagacctaccgcggacaccagcaagaggtctgtgggttgaagtggtcaggctcaggacagcaactggcaagcggaggcaatgacaacctgcttcacatttgggacatatcgatggcatcttcaaatccatctccaggccagaatcagtggctccacaggttcgaggaccacatggctgcggttaaggcccttgcttggtgtcccttccagagtaacttgctcgcatctggtggtggcggcggcgatcggtgcatcaagttttggaacacccatacaggcgcttgcttgaattcagtggacactggctcccaagtgtgctccctgttgtggaataagaacgagcgtgaattgcttagctctcatggctttactcagaaccaactgactctctggaagtacccttcgatggtgaagattgcggagcttacaggccatacctctcgggttctcttcatggctcagagtccagatgggtgcacggtggcatctgcagctggggatgaaacgctgagattttggaatgtatttggaactcctgaagcaccaaagcctgctgccaagacagctagtacaggacccttcaccagttttaatcacattaggtgaggaatgaggtggagagaggtgtggtggtgtgtgggaagtgatgtgtcgtcatctgatccttgaaagcatggtatgatgggaagaattggcatggaagacctggtagcctgacgcaagatcatattactggcagaccaattgctctaaaagaaagattaggcacaattaaaatctcctatgggaaggcatcacacattggttgggatcttctagtgtcttgtggtaagaaggtgatttttgggttcagcaagagttggtggtgtggaaacattgtaaaaggatctatataagaagggatcccaacaaaaaccaaaatggttcattgcttgtattataaactcttatatagtggaatttctctcccatgctccctgtggatgtaggcatatcg

SEQ ID NO: 3474 - DNA, 1750 bp, Sorghum bicolor
tctgctattacaggttgctgtgttaagttgtcacatggatccagcacaatatttccaacccaggacattctcaataaagttgtggccaccaagtgaaagcacacggctcatgcttgttgagaggatgacaaagaatctgtccacagagtcagagtccattttctctcgcaaatacggtactttgggcaaggaagaagctcatgagaatgcaaaaaggattgaagaactttgctttgcctcggctgatgagcatttcaaaagggagccagatggtgatgggagttctgctgtccagctatatgcaaaggaaacgagcaagatgatgttggaagttctgaaaaaaggccctaggactactgcagaactggaagcacctgtagctgatacacctcttgtgcctgctgatactgtactagatatatctggtggcaagcgtgcttttattgaggcagatgaagcaaaggaactgctgagtccacttacaaaaccaggaaattcatatcaaagaatatgctttagcaacaggagctttggtattggcgctgctaatgttgctgggccaattcttgagtcagttaagaatcagctcacagaggtagatatctcagattttgtggcaggaaggcctgaggatgaagctcttgatgtgatgcgcatattctccaaagcattagagggttctgtcctgagatatctgaacatctctgacaatgctttgggtgagaagggtgtcagggcattcagtgagcttctgaaatcacaggaatccctggaagaactatatgtgatgaatgacggtatatcagaggaagctgcaaaagctctatctgagcttattcctgcaactgagaagctcaaggttcttcacttccacaacaatatgactggagatgaaggtgctatgtatatcgctgagatggttaagcgttctccaaatgtagagagtttcaggtgctcagcaacaaggataggatctgatggtggagtcgcattgtctgaggcattagggacatgcactcgtctgaagaaacttgatctccgggacaacttgtttggtgttgatgcagggttagctctcagcaaaacccttccaaagcttcctgatcttgttgagctttatctcagtgatctcaatcttgagaacgagggcacaatcgcaattgtcaaagccctcaaacagtcagcaccgcagttggaggtccttgaaatggcaggaaatgaaataaatgccaaagcagccccagatttggcagaatgcttaacagcaatgcagtcactgaagaagctgaccttggctgaaaatgaactgaaggatggcggtgctgtgattattgcaaaatcattggaagatggccacacagatctcaaggaacttgatgtgagcacgaacatgctgcagagggttggagctcggtgctttgcgcgggcagtcgcagataaaccagcttttgtgcaactgaacatcaatggaaatttcatctctgatgaagggattgatgaggtgaaggaaattctgaaggctggtaagaaatccctggatgttctgggctcactagatgagaatgaacctgacggggagcctgatgatgaggaagaggaccaggatgctgaggacaatgaggatgagctggattcgaagctgcagagtgtgaaggttgagcaggatgattgaccaagttggttttaaggtataagtgttgttgatccttggttccttagtcagtttttgttatgtaaaaccatttatctt

SEQ ID NO: 3475 - DNA, 1983 bp, Zea mays
aaaccctaacaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagccagatggtgatgggagttctgctgtccagctatatgcaaaggaaacgagcaagatgatgttggaagttctgaaaaaaggcccaaggactactgcagaactggaggcacctgtagctgacacacctcttgtgtctgctgatactgtactagatatatctggtggcaagcgtgcttttattgaggcagatgaagcaaaggaactgctgagtccacttaccaaaccaggaaattcatataaaagaatttgctttagcaacaggagctttggtattggtgctgctaatgttgctgggccaattcttgagtcagttaagaatcagctcacagaggttgatatctcagattttgtggcaggaaggtctgaggatgaagcccttgatgtgatgcgcatattctccaaagcattagatggttctgtcctgagatatctgaacatctctgacaatgctttgggcgagaagggtgtcagggcattcagtgagctcctgaaatcgcaagaatccctggaagaactttatgtgatgaatgatggcatatcagaggaagctgcaaaagctctatctgagcttattcctgcaactgagaagcttaaggttcttcacttccacaacaatatgactggagatgaaggtgctatgtatattgctgaaatggttaagcgttctccaaatgtagagagtttcaggtgctcagcaacaaggataggatctgatggtggagtcgcattgtctgaggcattggggacatgcactcgtctgaagaaacttgatcttagggacaacttgtttggtgttgatgcagggttagctctcagcgaaacccttccaaaactacctgatcttgttgagctttatctcagtgatctcaatcttgagaacaagggtactatagcaattgcaaaagccctcaaacagtcagcactgcagttggaggtccttgaaattgctggaaatgaaataaatgccaaagcagccccagatttggctgaatgtctagcagtaatgcagtcactcaagaagctgaccttggctgaaaatgaactgaaggacaatggtgctgtgataattgcaaaatcattggaagatggccactcagatctcaaggaacttgatgtgagcacgaacatgctgcagagggttggagctcggtgctttacgcgggcagtcgcaaataaaccagattttgtgcagctgaacatcaatggaaattttatctctgatgaaggggttgatgaggtgaaggaaattctgaaggctggtaagaaatctctggatgtgctgggcccactagacgagaatgaacctgatggagagcctgatgatgaggatgccgaggacgatgaggacgagctggatttgaagctgcagagtgtgaaggttgagcaggatgaggatgattgacgatccttaggttaaatatctttagctactcagtaatcatttggatgtccatgagctacgcaaacttttaattaaaaagaatgtactgaggcttttgc

SEQ ID NO: 3476 - DNA, 2378 bp, Panicum virgatum
ttgaatacttggaatgccaatattgtgggacggagtacgtttttgtacgtgggccggacgcgtatctatccgttttggggcacggcccagcccacgaaatacttcagcctgcaatccccgcccgtgacctagcccgtagcccacccacgctcgcacaggcacaccctcgcacagtcgcactgcacgcacacgctcgcaggcgccggcgccgccagaccaggcgcccgcccgcccgagcgccgccactcgccgtcgccggccacaagccaccgcccgccggcaaggaggagcgccggctgcaatctctgggtctcgtgtcaacttcgaaggttttcacatggattcagcagcacaaaatttccaacccaggacattctccatcaagctgtggccaccgagtgaaagcacacgcctcaagcttgtagagaggatgaccaagaacctgtccactgagtccatattttcccggaagtatggacttttgggcaaggaagaggctcatgagaatgctgaaaggattgaacagctgtgctttggatctgcagatgagcatttcaagaaagaacctgatggtgacgggagttccgctgtccagctgtacgctaaagaaactagcaagatgatgttggaagttcttaagaaaggcccaaggatcactgcagaattagaagcgtcggtagctgatacacctctagcgcctggtgatactgtattagatatatctggtggcaagcgtgcttatatcgaggcagatgaagcaaagcaactgctgagtccacttaccaaaccaggaaactcatataaaaggatctgctttagcaacaggagctttggtgttgatgctgctaatgttgcaggatctattctcgagtcagttaagaatcagcttacagaggtagatatatctgattttgttgcaggaaggccagaggacgaagctcttgatgtgatgcgcatattctccaaagcactagagggttctgtactgagatatctaaacatctccgacaatgcactaggtgagaagggtgtcagggcattcagtgagctcctgaagtcacaggaaaatctggaggaactctatgtcatgaatgatggcatatcagaggacgctgcaaaagctctttctgagcttattccttcaactgagaagcttaaggttctccacttccacaacaacatgactggagatgaaggtgctgtgtatgttgctgagatggttaagcggtctccaaatctggagagtttcaggtgctcagcaacaaggataggatctgatggtggtgtcgcattgtctgaggcattagggacatgcacacatctgaagaaactggatcttagggataatttgtttggtgttgatgcagggattgctctcagcaaaacccttccaaagcttcctgatctcgttgagctttacctcagtgacctcaatcttgagaataagggtacagtagcaattgtcaatgccctcaaacagtcagcacctcagttggaagtccttgaattggctggaaatgaaataaatgccaaggcagccccggatttagcagaatgcctaacagccatgcaatcactcaagaagctgaccttggctgagaatgaactcaaggatgctggtgctgtgattattgcaaaatctttggaagatggtcatgtagatctgaaggaatttgatgtaagcacaaacatgtttcagagggctggagcacgctgctttgcacgggcagttgcaaataaacctggttttgtgcaactgaacatcgatggtaatttcatctctgatgaagggattgatgaggtgaaagatattctgaaggctggtaagaattcgctggatgttttgggctcactggatgagaacgaacctgaggggcagcccgatgacggtgatgaggatgatgatgacgacgaaggtgccaaggatgatgacgtcgaggacaggctggattcgaagctgcagaacgtacaggtggagcaggatgatgaaccatgcttaggctaactagttctgcgttttggtccagtaatcttctgaataccagctaggctagacttttagttatgagcaaatgcactgtgtcaccagcatttagaaccgagtcaagcagcctggtgatctatccttgccgtttatgagaaccttttgtaacttcagaacttcggtatctgtggttgtcagggtcaggaagctgactttgaacttatttcatggaccctatttagtactcccaacttattcgctgtgatgttttggggcgcttcatgggtttatttgcaatctgtgctattgtggcatgtatgaatgttgcctgtgtttttcttttatataataatgttgcctatgttggtgtctgcacaagtaacgtgtgaatcat

SEQ ID NO: 3477 - DNA, 2036 bp, Panicum virgatum
ttcgaaggttttcacatggattcagcagcacaaaatttccaacccaggacattctccatcaagctgtggccaccgagtgaaagcacacgcctcaagcttgtagagaggatgaccaagaacctgtccactgagtccatattttcccggaagtatggacttttgggcaaggaagaggctcatgagaatgctgaaaggattgaacagctgtgctttggatctgcagatgagcatttcaagaaagaacctgatggtgacgggagttccgctgtccagctgtacgctaaagaaactagcaagatgatgttggaagttcttaagaaaggcccaaggatcactgcagaattagaagcgtcggtagctgatacacctctagcgcctggtgatactgtattagatatatctggtggcaagcgtgcctttatcgaggcagatgaagcaaagcaactgctgagtccacttactaaaccaggaaactcatataaaaggatttgctttagcaacaggagctttggtgttgatgctgctaatgttgcaggatctattctcgagtcagttaagaatcagcttacagaggtagatatatctgattttgttgcaggaaggccagaggacgaagctcttgatgtgatgcacatattctccaaagcactagagggttctatactgagatatctaaacatatccgacaatgcactaggtgagaagggtgtcagggcattcagtgagctcctaaagtcacaggaaaatctggaggaactctatgtcatgaatgatggcatatcagaggacgctgcaaaagctctttctgagcttattccttcaactgagaagcttaaggttctccacttccacaacaacatgactggagatgaaggtgctgtgtatgttgctgagatggttaagcggtctccaaatctggagagtttcaggtgctcagcaacaaggataggatctgatggtggtgtcgcattgtctgaggcattagggacatgcacacatctgaagaaactggatcttagggataatttgttcggtgttgatgcagggattgctctcagcaaaacccttccaaagcttcctgatctcgttgagctttacctcagtgacctcaatcttgagaataagggtacagtagcaattgtcaatgccctcaaacagtcagcacctcagttggaagtccttgaattggctggaaatgaaataaatgccaaggcagccccggatttagcagaatgcctaacagccatgcaatcactcaagaagctgaccttggctgagaatgaactcaaggatgctggtgctgtgattattgcaaaatctttggaagatggtcatgtagatctgaaggaacttgatgtaagcacaaacatgtttcagagggctggagcacgctgctttgcacgggcagttgcaaataaacctggttttgtgcaactgaacatcgatggtaatttcatctctgatgaagggattgatgaggtgaaagatattctgaaggctggtaagaattcgctggatgttttgggctcactggatgagaacgaacctgaggggcagcccgatgacggtgatgaggatgatgatgacgacgaaggtgccaaggatgatgacgtcgaggacaggctggattcgaagctgcagaacgtacaggtggagcaggatgatgaaccatgcttaggctaactagttctgcgttttggtccagtaatcttctgaataccagctaggctagacttttagttatgagcaaatgcactgtgtcaccagcatttagaaccgagtcaagcagcctggtgatctatccttgccgtttatgagaaccttttgtaacttcagaacttcggtatctgtggttgtcagggtcaggaagctgactttgaacttatttcatggaccctatttagtactccaacttattcgctgtgatgttttggggcgcttcatgggtttatttgcaatctgtgctattgtggcatgtatgaatgttgcctgtgtttttcttttatataataatgttgcctgaatacctttgtcac

SEQ ID NO: 3478 - DNA, 2556 bp, Brachypodium distachyon
gacggccacggagcaagcaacctgccaagggcggcttgaactgaaaccctagtctagacgaaccctccccccactacagaaacccacgctacgcccgcaactccgccggccgccgctccttctcgttccacccgcccatcccctttcccctctgcttccgccctcgcgcgcgcctcctcctcctgccatattccttgcgagccctctcctccctctccttagtgcttcctccagtcgacgtctccggtggaagccgacgtctccaggcactagacgacgccgcggctgtcgcccttaagcagacggtgtcgccgtcgcgatccaagggttgttgtgtgaagtgccacatcaccacatggattcaatagctcaagatttccagccccggacattctccatcaaactatggccaccaagtgaaagcactcgtttgatgctagtggagaggatgaccaagaacctgtccaatgagtcaatcttttctcgcaagtatggccttctgggcaaagaagaggcccacgagaatgctaaaaggattgaagatatgtgctttgcttctgcagatgagcatttcaagaaggagcctgatggtgatgggagttctgcagtccagctatatgcaaaagaaactagtaagctgatgctggatgtcctgaaaagaggcccaaagacaaccgtggaaccagaagcacctgttattgatacacctcctgagcctgctgatactgtgtttgatatatcaggtggcaaacgtgcctttattgaagcagaagaagcaaaggagctactgagtcccctaacaaaaccaggaaactcatacaaaaggatctgcttcagcaacaggagctttggtattggtgctgccaatgttgctgggccaattcttgaatctataaagacgcagctcacggaggtagatatctcagattttgttgctggaaggcctgaggatgaagctcttgatgtgatgcgcatattctccagagcattagagggatccgtactgagatacctgaatatctctgataatgctttaggcgagaagggtgtcagggcattcaaagagctcctggaatcacagggcaacctggaagaactatatgtgatgaatgatggtatatcagaggaagctgcaaaagctctatctgagcttattccttcgactgagaagctgaaggttcttcacttccacaacaatatgactggagatgaaggagcaatgtcaattgctgagatggttaagcgttccccaaatctggagagttttaggtgctcagcgacaaggataggttctgatggcggggtggcattggctgaggcgctagggacctgtactcatctgaagaaacttgacatcagggataacttattcggtgttgaggctggggtagctctcagcaaaacgcttccaaagcttcatgatctcgttgagctgtacctcagtgacctcaatcttgagaacgagggtacagtagcaattgtgaatgtcctcaagctgtcagcacctcagttggagatccttgaaatggccggaaatgaaataacggctgaagcaacccaagatatagcagcatgcctgaaagcaatgcaatccctcaagaagctgaccctggctgagaatgaactgaaggatgctggtgcagtggtcattgctcaatcattggagggaggccacgcagatctgaaggagcttgatgtgagcacaaatatgttccagagggctggagctcggtgctttgctcaagcaatcacaaacaaaccaggttttatgcagctgaatatcaatgggaatttcatatctgatgaagggattgatgaggtcaaggcaattctgaagggcggtaagaactcgctggaagtgcttggcccattggatgaaaatgaacctgatggggagcaggaatatgatgatgaggaagaggatgggagtgatggcgatggtcaggttgagaatggggaggatggtctggacacgaagctgcagcatctgaaggtggagcaggatgactagtcacattcagatggactagctcccatcttttgcaccaactagcataaaaaatctttaccacccaggtcaaacttcccctataaactgaactcaccgtggctccattcttctaaaatgaatcaagcagcctggtgatttatctgtagtcctctgtaaccttggatgttctgtcatgttttatcaacatcttggttatctggtcaaggccatgtgaagctggacccataaaatctgtggcatgtctttgctgtgctatctttgaaacttatgatgcgatatcttccagatctgtgataaggctgagaggccaaatatacaattcatgtagcaattggtgacttgggtaatgtaccgtagtctatttgaaatttaacttgttcaatgttgtgtttagtgttcagtaatgaggcaaggctgtgggcaactgtactttcttatgctttgcttggaattcctgccactcattgagctttcgtgggagcatattctctctctaatggtagccagttatttcttttcccattttctgaagtaacgctaataaa

SEQ ID NO: 3479 - DNA, 2788 bp, Pennisetum glaucum
gtcgtccttcgtcggccgcagctcctcctgcaactactggagctccaccgacaccagcccagggtgccgtgtcaatttcaaagcttttcacatggatacagcagcgcaagacttccaaccgaggacgttctccatcaaactctggccaccaagtgaaagcacacgcctcatgcttgtagagaggatgacaaagaacctgtccaccgagtccatattttcccgcaagtatggacttttgggaaaggaggaggctcatgagaatgctaaaaggatagagcagctgtgttttgcgtcggctgatgagcattttaagaaggaacctgatggtgatgggagttctgctgtccagctgtatgctaaagaaactagcaaaatgattatggaagttcttaagaaaggcccaatgactactgctgaaccagaagcacctgtagctgatacacctcttcagcccggtgatactgtattagatatatctggtggcaatcgtgcctttatagaggcagatgaagcaaaggaactgctgagtccacttaccaaaccaggaaactcgtataaaaggatttgctttagcaacaggagcttcggtattgatgctgctaatgttgctcggcctattctcgagtcagtgaagaaccagcttacggaggtagatatatctgattttgtcgcaggaaggcctgaggatgaagcccttgatgtgatgcgcatattctccaaagcactagagggttctgtactgagatatctgaacatctctgataatgcattaggtgagaagggtgtcagggcattcagcgagctcctcaagtcacaggaaaaactggaagagctctatgtaatgaacgatggcatatcagaggatgctgcaaaagctctttctgagcttattccttcaactgagaagcttaaggttctccacttccataacaacatgactggagatgaaggtgctgtgtatgttgctgagatggttaagcgatctccgaatctagagagtttcaggtgctcagcaacaaggataggagctgatggtggtgttgctttgtctgaggcattagggacatgcacacatctgaagaaacttgatctcagggataacctgtttggtgttgatgcagggattgctctcagcaaaacccttccaaagcttcctgatcttgttgagctttacctcagtgacctcaatctcgagaataagggtaccatagcaattgtcaatgtcctcaaacagtcagcacctcggttggaagtccttgaattggctggaaatgaaataaatgccaaagcagccccagctttagcagaatgcctaacatctatgcagtcattaaagaaactgatcttggctgagaatgaactcaaggatgatggtgctgtgactattgcacaatcactggaagttggccatggagatctgaaggagcttgacgtgagcacaaacatgcttcagcgggttggagctcgctgctttgcacgggcagttgcaaataagcctggttttgtgcaactgaacatgaatggcaatttcatctccgatgaagggattgatgaggtgaagagggtaattgaagttgtgacaaaacataaataagtgttctagctgttgatttcctggcctgtataggtgataatagagctctcagcctctcttacatttccttcttccagtgctatgctcagtcctatctacacccgggaattggaactaataacatgccatatcacgtacaagacagcagattaatagcttactctgcgcatactttgcagcttttccggcagaagccaggtgcttccttggtccccaccatgtagttagggttcttcgcgcactcacccacagccgcccactgggggcagagaacattgtcgtcctcacaaccgtcagacgaacccgactgcttgacagggatgtcaaaagacctcacatggatccatttagtggcggaccacttctgcccttcgatgacggggcagctcccgtgcaagctgtcagaatctgttgttgcatcagggtggagactgaagaacagaagggcgtcaccctttactggtttaactgcatatccatttcttgcacactcggaccaggtgtcgtccttgggttgtaatagcttcccctctgcattggggaagatagtctctccgcccttctcaacatttgataggtacataagcacagtggcaatgcggtggcccccaagggcttgattatttttgtcatggaagtagtcatagtggggctcatacttctcaccattctggtagtgtaatatctgaatagattcaccattctctggtggaagaaatgtccaagcagctatcctctcttctattctctttactacttcatcctgcttcttctcgaggaacatgccggagctggtgcgcacctcgctctggacgctcttcccggattcgttgtccgccaccatcgacttctccagcttgtcctttgccagcgcgatcaggtggtcgcactcggcatccgtcaggaaccccttgtgcaggaacgccctgggtcgccacgagagctggaccacgcgtgaggggtcgaagccgccggcgccccggctcgccgcggtggcggggaaaaggctgtcggcgagtaggagcgcgaccgtggcggcgaggaagagatagcggtggaaagccatggcgccgcgagattgggaggaggacgaagggtggagtggagggttggagaagaagaagcgggggtgtcaaccgttcaggcgccgacgtgacctcctcccaatctcgcggcgccatggctttccaccgc

SEQ ID NO: 3480 - DNA, 2040 bp, Brachypodium distachyon
tgcttgttgtctgatctaccattaggttgctgtgcagaagtgccgcatttcctcatggattcgccggtctggggattctccatcaagctgtggccgctgagcgaaagcacacgcctgatggtcatcgataggatgacagagaacccgtccaccgagacgctcttttctcgcaagtatggtcgtttggacaaggaagaggctcgcgagaacgctaagaggattgaagagacctgctttgcttctgtggatgagcatttcaaggaggagcctgatggtgatgggagttcagctgttcagctatacgctagagaaactagcaagttgatggtggaggtcctgaagagaggcccaagggcaagtgccgagctggaagcacctgttgttattgatgcacctcttgagcctgctgatacagtgctcgatatatctggtggcaagcgtgcttttatcgacacggacgaagcaaaggaacttctgatcccacttaccaagccggggaactcttataaaaggatctgcttcagcaataggagctttggtatcgatgctgccaatgttgctggtccgattcttgaatccatcaagaagcagatcacagaggtagacatctctgattttgttgcaggaaggcctgaggatgaagcccttgatgtgatgcgcatattctccaaagccttggaaggttctgtgttgagatacctgaacatctctgacaatgctttaggcgagaagggtgtcagggcattcgaagagctcttgaaatcacaggacaacctggaagaattctctgtgatgaacgatggtatatcagaggaagctgcaaaggctctatctgagcttattccttcaactgagattcttaaggttctccacttccacaacaacatgactggggatgaaggtgctttgtcaattgctgagatggttaagcgttcttcaaacctagagagttttaggtgctcagcaacaaggataggatctgatggtggggtggcattggctgaggcattagggacatgcactcgtctgaagaaacttgacctcagggacaacttgtttggtgttgaggcagggatagctctcagcaaaacgcttcctaagcttcctgatctcgtggagctgtatctcagtgacctcaatctcgagaacaaaggtacgatagcaattgccaatgccctcaaacagtcagctcctcgattggaagtccttgaaatggctggaaatgaaataactgcgaaagcaacccaagctttagcagaatgtctaacagtgatgcaatcgctcaagaagctgacgttggctgagaatgaactggaggaccgtggcgctgtggtgattgcaaaaacattagaaaacagtcacccagatctgaaggagcttgatgtgagcacaaatatgctgcggagagccggagctcggtgctttgcccaggcaatcgcagacaaaccaggttttgtgcagctgaacatcaatgggaatttcatctctgatgaaggaattgaggaggtaaaaaagattctgaagagtggtaagaactcgctgagcgtgcttggctcactggacgagaacgatcctgagggggaacccggagatggtgacgaggaaggggatgaggaggatgacgaaggtgggctggactcgaagttgcagaacctcaatgttgagcaggactagtcaagtttaggttaagtagctagctccaatatttctctccaattggctcaagagttctgaatcttatccatccaggttaaatagaaggaattgctattccattgttctaaacccaggcaagcagccacatggtgcatgtatcctgggaatatatatctgttcttctttagcttccattggaaattatctcatgctttagcaacactttgggtgtcacaagaccaggttaagatccatggcatgtcgagaggaccaaaagcattttgagcttgtgcctaagacttggttgtttttgctattgtgcatgtgcaagaaaatgtttggaaaagaagttaaattacaaccattgtccagaattatctacac

SEQ ID NO: 3481 - DNA, 2008 bp, Saccharum officinarum
cgaagccagtgggcagcggccaccaaccccaggtcccggccccggccccggcctcctccgggtcgcacacctgtcccggcggcctcccccgcgcaccagatcacacgcaccgccagtcaaacccccccacctccctggacgggagctccccaccaccacccgaagactcgatcccccgccgtccgccccgtatccaagggccccggccgcgcatccctcctccggcgagccaccgcgcccctgcccataaatacctctccgcgccagccgctgccgctgccacccccgcgagacagacctgtccgaatcgcgcccaggtccctcgctgggagtttcgccgagggccctcccgcctccccctagattcacgacggagatggcgtccgagctcacctaccgcggcggcggggcgtccacggccgccagcgccggcgccgggggatactccccgaagccgtccaagccgctcgcgtggctgccccgcgcggcccgctacgccgtcgccgagcaccgcccgctcttcgcgctcgccgggatgctcatcgccgccgccgtcatctccatcgcctccccttccgcctcctcaacgtccaccggcgccgcctcgtcctactccaacaacaactacaacaacaacccgctcgcccgcttctccgtcgagcccgcccaccaccgcgacgtggccacgcggcacttcgtcggcggcaaggtgccgctcggcctcaagcggaaggcgctccgcgtcctcgtcaccggcggcgccggcttcgtcggcagccacctggtggaccgtctcctcgagcgcggtgacagcgtcatcgtcgtcgacaacttcttcaccggccgcaaggacaacatcctgcaccacctcaacgacccaaacttcgagatgatccgccacgacgtcgtcgagcccattctgctcgaggtcgaccagatctaccacctcgcctgcccggcgtcccccgtccactacaaatacaaccccatcaagacaatcaagaccaatgtggttggcactctgaacatgctcggattggcaaagaggatcaacgccaagttcctcctcaccagtaccagtgaggtctatggtgatcccctccagcacccgcaggtggagacttactggggcaatgtcaatcccatcggtgtcaggagctgttacgatgagggcaagcgtacagctgaaacgttgaccatggattaccaccgtggtgccaaccttgaggttaggatcgcacgtatcttcaacacatatggccctcgcatgtgcattgatgatggccgtgttgttagtaactttgttgctcaggcactgaggaaggagcccttgactgtttatggtgatggaaagcaaaccaggagtttccaatatgtttctgatctggttgagggtctgatgaagctgatggaaggcgatcatgtaggaccattcaacctgggtaaccctggtgagttcaccatgcttgagcttgccaaggttgtccaggacaccatcgaccccaatgcacagatcgagttccgtcagaacacccaggacgacccacacaagcgcaagcccgacatcagccgtgccaaggagctccttgggtgggagccgaagatccccctccgtgagggccttcccctcatggtcaacgatttccgcaagcgcattttcggcgaccaagacaccgccgccaccactggaaaccagcaaggttaggatgaaggcgcacgagacttgggaaatttttggtggcctgcttctagctgcttggttgctctccttactgacaaaagctatggccacgtagttcgttgggaatgcgttactaaaataccttggttgatgctgtactgctattctttttcctgtattttttttctcagttctctcagtccttagctatacaaaaaatttcagttgaaccgttggagataaacccggatgatcaaattctttgttgagagcatagcatcatatatatggtataaatcacgttttctgcaaaaaacaacccccccc

SEQ ID NO: 3482 - DNA, 2031 bp, Zea mays
cagaaaactcgatcccccgccgtccaccccgcatccaagggccacgaccccgcatctctcccccggcgagccaccgctcccccgcccataaatacctctctgctccagccgctgccgctgccacccccgcgagacctgtccgaatcgcgtccaggtccctcgctgggagtttcgccgagggccctcccgcctcccccctagattcacgacggagatggcgtccgagctcacctaccgcggcggcggggcgttcacggccgccagcgccggcgccgggggctactccccgaagccgtctaagccgcttgcgtggctgccccgcgcggcccgctacgccgtcgccgagaaccgcccgctcttcgcgctcgccgggatgctcatcgccgccgccgtcatctccatcgcctccccgtccgcctcctcctcctcctccgccgcctcgtcctactccaacaacaacccgctcgcccgtttctccgtcgagcccgcccaccaccgcgacgtggccacgcggcacttcgtcggcggcaaggtgccgctgggcctcaagaggaaggtgctccgcgtcctcgtcaccggcggcgccggcttcgtcggcagccacctggtggaccgcctcctgcagcgcggagacagtgtcatcgtcgtcgacaacttcttcaccggccgcaaggacaacgtcctgcaccacctcggcgaccccaacttcgagatgatacgccacgacgtcgtcgagcccatcctgctcgaggtcgaccagatctaccacctcgcctgccccgcgtcccccgtccactacaaatacaaccccatcaaaacaatcaagaccaatgtggttgggactctgaacatgcttggattggcaaagaggatcaatgctaggttcctcctcaccagtaccagtgaggtctatggtgatcccctccagcacccgcaggtggagacttactggggcaatgtcaatcccatcggtgtcaggagctgttacgatgagggcaagcgtacagccgaaacgttgaccatggattaccaccgtggtgccaaccttgaggttaggatcgcacgtatcttcaacacatatggccctcgcatgtgcattgacgatggccgtgttgtcagtaacttcgttgctcaggcactgaggaaggagcccttgacggtttatggtgatggaaagcaaaccaggagtttccaatatgtttctgatctggtcgagggtctgatgaagctgatggaaggcgagcatgtaggaccatttaacctgggcaaccccggcgagttcaccatgctggagcttgccaaggttgtccaggacaccatcgaccccaacgcacggatcgagttccgtcagaacacccaggacgacccacacaagcgcaagcccgacatcggccgtgccaaggagctccttgggtgggagccgaagatccccctccgcgagggccttcccctcatggtcaccgacttccgcaagcgcatcttcggcgaccaagacaccgcggctgccaccaccggaaaccagcaaggctaggacggaagaggagcacgggacttggaaatttttggtggcctgcttctagctgcttggtcgaccctcctctccttactgacaaaagctatggccatgtagttcgtcgggaatgtgtcgctgaaataccttggttgatgctgtaatgctattctttctcctgtattttttctctctcagttcgctcagccattagctatacaaaaaaaattccagttgaaccgttggggataaacctggatgatctaattctttgttgagagcatagcatcatatatatggtatagctcacttttttttgtttgcttttgcaagtgtgccctgctttggtgggtctagttctttctttgttgacacgcggagaatgcctatcctgctcccagaaactatactagaacaaagaaacacagttcttaggatggaacaagatctttgttgagaccatgacttttctcagttctttgtcaacaacttaaaggaggaggaaaaagcaagcgttttcc

SEQ ID NO: 3483 - DNA, 2224 bp, Zea mays
cgcacgcaccgccagtcaaagcccccacctcccggccagcccccaccgccccgcgaagactgggtccctgccgtccgccccacatccaagggccccgtatccctcctccggcgagccaccgctcccccgcccataaatacctcttcgctcccgccgctgccgctgccacccccgcgagacctgtccgaatcgcgcccaggtccctcgctgggagtttcgccgagggccctcccgcctcccctagattcacgacggagatggcgtccgagctcacctaccgcggcggcgggacgtccacggccgccggcgccggcgccgggggatactcaccgaagccgtccaagccgctcgcgtggctgccccgcgcggcccgctacgccgtcgccgagcatcgcccgctcttcgcgctcgccgggatgctgatcgccgccgccgtcatctccatcgcctccccgtccgcctcctcctcctcctccacctccacctccaccggcggcgccgcctcgtcctactccaacaacaacaatccgctcgcccgcttccccgtcgagcccgcccaccaccgcgacgtggccacgcggcacttcgtcggcggcaaggtgccgctgggcctcaagcggaaggcgctccgcgtcctcgtcaccggcggcgccggcttcgtcggcagccacctggtggaccgcctcctcgagcgcggcgacagcgttatcgtcgtcgataacttcttcaccggccgcaaggacaacgttcttcaccacctcaacgacccaaacttcgagatgatccgccacgatgtcgtcgagcccatcctgctcgaggtcgaccagatctaccacctcgcctgcccggcgtcccccgtccactacaaatacaaccccatcaagacaatcatatcctttctctacgaattccttcagttcagttcccacaagaccaatgtggttgggactctgaacatgctcggattagcaaagaggatcaacgccaggttcctcctcaccagtaccagtgaggtctatggtgatcctctccagcacccgcaggtggagacttactggggcaatgtcaatcccatcggtgtcaggagctgttacgatgagggcaagcgtacagctgaaacgttgaccatggattaccaccgtggtgccaaccttgaggttaggatcgcacgtatcttcaatacatatggccctcgcatgtgcattgacgatggccgtgttgtcagtaactttgttgctcaggcactgaggaaggagcccttgacggtttatggtgatggaaagcaaaccaggagtttccaatatgtttctgatctggttgagggtctgatgaagctgatggaaggcgagcatgtggggccattcaacctgggtaaccctggcgagttcaccatgcttgagcttgccaaggttgtccaggacaccatcgaccccaacgcacggatcgagttccgcaagaacacccaggacgacccgcacaagcgcaagcccgacatcagccgcgccaaggagttcctcgggtgggagccgaagatccccctgcgtgagggccttcccctcatggtctccgacttccgcaagcgcatcttcggcgaccaagacgctgctgccaccaccaccggaaaccagcaaggttaggatgaaggagcgcacatgacatggaaatttttggtggccctgcttctagctgcttggttgctctctccttactgacaaaagctatgggccacgtagttcgttgggaatgtgttactggaatacctcggcacggctgatgctgtaatgccattctttttttcccctgtattttttctttctcagttctctcagtccttagctatacaaaaaaagttcagttgaacagttggagatgaacccggatgatctaattctttgttgagagcatagcatcatatatatggtataaatcctgtcattttgcaaatgtatgtatgcccttctttgatggttctagttctttgttgaagctaggcgtaggatgcctatcctgctctcaaaaactagacttgagcaaagaaacgaacgaacaagcagttgtgaagatgaaacaactctggcgggctagcttccacatacatgcttgtcccgaggagctcctgggctgtcttcagccgcggcttgtcctggactcctggtagatgggcttgttcttcctgatctgttcatgcatcttgcacaagaattcaattcaaggatgttttttt

SEQ ID NO: 3484 - DNA, 2178 bp, Panicum virgatum
catagtatcctacttgccgtgacaccattattttttttgttcatgttccacaatctgccgtgcaccgctacgcaagtgcaaaaacacggagccaaaccccacctaaattccaaacgcagtcgcagtccgtgtggcacatgcccccaacggtcggtccagccagctgagctacgaagaggtagtcgccgccgacgagcccacccggcggtgctgccacgcgcacgcggcgcacatgccggcggcttccctccctcttccgcacctgatcacaccgccagtcaaaccctcccgtccgccactcgcaaccccaccccgcaagacctccatcccccgccgcccaccgcggatccaacggcctcggcaccccccccccccccgcctcctccctccggcgagccacccgcccataaatacctctgctcccactgctgccacccccgcccgcctgtccaaatcgcgctccctgctctggtcaggttccctcggagtctcgccgaacgggagcggggggccgcctagattcgcgaggggccgagatggcgtccgagctcacctaccgcggcggcggggcgtccccggtcgccggcgccggcgccggcgcggggggatactccgcgaagccgtccaagccgcttgcgtggctgccccgcgccgcgcgctacgccgccgccgagcaccgcccggtcttcgcgctcgccgggatgctcatcgccgccgccgtcatctgcatcgcctccccgtccgccccctcctcctccgccgccgccgccgtctcctcctactcctcctccagcagtaccaacaacccgctcgcccgcttctccgtcgagccggcgcaccaccgcgacctggcctccacgaggcacttcgtcggcggcaaggtgccgctgggtctcaagcgcaaggcactccgcgtgctcgtcaccggcggcgccggcttcgtcggcagccacctcgtcgaccgcctcctcgagcgcggcgacagcgtcatcgtcgtcgacaacctcttcaccggccgcaaggacaacgtcgtgcaccacttcgccaaccccaacttcgagatgatccgacacgacgtcgtcgagcccatcctgctcgaggtcgaccagatctaccacctcgcctgcccggcatcgcccgtccactacaagtacaaccccgtcaagacaatcaagaccaatgtggttgggactctgaacatgcttggattggcaaagaggatcaacgccaggttcctcctcaccagcaccagcgaggtctatggtgatcccctccagcacccccaggtggagacttactggggcaatgtcaatcccatcggtgtcaggagctgttacgatgagggcaagcgtacagctgaaacgttgaccatggactaccaccgtggtgccaaccttcaggttaggattgcgcgtatcttcaacacatatggccctcgcatgtgcattgatgatggccgtgttgtcagcaactttgttgctcaggcacttaggaaggagcccttgactgtttacggtgatggcaagcaaaccaggagcttccaatatgtttctgatctggttgagggtctgatgaagctgatggaaggggatcacgttggtccattcaaccttggaaaccctggcgagttcaccatgcttgatctcgccaaggttgtccaggacaccattgacccgaatgcacggattgagttccgtcaaaacacccaggatgacccgcacaagcgcaagcctgacatcagccgcgccaaggagcttcttggctgggagccaaagatccccctgcgcgagggacttccccttatggtcactgacttccgcaagcgcatcttcggggaccaagacagcgctgcgaccaccggaaaccaacaaggttaggacgaaggagcatgagacttggaaaaattttggtggcctgcttctagctgcttggttactctcctcactgacaaaggctatggccgtgtagttcgttgggaacatgttactgaaatacctttggttgctgctgtaatgctattctttttccatgtaattgttttatcagttatctcagtcagctatacaaaattttcagttgaattttggagataaacccggatgatcttattctttgttgagagcatagcattatatgatataaatcacacatttctgtaagtgtatgcgctgcttttat

SEQ ID NO: 3485 - DNA, 2767 bp, Setaria italica
gcgcacatgccacggcggcttcccttccgcacctgatcacacacacacaccccggccagtcaaaccctcccgtccgccactcgcaatcgcgccccacccacccgaagactccatcccccgccgcccaccgcggatccaacggcccaggtccccggctccctcctccggcgagccaccgctcccccgcccataaatacctcggctcctgccgcggccaccgctgccacccccgcccgccctgtccgaatcgcgcccggtcccggccacgttccctaggagtttcgccgagcggggggcgcctagatttgctactacgagggaaggggggatggcgtccgagctcacctaccgcggcggcggggcgtccccggtcgccggcgccggcgccagctcggggggctactccgcgaagccgtccaagccgctcgcgtggctgccccgcgccgcgcgctacgccgccgccgagcaccgccccgtcttcgcgctcgccgggatgctcatcgccgccgccgtcatcaccatcgcgtccccgtccacctcctcatccaccggcgccgccgtcgcctcctactcctcctccaacagccaccacaacagcaacccgctcgcccgcttctccgtcgagccggcgcaccaccgcgacctggcgtccacgaggcacttcgtgggcggcaaggtcccgctgggcctcaagcgcaaggcgctgcgcgtgctcgtcaccggcggcgccggcttcgtcgggagccacctcgtggaccgcctcctcgagcgcggcgacagcgtcatcgtcgtcgacaacctcttcacgggccgcaaggacaacgtcgtgcaccacttcggcaaccccaacttcgagatgatccgacacgacgtcgtcgagcccatcctgctcgaggtcgaccagatctaccacctcgcgtgcccggcgtcacccgtccactacaagtacaaccccgtcaagacaatcaagaccaatgtggttggaacactcaacatgcttggattggcgaagaggatcaatgccaggttcctcctcaccagcaccagcgaggtctatggtgatcccctccagcacccccaggtggagacttactggggcaatgtcaatcccatcggtgtcaggagctgttacgacgagggtaagcgtactgctgaaacattgaccatggactaccaccgtggtgccaaccttgaggttaggattgcacgtatcttcaacacatatggccctcgcatgtgcattgatgatggccgtgttgtcagcaactttgttgctcaggccctgaggaaggagccattgacggtttatggtgatggtaagcaaaccaggagcttccaatacgtttctgatctggttgagggtctgatgaagctgatggaaggtgagcacattggcccattcaaccttggaaaccccggcgagttcaccatgcttgagcttgccaaggttgttcaggacactattgacccgaatgcacggattgagttccgtcaaaacacccaggacgacccacacaagcgcaagcctgacatcagccgcgccaaggagctcctcgggtgggagccgaagatccccctccgcgagggacttcccctcatggtcactgacttccggaagcgcatcttcggcgaccaagacagtgccgccaccaccggaaaccagcaaggttaggacgaaggagcatgagactcaggaaaattttggtggcctgcttctagctgcttggttactctccttactgacaaagctatggccgcgtagttcattgggaatgtgttactgaaataccttggttgctgctgtaatgctattcttttttcctgtaattgttttcagttctctcagtcatcagctatacaaaaaaatgtcagttgaattgttggagataaacctggatgatctaattctttgttgagagcatagcattataagatataaatcacatgtttttgcaagtgtatgccctgctttgatgtgtctagttcttttgttgagatgcagatgatgactctcctgaactcagaaactactctgaaacaaacagcagttctggtgatgcaacaagattttattgagcatcaagttcagtacactgtttacatcaccatcagacctgtttcttatgccatgtacagttcatagtgaacaacagatcaatggaagtgttttttctatctacatcctacattgctgctggtgtggtcggccacctagtccacagaggaagctgccgcgccgttgaggccggccttgtgccggcaccggaccctctgtgccaccgctgctggcgacgcgggtgattttcgtgggcgccacctggtggaacatctcgggctcagatggaggccttacccgctcttcaggtttccaatggcgactccgctcatcaagccacgcaacaatgtcggagaacactagctccacattctcatcgggctcaccggcggtgaggccgtgccacatccctgggtagagcttgatggtcttgtcagtgctggctgccctctcatacagggctcggctgacctctgggtcggtcaccatgtcggcctcgccgtgcaggatgaagaatggcatcctcacctggtggaaacatagcaagaaattcaaggacagccaacagtagtcacatctctggattgacagagctaacccatcttatggaaacaaatcggtttgaagggggttttgcttatttttagcacatgtcacatcgaatgtttaaatactaattaggagtattaaatgtagacgatttacaaaacc

SEQ ID NO: 3486 - DNA, 1828 bp, Panicum virgatum
gccccgcctgtccgaatcgcgcgccccggtcgagtttcgcgagggaccgagatggcgtccgagctcacctaccgcggcggcggggcgtccccggtcgccggcgccggcgccggcgcggagggatactccgcgaagccgtccaagccgctcgcgtggctgccccgcgccgcgcgctacgccgccgccgagcaccgcccggtcttcgcgctcgccgggatgctcatcgccgccgccgtcatctgcatcgcctccccgtccgctccctcctcctccgccgccgccgccgccgtgtcctcctactcctcctccggcattaccaacaacccgctcgcccgcttctccgtcgagccggcggcgcgccaccgcgagctggccggcgcgcggcacttcgtcggcggcaaggtgccgctgggcctcaagcgcaaggcgctccgcgtgctcgtcaccggcggcgccggcttcgtcggcagccacctcgtcgaccgcctcctcgagcgcggcgacagcgtcatcgtcgtcgacaacctcttcaccggccgcaaggacaacgtcgtgcaccacttcgccaaccccaacttcgagatgatccgccacgacgtcgtcgagcccatcctgctcgaggtcgaccagatctaccacctcgcctgcccggcgtcgcccgtccactacaagtacaaccccgtcaagacaatcaagaccaatgtggttgggactctgaacatgcttggattggcgaagaggatcggcgccaagttcctcctcaccagcaccagcgaggtctatggtgatcccctccagcacccccaggtggagacttactggggcaatgtcaatcccatcggtgtcaggagctgttacgatgagggcaagcgcacagctgaaactttgaccatggactaccaccgtggtgccaaccttgaggttaggattgcacgtatcttcaacacatatggccctcgcatgtgcattgatgatggccgtgttgtcagcaactttgttgctcaggcacttaggaaggagcccttgactgtttacggtgatggcaagcaaaccaggagcttccagtatgtttctgatctggttgagggtctgatgaagctgatggaaggggatcacgttggtccattcaaccttggaaaccctggcgagttcaccatgcttgagcttgccaaggttgtccaggacaccattgacccgaatgcacggattgagttccgtcaaaacacccaggacgacccacacaagcgcaagcctgacatcagccgtgccaaggagctccttggatgggagccaaagatccccctccgtgagggacttcccctcatggtcactgacttccgcaagcgcatctttggggaccaagacagcactgccaccaccggaaaccaacaaggttaggacgaaggagcatgagacttggaaaattttggtggcctgcttctagctgcttggttactctccttactgacaaaagctatggccgtgtagttcgttgggaacatgttactgaaataccattggttgcttctgtaatgctattcttttttcatgtaattgttttatcagttatctcagtcagctatacaaaattttcagttgaattttggagataaacccggatgatcttattctttgttgagagcatagcattatatgatataaatcacacatttctgtaagtgtatgcgctgcttttatgtgtctagttctttgctgagatgcagaggatgcctctcctgaattcagaaactacactgaaacaaacagcagttctgatgatgcaacaagattttattgaacatcagttcagcatactgtttacatcacc

SEQ ID NO: 3487 - DNA, 1506 bp, Pennisetum glaucum
cgccggcgcgggcggctactccgcgaagccgtccaagccgctcgcgtggctgccccgcgccgcgcgctacgccgccgccgagcaccgccccgtcttcgcgctcgccgggatgctcatcgccgccgccgtcatcaccatcgcctccccatcctcctccacctccaccaccggcgccgccgtcgcctcccactcctcctccaacagcaacccgctcgcccgcttctccgtcgagccggcggcgcgccaccgcgacctggcgtccacgcggcacttcgtgggcggcaaggtcccgctcggcctcaagcgcaaggcgctgcgcgtgctcgtcaccggcggcgccggcttcgtcggcagccacctcgtcgaccgcctcctcgagcgcggcgacagcgtcatcgtcgtcgacaacctcttcacgggacgcaaggacaacgtcgtgcaccacttcggcaaccccaacttcgagatgatccgccacgacgtcgtcgagcccatcctgctcgaggtcgaccagatctaccacctcgcgtgcccggcgtcacctgtccactacaagtacaaccccgtcaagacaatcaagaccaatgtggttggaacactcaacatgcttggattggcgaagaggatcaatgccaagttcctcctcaccagcaccagtgaggtctatggtgatcccctccagcacccccaggtggagacttactggggaaatgtcaaccccatcggtgtcaggagctgttacgatgagggtaagcgtactgctgaaacattgaccatggactaccaccgtggtgccaaccttgaggttaggattgcacgtatcttcaacacatacggccctcgcatgtgcattgatgatggccgtgttgtcagcaactttgttgctcaggcactgaggaaagagccactgacggtttatggtgatggtaagcaaaccaggagcttccaatatgtttctgatctggtcgagggtctgatgaagctgatggaaggggagcacattggcccattcaaccttggaaacccgggcgagttcaccatgcttgagcttgccaaggttgttcaggacactattgacccgaatgcacggattgagttccgtcaaaacacccaggacgacccacacaagcgcaagcctgacattagccgcgccaaggagctcctcgggtgggaaccgaagatccccctccgcgagggacttcccctcatggtcactgacttccggaagcgcatcttcggcgaccaagacagtgccgccaccactgcaaaccagcaaggttaggatgaaggagcataagacccaggaaaaattttggtggcctgcttctagctgcttggttactctccttactgacaaaagctatggccgcgtagttcattgggaatgtgttactgaaatacctttgttgctgctgtaatgctattcttttttttcctgtaattcttttctcagttctctcagtcatcagctatacgacaaaattcagttgaattgtcggagataaa

SEQ ID NO: 3488 - DNA, 4245 bp, Oryza sativa
ccccgcgcccccttctccctccccacctgcccgcattttgcatccaggtccccggggaaatttttatttgcggggagggccttggggggtttgtggaaattttacatccaggtccctcgccgtcgtcgtgagggaaaaagaaaaagaaaaaaagatggcgtcggagctgacctaccgcggcggcggcggcgcgacgctggccggcgaggcggaggcggcggtagcggcgggggggtactccccgaagccgtccaagccgctcgcgtggctcccccgcgccgcccggtacgccgccggcgagcaccgcccgctcttcgccctcgccgggatgctcgtcgccgctgccatcttctccctcgccaccccgtactcctcctccacccccgccgccgcggccgccggttcaaccgcggcgaacccgctggcgcggttctcggtggagccggcggtgagccggcggcagcagcagctgccggcgaggcagttcgtgggcgggaaggtgccgctggggctgaagcggaaggggctccgggtgctggtgaccggcggcgccgggttcgtggggagccacctggtggaccggctggtggagcgcggcgacagcgtgatcgtggtggacaacctgttcacggggcggaaggagaacgtggtgcaccacttcggcaacccaaacttcgagatgatccgccacgacgtcgtcgagcccatcctcctcgaggtcgaccagatctaccacctcgcctgccccgcttcccccgttcactacaagtacaaccccgtcaagacaatcaagaccaatgtggttgggactctcaacatgctcggattggcgaagaggatcaatgccaggttcctcctcaccagcaccagtgaggtctacggtgatcccctgcagcatcctcaagtggagacttactggggcaatgtcaaccccattggtgtgaggagttgttacgatgagggcaagcgcacagctgaaactttgaccatggactatcaccgtggtgccaaccttgaggttaggatcgctcgtatcttcaacacatatggccctcgcatgtgcatcgatgatggccgtgttgtcagcaactttgttgctcaggctttgaggaaggagcctttgacggtttacggtgatggcaagcagaccaggagtttccaatatgtctctgatctggttgagggattgatgaggctcatggaaggtgagcacgtagggccattcaacctgggtaaccctggtgagttcaccatgctggagctggccaaggttgtccaggacaccatcgaccctaacgcaaagatcgagttccgtcccaacacccaggacgacccgcacaagcgcaagcctgacatcggccgtgccaaggagctccttgggtgggagccaaagatccctctccacaagggtcttcccctcatggtcaccgacttccgcaagcgcattttcggtgaccaagacagcaccgccacaaccaccggaggccaacaagggtagaaggaggaggaggcataagactctggaaattttgatggcctgctttctagctgcttggttaagctccttactgacaaaaggcatggcctcatagttagttcctctggagctgtttgttactaaaaataccttggttgatgatgctgctgctgctgcctgtgatgtcattcttttttcttgtaattttttcttcctcctctcagtctctctcatctatacgaaacttcagttggacataaaagttgtggatcttctgattctttgttgagatgatagcattatatggtataaattacatgttctctcagaaatttgtattttgccaggctgctcgctctaggcaggcagctggtgcatgttcaaactgaaacaaacagaaactgttctgatgaaactaaaaatttctctgaacttgttcatgacactgtttgcatcacaacatctgcattcctttcattttgtatatcaagggagttctttttttttcccctctttctatattttacatcctacattgctggggatttgctcggccggttaggccgcagaggaagccgccggcggcgccttgccgcggcggctcaggcgacactgggctgtccgccgcagcggcggcggcgctgtcggtgcaggccgccggcggggtaatgctcgccctgtcctggcggtggctgcggcggtcgagccaggcgacgatgtcggagaagacgaggtggacgttgtggtccggctcgccggcggtgaggccgtgccacatccccgggtagagcttgatggtcttgtcggcgctggcggcgcgctcgtacagcgcacggctcacctccgggtccgtcaccttgtcggcctcgccgtgcaggatgaagaacggcatgctcacctgccacccaccacgaaaaaccacaatgttcagaaactcacactctacatatgttcagagttcagtcactggcactcgacagagctgatgcatcaattcatggcagatgataatcttgtcagatggatcagtcagggttttttttcacctgtgacaagctttgctcgacgctgatgctggttcgcagcagctccagcgccgtcttcagcctgggcttgtcctggtagatcagcttgttcttcctgatctgctcaattgttcacaagaaaacagtttcagaaaacagaatctctctctctctctctctctctttttcctacattctttgctcaaaacacacaagatctcgcagcatgattaggtctgaatcttgcattctgacaatacaaattggtgaattgctcaaacgtttgaaccttttcgcgcttgatggggtctttgaaggcagagtcgatgacgtccttggtggggacgatcttccacttggggatgatctcctccacctgcgtcaggagcgtcaccaccaacggatgcggcttcaccttctccgatatctgaaacacgatcaatcaaatttagccataccatatatgccatcagattgctgccaagtgccaagccctgaaattcagcaagaacagaaatgcagaacagaaacagagagagagaatccatgtgaaaccttgcacatcggcgcgacgaggacggcgccgtcccagaaggttgggtccttgcggtgcagcagcagcgcaaccgcgccgcccatcgactccccgtacaggaaccggctcttgtctctgtactcctccagctctgaaaaaagtatatttgataatctaattgacatctaatttggaagtttttataccggtcaaaggtaaaagcacaccggtttaacagtatcaagtagaagtaaaaaggaacggagggagtacattttgatatgacacttaataaatgtagtgccaccctaaagaccatcagaaagtttgttatagattttgatatatgtattcttttttctataatttggtcaaagactcaagttatggaagtttgacttagaacaaaactaaaacattttgctatactagatttcaatatgatacactgaaacttcattcttggaaacaccttttttttttttacatgtcattcttgaaaacatttgaaactctgaattgaaacacagcaccatctgctctttccagtgactactggtaatttacttgtgatggtaaaagttcagaggcaaaatggagtagaaacagatgaagatcagaagaggttttttttttctttaccacatattgatttgaagaatctgtcgcagtcatcgacaagatgctcgaacttctggatgtagcatctggcacccatggacttgccatgcccctcataatcgatgccgaacacgccgtaacccgccgtggccagctcgaccccacatgctgccagtatcacaatgtcccccaccattagaacacagcatcatgctctctgattgattgctttcccatgtgacagtaattaattaattaaccagctgataaataattctcatggcccagcgatttttttttgccagcccaaaaataattctcacgagctaaaagtggctttgaaaattaggcccattacatgtttgcaagtttgcaaacactagttgaacacagttaccatcatcgttgacaacagtatctgaaacccttgctagctatcccaacatttttcggcgtaggctgtgtttagttacattcaaacttctaaaaattccgtcacattaaatatttagatacatgcgtggaacattaaatatggacgaaaaaaaaccaattacacactttgcatgtaaattgcgagatgaatc

SEQ ID NO: 3489 - DNA, 2467 bp, Brachypodium distachyon
cacgcatccaacgcccccaatcgcccgtccccttcgcggcgtcccataaatacctcctctgccgtctctcttacacgcacctcgcccccgatacagactgcggcgaggtccctggcctggatctcctccctttctctctttcacggaagggaccccagagtctgtttcctttccccggccaggttcttcttcgccggagatataatggcgtcggagctcacctaccgaggcggggcggcgtccccctccgccgccggtgccggtgccgccgggtacgccccgaagccctctaattcgaagccgctcgcgtggctcccccgcgccgcccggtacgccgccgccgagcaccgcccgctcttcgccctcgtcgggatgctcttcgccgccgccgtcttctgcatcgctgccccctcctcctcctccgcccccgccaccgcatcctcctactcctccggcgcccgcgccgtcaccaacccgctcgcccgcttctccctggactcgtcggcggcggccgcgcaccaccccgcccgccacttcgtcggcggcaaggtgcccctgggcctcaagcggaagggcctccgcgtcctcgtcaccggcggcgccggcttcgtggggagccacctcgtggatcgcctcgtggagcgcggcgacagcgtcatcgtcgtcgacaacctcttcacgggccgcaaggagaacgtggtccaccacttcggcaaccccaacttcgagatgatccgccacgacgtcgtcgagcccatcctcctcgaggtcgaccagatctaccatctcgcctgccccgcctcccccgtccactacaagtacaaccccgtcaagacaatcaagaccaatgtggttggtacattgaacatgcttggattggcgaagaggatcggagccaggttcctcctcaccagcaccagtgaggtctacggtgatcccctccagcaccctcaggtggagacttactggggcaatgtcaaccctatcggtgtcaggagctgctacgatgagggcaagcgtacagctgaaacattgaccatggactaccaccgtggtgccaaccttgaggtcaggattgctcggatcttcaacacatatggtcctcgcatgtgcattgatgacggtcgtgttgttagcaactttgttgctcaggcgctaaggaaggagcctttgacggtttatggtgacggcaagcagaccaggagcttccaatacgtttctgatctggttgaggggttgatgaggctgatggaaggggagcacgtagggccattcaacttgggtaaccctggtgagttcaccatgctggagctggccaaggttgtccaggacaccattgatccgaatgcgcggattgagcaccgtgagaacactcaggacgatcctcacaagcgcaagccagacatcaaccgtgccaaggagctcctcggctgggagccgaagatccccctccgtgagggccttcctctcatggtcactgatttccgcaagcgcatctttggcgaccaagatagcgccaccacagccaccggaggccaataaggggtgtagaagggacttgaagactttgaaattttggtggcctgcttctagtttctcggttgatctccctactgacagagctatggccacgtagttatcgaaagctttactaaaataccttggttgttggtgtaatgtcatttttttttctgaattgtcttcccctcctcggtctcagctatacagattttccagttgattgaattgtttgttggagataaacctggatcttgtaattctttgttgagatgatagcattatactatggtacaaaatactagtacatgatctctcagatatgtgttttgctccaggacttgacgaaactactgaaacaagcagcatttgttcctgacgaaactactgtttaatttctttttcacttgctgaacttttcattatctcgggtatttacattctgcactgttgatgaggtgccttgccggtcaacccgcagaggaagctgcttcgccgctgaggctgagggcggcgggcatgtgtcgacgccggactgtccgtgccatcgccgcatttcatgtcggtggtcttactggacgccacctgggtatcaggctccgagggagctcttacttgttggtcttcactgagtctgcgacgacagcttcgctggtcgagccaggcgacaatgtcagcaaagaccagctccacattgtcatcaggctcgccggcagtgaggccatgccacatccccgggtagagcttaatggtcttgtcgacgctggcggcacgctcgtacaatgcacggctgacctccgggtcagtcaccgtgtcggcctcgccgtgcaggacgaagaagggcatgctcacctccgacaggccgtcctcgacgtccatgctggtcctcagcagctccagcgccgtcttgagccgcggcttgtcctggtagatgagcttgttcttcctg

SEQ ID NO: 3490 - DNA, 1475 bp, Panicum virgatum
gccagtcaaaccctcccgtccgccactcgcaaccccacctcgcaagacctccatcccccgccgcccaccgcggatccaacggcctcggcccccccgcctcctccctccggcgagccacccgcccataaatacctctgctcccaccgctgccacccccgcccgcctgtccaaatcgcgctccctgctctggtcaggttccctcggagtctcgccgaacgggagcggggggccgcctagactcgcgaggggccgagatggcgtccgagctcacctaccgcggcggcggggcctccccggtcgccggcgccggcgccggcgcggggggatactccgcgaagccgtccaagccgcttgcgtggctgccccgcgccgcgcgctacgccgccgccgagcaccgcccggtcttcgcgctcgccgggatgctcatcgccgccgccgtcatctgcatcgcctccccgtccgccccctcctcctccgccgccgccgccgtctcctcctactcctcctccagcagcaccaacaacccgctcgcccgcttctccgtcgagccggcgcaccaccgcgacctggcctccacgaggcacttcgtcggcggcaaggtgccgctgggcctcaagcgcaaggcactccgcgtgctcgtcaccggcggcgccggcttcgtcggcagccacctcgtcgaccgcctcctcgagcgcggcgacagcgtcatcgtcgtcgacaacctcttcaccggccgcaaggacaacgtcgtgcaccacttcgccaaccccaacttcgagatgatccgacacgacgtcgtcgagcccatcctgctcgaggtcgaccagatctaccacctcgcctgcccggcatcgcccgtccactacaagtacaaccccgtcaagacaatcaagaccaatgtggttgggactctgaacatgcttggattggcaaagaggatcggcgccaagttcctcctcaccagcaccagcgaggtctatggtgatcccctccagcacccccaggtggagacttactggggcaatgtcaatcccatcggtgtcaggagctgttacgatgagggcaagcgtacagctgaaacgttgaccatggactaccaccgtggtgccaaccttgaggttaggattgcacgtatcttcaacacatatggccctcgcatgtgcattgatgatggccgtgttgtcagcaactttgttgctcaggcacttaggaaggagcccttgactgtttacggtgatggcaagcaaaccaggagcttccaatatgtttctgatctggttgagggtctgatgaagctgatggaaggggatcacgttggtccattcaaccttggaaaccctggcgagttcaccatgcttgagctcgccaaggttgtccaggacaccattgacccgaatgcacggattgagttccgtcaaaacacccaggatgacccacacaagcgcaagcctgacatcagccgtgccaaggagctc

SEQ ID NO: 3491 - DNA, 1671 bp, Secale cereale
cggcgaccggcgcggggtccctgcgctcgcgcctcctctacgacgggggcccctagccacgccaccggagatggcgtccgagctcacgtaccgcggcggggcgtcgtccccgtccgcgggcgccgccggcgccgccggcgagtactcctccccgaagcccgccagctccaagccgctcgcgtggttgccccgcgccgcccgctacgccgcggccgagcaccgcccgctcttcgccctcgtcggcatgctcgtcgccgccgccgtcttctgcctcgccgccccctccggctccggcacggccaccacgccctactcctccggacgcgctgccgccgtctccggcgcgctcacccgcttctccgtcgaccccgccgcgcacaaccccggccgccagttcgtggccggcaaggtgcccctggggctcaagcgcaaggggctgcgcgtcctcgtcaccggcggcgccggcttcgtgggcagccacctggtggaccgcctggtggcgcgcggcgacagcgtgatcgtggtggacaacctcttcacgggccgcaaggagaacgtgatgcaccacttcggcaaccccaacttcgagatgatccgccacgacgtcgtcgagcccatcctcctcgaggtcgaccagatctaccatctcgcctgccccgcatcccccgtccactacaagtacaaccccgtcaagacaatcaagaccaatgtggttggtacactcaacatgcttggactggccaagaggatcggcgccaggttcctccttaccagcaccagtgaggtctacggtgatcccctccagcaccctcaggtggagacatactggggcaatgtcaaccccatcggtgtcaggagttgctacgatgagggcaagcgtacagctgaaaccttgaccatggactaccaccgtggtgccaaccttgaggttaggattgctcggatctttaacacttatggcccgcgcatgtgcattgacgatggccgtgttgtcagcaactttgttgctcaggcgttaaggaaggagcctttgacggtttacggcgatggcaagcagaccaggagtttccaatacgtttctgatttggttgaggggttgatgaggctgatggaaggtgaccacatagggccattcaacttgggtaaccctggtgagttcaccatgctagagctggccaaggttgtccaggacaccatcgaccctaatgcacggatcgagttccgtgagaacacccaggacgacccgcacaagcgcaagccagacatcaccaaggccaaggagcaactcgggtgggagccgaagatcgccctccgcgacggccttcccctcatggtcaccgacttccgcaagcggatcttcggggaccaagatagcgccaccaccgccaccgaaggccagtaaagagtagaccggagtacaatcaatactttgaaattttggtggcctgcttctagcttgcttcttggttaatcacccctactgacagagctatggccacgtagtcgtcgtcgagagttttacctgctaaataccttggttgttgatgtaatgttattcatttttgtcgtcgccttttccgtcagtctcagctatacggacagacatcccagttggattgtttgatatataaatctggatcttctaattctttgttgagatgatagcattgt

SEQ ID NO: 3492 - DNA, 2375 bp, Secale cereale
tggcgtccgagctcacgtaccgcggcggggcggcgtccccttccgcgggcgccggcggcgccgccggcgagtactcctccccgaagcctgccagctccaagccgctcgcgtggctgccccgcgccgcccgctacgccgcggccgagcaccgcccgctcttcgccctcgtcggcatgctcgtcgccgccgccgtcttctgcctcgccgccccctccggctccggcacggccaccacgccctactcctccggacgcgccgccgccgtctccggcgcgctcacccgcttctccgtcgaccccgccgcgcacaaccccggccgccagttcgtggccggcaaggtgcccctggggctcaagcgcaaggggctgcgcgtcctcgtcaccggcggcgccggcttcgtgggcagccacctggtggaccgcctggtggcgcgcggcgacagcgtgatcgtggtggacaacctcttcacaggccgcaaggagaacgtgatgcaccacttcggcaaccccaacttcgagatgatccgccacgacgtcgtcgagcccatcctcctcgaggtcgaccagatctaccatctcgcctgccccgcatcccccgtccactacaagtacaaccccgtcaagacaatcaagaccaatgtggttggtacactcaacatgcttggactggccaagaggatcggcgccaggttcctcctcaccagcaccagtgaggtatacggtgatcccctccagcaccctcaggtggagacatactggggcaatgtcaaccccatcggtgtcaggagttgctacgatgagggcaagcgtacagctgaaaccttgaccatggactaccaccgtggtgccaaccttgaggttaggattgctcggatctttaacacttatggcccgcgcatgtgcattgacgatggccgtgttgtcagcaactttgttgctcaggcgctaaggaaggagcctttgacggtttacggcgatggcaagcagaccaggagtttccaatacgtttctgatttggttgaggggttgatgaggctgatggaaggtgaccacatagggccattcaacttgggtaaccctggtgagttcaccatgctagagctggccaaggttgtccaggacaccatcgacccgaatgcacggatcgagttccgtgagaacacccaggatgacccgcacaagcgcaagccagacatcaccaaggccaaggagcaactcgggtgggagccgaagatcgccctccgcgacggccttcccctcatggtcaccgacttccgcaagcggatcttcggggaccaagatagcgccaccaccgccaccgaaggccagtaaagagtagaccggagtacaatcaatactttgaaattttggtggcctgcttctagcttgcttcttggttaatcccccctactgacagagctatggccacgtagtcatcgtcgagagttttacctgctaaataccttggttgttgatgtaatgttattcatttttgtcgtcgccttttccgtcagtctcagctatacggacagacatcccagttggattgtttgatatataaatctggatcttctaattctttgttgagatgatagcattatactgtggtataaattaaattacatgttgtttcagaaatgtgcatttcccagctgcttcaggaacataaagaaaacttcagagtggagcaaaactttattcagttaacagagcattcgtgcagcacactatttacatgctttcatctgctgcttcttcttttcccttccatgtttacattctacattgcccacagaggaagccgcctcggcgccgaggtatcgacaccgggctgtccatgccgctgccgccggaaactggccgctgttggtaccttgcaggttccgacggggcaattcctacccggccgccgggttcaggcttgcggtgatggctgcgcttgttgagccaggcgacgatgtcggcgaagaccagctccacattgtcgtctggctcgccggctgtgaggccgtgccacatccccgggtagagcttgatggtcttgtcggcgctggcggcccggtcgtagagcgcgcggctgacctccgggtcggtcacggtgtcagcctcgccgtgcaggataaagaagggcatcctgacctcggagaggctgtcctcgacgtccatgctggtcctgagcagctccagcgccgtcttgagccgcggcttgtcctggtagatgagcctgttcttcctgatgtgctcgcgcttgacggggtccttgaaggcggagtcgatgacgtccttggtggggacgatcttccaggtcgggatgagctcctccacctgcgtcagcagggtcaccaccaccggatgcggcttcaccttctccgatat

SEQ ID NO: 3493 - DNA, 1942 bp, Triticum aestivum
attcggacgaggacacaaacctgcggcgaggtccctgcccgcgcttcctcttacacggggggccctacacttctccggccacgccaccgggtccttcttgcctcggcccgccggagatggcgtccgagctcacgtaccgcggcggggcggcgtccccgtccgcgggcgccgccggggccgccggcgagtactcgtccgcgaagcccgcctgctccaagccgctcgcgtggctgccccgcgccgcccgctacgccgcggccgagcaccgcccgctcttcgccctcgtcggcatgctcgtcgccgccgccatcttctgcctcgctgccccctccggctccggcccggccgccacgccctactcctccggacgcgccgccgccgtctccggcgcgctcacccgcttctccgtcgaccccgccgcgcgcaaccccggccgccagttcgtggccggaaaggtgcccctcgggctcaagcgcaaggggctccgcgtcctcgtcaccggcggcgccggcttcgtgggcagccacctggtggaccgcctggtggcgcgcggcgacagcgtgatcgtggtggacaacctcttcacgggccgcaaggagaacgtgatgcaccacttcggcaaccccaacttcgagatgatccgccacgacgtcgtcgagcccatcctcctcgaggtcgaccagatctaccatctcgcctgccccgcatcccccgtccactacaagtacaaccccgtcaagacaatcaagaccaatgtggttggtacgctcaacatgcttggactggccaagcggatcggcgccaggttcctcctcaccagcaccagtgaggtctacggtgatcccctccagcaccctcaggtggagacctactggggcaatgtcaaccccatcggtgtcaggagttgctacgatgagggcaagcgtacagctgaaaccttgaccatggactaccaccgtggtgccaaccttgaggttaggattgctcggatcttcaacacctatggcccacgcatgtgcattgacgatggccgtgttgtcagcaactttgttgctcaggcgctaaggaaggagcctttgacggtttacggcgatggcaagcagaccaggagtttccaatacgtttctgatttggttgaggggttgatgaggctgatggaaggtgaccacatagggccattcaacttgggtaaccctggtgagttcaccatgctggagctggccaaggttgtccaggacaccatcgacccgaatgcacggatcgagttccgtgagaacacccaggacgacccgcacaagcgcaagccagacatcaccaaggccaaggagcagctcgggtgggagccgaagatcgccctccgtgacggtcttcccctcatggtcactgacttccgcaagcggatcttcggcgaccaagatagcgccaccaccgccaccgaaggccagtaaagagtagaccggagtactatactttgaaattttggtggcctgcttctagcttgcttcttggttaatccccccactgacagagctatggccacgtagtcgtcgtcgagagttttactgctaaataccttggttgttgatgtaatgttattcatttttgtctgtcgccttctccgccagtctcagctatacggacagatatcccagttggattgttggatatatataaatcaaatctggatcttctaattctttgttgagaagatagcattatatggtataaattacatgttgtttcagaatgtggatcttcccagatgcttcaggaagccaatctctgtctagaacacaagaaacttcagagtggagcaaaactttattcagtttactgagcattggtgcagcacagtatttacatgctttcatctgctgcttctcttttccttgcacaaacagttccatgtttacattctacattgcccgcagaggaagccacc

SEQ ID NO: 3494 - DNA, 1811 bp, Avena sativa
ccctaccgacacaaaccgcggcgaggtccctggagttcttacacggggggcccctagagttgttcggcgatacgaccaggtccccgcagatggcgtcggagctgacctaccgcggcggggcctccccgtccgccggcgccggtgccggcgcgtacgccgccccgaagcccgccagctccaaggcgtcgtggctctcccgcgccgcccggtacgccgcgggcgagcaccgcccggtcttcgccctcgccgggatgctcttcgccgccgccctgttctgcttcgccggcccctccagcaccaccggccccgccaccggcgcctactcctccggaggcgccgccgccgccgtctccggctcgctctcccgcttctccgttgaccccgcggcgcacaaccccgcccgccacttcgtcggcggcaaggtgcccctgggcctcaagcggaagggcctccgcgtcctcgtcaccggcggcgccgggttcgtcggcagccacctcgtggaccgcctggtggcccgcggcgacagcgtgatcgtcgtcgacaacctcttcacgggccgcaaggagaacgtgatgcaccacttcggaaaccccaacttcgagatgatccgccacgacgtcgtcgagcccatcctcctcgaggtcgaccagatctaccacctcgcatgccccgcatcccccgtccactacaagtacaaccccgtcaagactatcaagaccaatgtggttgggacactgaacatgcttggattggccaagaggatcggagccaggttcctcctcaccagcaccagtgaggtctacggtgatcccctccagcaccctcaggtggagacttactggggcaatgtcaaccccatcggtgtcaggagctgctacgatgagggcaagcgtacagctgaaacattgaccatggactaccaccgtggtgccaaccttgaggttcggattgctcggatcttcaacacatatggcccgcgcatgtgcatagacgatggccgtgttgtcagcaactttgttgctcaggcgttaaggaaggagcctttgacggtttacggtgatggcaagcagaccaggagtttccaatatgtttctgatctggttgagggtttgatgaagctgatggaaggggagcacattggaccgttcaacctgggtaaccctggtgagttcaccatgctggagctggccaaggttgtccaggacaccatcgacccaaatgcgcggattgagttccgtgagaacactcaggacgacccgcacaagcgcaagccagacatcactaaagccaaggagctcctcgggtgggagccgaagatccccctccgtgacggtcttcccctcatggtcactgacttccgcaagcggatcttcggcgaccaagatggtgacggcaccaccagtggaggccaataagcatagagcggaatacaatacttcaaaattttggtggcctgcttctagcttcttggttaatctccttactgacaaagctgtggccacataagtccttgtgggttttactaaataccttggttgttggtgtaatgtcatgtcattctttttcttgtcatttttctgtcggtctcagctatacggatattcaagttcaattgtcggtgataaacctggatcttctaattctctgttgggatgatagcatatatggtataaattacatgttctctcacaactgtgtgtctatctagctgctttatatgaagctaatatttctccagaacacaagaaaactagactgtaacaagtacaacctgttcctgacagggcaagattttattcagtttactgagc

SEQ ID NO: 3495 - DNA, 1673 bp, Saccharum officinarum
cacgatctggtccaaagccccaactgaaatttacatccaggcccttcgccggagatggcgtcggagctgacgtaccgtggcggcagcgcggcgccaggctccgcctccaacggcggggagtactccccgaagccctccaagccgctctcctggctctcccgcgccgcgcgctacgccgccgccgagcaccgccccgtcttcgccctcgccggcatgctcttcgctgccgccctcttcaccttctcctccccctccacctcatcgccgtccgaacccgccgcttcggtcggattcaaccaccttgccgttgccgggcacccgtccttccgcgggtccgtcggcggcaaggtgcccctggggctgcgccggcgcgcgctgcgggtgctcgtgacgggcggcgccgggttcgtggggagccaccttgtggaccggctcgtggagcgcggcgacagcgtgatcgtggtggacaacttcttcacggggcgcaagggcaacgtggctcaccatctccagaaccccaggttcgaggtgatccgccacgacgtcgtcgagcccatactgctcgaggtcgaccagatctaccaccttgcctgcccagccagccccgtgcactacaagtacaaccccatcaagaccatcaagacgaatgttgttgggacactgaacatgcttggattggccaagaggattggggcaaggttcctacttacaagcaccagtgaggtctatggtgatcccctccagcaccctcaggtggaaacttattggggcaatgtcaaccctataggtgtcaggagctgctatgatgagggcaagcgtacagctgaaacattaaccatggactaccatcgtggtgccaaccttgaggtaaggattgcccggatctttaacacatatggtcctcgcatgtgcattgatgacggccgtgttgtcagtaatttcgttgctcaggcgctgaggaaggagcctttgacagtctatggtgatggcaagcagactaggagctttcaatatgtctcagatttggtggaagggctgatgaagctcatggaaggggatcacattggaccattcaacctcggtaatcctggagaattcaccatgctggagctggccaaggtggttcaggacaccatcgacccagacgcgcgcatcgagttccgtccaaacactgcagatgatccgcacaagcgcaagcctgacatcagccgcgcaaaagagctccttggctgggagcccaaggttccccttcgtgagggtcttccccgcatggtcactgacttccgcaaacgtatcttcggggaccagggagaatccactgaggcagctggtggcctttcttagtcttcaatcaacttcttaaagcgacacgtttgttcagtttgtatgatcacttgatacaaaagagggcgggagcaagatctggacaggtttggtggtatgctcttcggttgctctatacaacacggacaaaaaggtcatggctgcatacgtagttcttatatataggaatatacaaatgtttgttaccaagtacgaaaatatcctggcactgctgtactgctgttctttcctaatttggatgtaatgctatatactatgtaacaacctagtttttgtaatggcattgttaatggatttaacggaatgctaataacatctcaaggtcatag

SEQ ID NO: 3496 - DNA, 2338 bp, Sorghum bicolor
ggtcgttcgcctctcgcatcgcacacgatataagccatttttcttcactgctgatgccgagtgccgactcctccatactactacttcacgatctggtccaaagccccaactgaaatttacatccaggcccttcgccggagatggcgtcggagctgacgtaccgtggcggcagcgcggcgccaggctccgcctccaacggcggagagtactccccgaagccctccaagccgctctcctggctctcccgcgccgcgcgctacgccgccgccgagcaccgcccggtcttcgccctcgccggcatgctcttcgctgccgccctcttcactttctcctccccctccacctcgtcgccgtccgagcccgccgcgtcggtcggattcaaccaccttgccgtcaccgggcacccgtccttccgcgagtccgtcggcggcaaggtgcccctggggctgcgtcggcgggcgctgcgggtgctcgtgacgggcggcgctgggttcgtggggagccacctggtggaccggctggtggagcgcggcgacagcgtgatcgtggtggacaacttcttcacggggcgcaagggcaacgtggcgcaccatctccagaaccccaggttcgaggtgatccgccacgacgtcgtcgagcccatactgctcgaggtcgaccagatctaccaccttgcctgcccagccagccccgtgcactacaagtacaaccccatcaagaccatcaagacgaatgttgttgggacactgaacatgcttgggttggccaagaggattggggcaaggttcctacttacaagcaccagtgaagtctatggtgatcccctccagcaccctcaggtggaaacttattggggcaatgtcaaccctataggtgtcaggagctgctatgatgagggcaagcgtacagctgaaacattaaccatggactaccatcgtggtgccaaccttgaggtaaggattgcccggatcttcaacacatatggtcctcgcatgtgcattgatgacggtcgtgttgtcagtaattttgttgctcaggcgctgaggaaggagcctttgacagtttatggcgatggcaaacagactaggagctttcaatacgtatcagatttggtggaagggctgatgaagctcatggaaggggatcacattggaccattcaacctcggtaatcctggagaattcaccatgctggagctggctaaggtggttcaggacaccatcgacccagaggcgcgcatcgagttccgtccaaacactgcagacgatccacacaagcgcaagcctgacatcagccgcgcaaaagagctccttggctgggagcccaaggttccccttcgtgagggtcttcctcgcatggtcactgacttccgcaaacgtatcttcggggaccaaggagaatccactgaggcagctggtggcctttcttagtcctcaacttgttggaagtgacacgtttgttcagtttgtatgatcacttgatacaaaagcgggcgggagcataagatctggacagttttggtggtatgctctttggttgctctatacgacacggacaaaaaggtcatggttgcatacgtagttcttataataggaatatataaatgtttgttaccaagtacgaaaatatcttgcactgctgtactgctgttctttcctaatttggatgtaatgctatagtatgtaacaacgtactttttctaatgtattgttaacagattgtctggaaagctaatgacatctcaaggtcatagcgctataagcttacatatatttgaacatgagtttccatctgcgaacggaacaaaagattgagcaaatgttcaccacaatggagggaagggaatgattggtcatacataactttgtcgagcataagaccaagtatatcacaaatttgcacatcatcacttccttatttgccattgttgaagcaggcgcccatctgatcctgggtccattacagtaattcttctgtattcacatttctgcatggtgatgcgtccggccggcaagcccgcagaggaggcccggacgccgccgccgaggacgcccttgtgtctgcgctttgccgtcgacggcgtcgtcaccatggatgaacttggccggcgctggcaccagcttcctgaagcggtcctccatggtccagctccggcagcgctggttgagccaggagacgatgtcggagaagacggcctccacgttctcgtcggtctccccagcggtgaggccgtgccacatccccgggtagagcttgatggtcttgtcggcgctcgccgcgcgctcgtacagggcgcggctcacctccgggtccgtcaccgtgtcggcctcgccgtgca

SEQ ID NO: 3497 - DNA, 2393 bp, Oryza sativa
cgcgataaacctcgccgacggcgcggagagaaatctgactctccaacctcccgtccttggtccttacacgcaattataggggcgtgggtcccacgtctcagtgagagagagagaagctttttttttctacatctgagacgttcgccggagatggcgtcggagctcacgtaccgcggcggcgcgggggccccgggctccgcctccgacggcggggagtactcccccaagccctccaagccgctctcctggctcacccgcgccgcccgctacgccgccgccgagcaccgccccgccttcgccctcgccgggatgctcctcgccgccgccctcttctccctctacgccccttcctccgacgcctcatcctccgccgccaccaccaccaccaccaccttcagccacctctcctcgctcccgtcgtcgtcggcggcgtcgctgcacgagtccgccggggggaaggtgccgctgggcctccgccgccgcgcgctgcgggtgctcgtcacgggcggcgccgggttcgtcgggagccacctcgtggaccgcctggtggagcgcggcgacagcgtgatcgtcgtcgacaacttcttcacggggcgcaaggacaacgtggcgcaccacctcgccaacccgcgattcgaggtgatccgccacgacgtcgtcgagcccatcctgctcgaggtcgaccagatctaccacctcgcctgccccgctagccccgtgcactacaagtacaaccccatcaagaccatcaagaccaacgtggttgggacactgaacatgcttggattggccaagaggattggggcaaaatttctcctcaccagcaccagtgaggtatatggagatcccctccagcaccctcaggtggagacttactggggcaatgtcaaccccattggtgttagaagctgctatgatgagggcaagcgcacagctgaaacgttgaccatggattaccaccgtggtgccaaccttgaggtgaggattgctcggatttttaacacatatggtcctcgcatgtgcattgatgatggccgtgttgtcagcaactttgttgctcaggcactgaggaaggaacctttgactgtctatggtgatggcaagcagactaggagctttcaatatgtctctgatttggtggaagggttgatgagcttgatggaaggggagcacataggaccatttaacctgggtaatccgggtgagttcaccatgctggagctggctaaggttgtccaggacaccattgatccgaatgctcgcattgagttccgtccgaacactgcggatgatccacacaagcgcaagcctgacatcacccgtgcgaaagagctcctgggctgggagcccaaggttcccctgcgtgagggccttcccctcatggttaccgacttccgcaaacgcatctttggcgaccaggaagcctaatctgcagcagctggtggcatgtattaaatttcaacatgacaacggcacacaactcattaaaatcctataacttgtactttatagtaactacatgtggagaagttaaatcgggtagaaatacttggaaaggaaattggtgccttggttctttggttgcttcatacctcacggacaaaatggccatggctgaatacatagctagttctttggacacatggggatgctactaatactatcaatctatcataggcactactgtaagctactgtcttttttggtcttgctcatagaagccatatggtgttatacatgtaatctttattggaaactcgatatatgtttcagtatgaacagaacattccacttgcttacatgaagcatctttttaaacttttttttgaccaaatttgcactggattggaggaaaaggaatggtttgtgatacattacattacttggcaagttggcatatgtcttgactcttaacacctctataatacacgaagtcatgcacactgtgccacttattgaccattctaggcaggctggagcctctaatctttacattgttacaaagctacatttccgagtggtgatgcgttcggccggcgagcccggagaagcagccgccgcgccgccgtggagggccgcgcttggcgtcaccgtcgacgtcagcggcgccgcccctctcgccgcggatgaacctgtccggcgacgccatcatcttcatcaggcggtcctccaccgtccaggtgcggctgcgcccgttgagccaggcgacgatgtcggagaagatggcgtcgacgttgtggtcgggctcgccggcggtgaggccgtgccacatcccggcgtagagcttgatggccttgtcggcgctggcggcgcgctcgtacagcgcccggctcacctccgggtccgtcaccgtgtcggcgtcgccgtgcagcacgaagaacggcagcttcacc

SEQ ID NO: 3498 - DNA, 2747 bp, Zea mays
cgtcggggtagcttttttgccgggctacctttaattctcttcgcaaacacacaattgcctttttatttaagcaagcgtgtatgatggtgcgtgtctgatgactaacgatgtatgacggaacttctaccggcaggtgtgacacgtgctctccaatgatgagaccatgcaaattgtgacatatatcaaagtctgatggttgcaatgtagtagtgaaacaactaaattaaaataacaaaatttatgtatagctaggatcacaaatggattatgaaacattttcttataacaatataagacacatcttgtatatatgttatcatggtattatatgtttccgttgcaattcacagctactcaccctcgcctagtaataacatgaaaacatccgtgattctcgcacagcaagtttggccgtttggttagtcgaaatccaacttcaattctttggcaactctgtttccttgttggtgaggtcgtgactcgtgaaggtgaggtggaaagccggtggaggttgacagcaccgtcagatcaacgggtctaccgttcatcactgatccaacgtctcatatcatttcaacgaacaggtcgttcgtctcacgcatgacacacgatataaaccatctcgtcaatgccgactcctccctccatactactacttcacgatctggtccaaagccccaactcaaatttacatccaggccattcgccggagatggcgtcggagctgacgtaccgcggcggcagcgtggcgccaggctccgcctccaacggtggggaatactccccgaagtcctccaagccgctctcctggctcgcccgcgccgcgcgctacgccgccgccgagcaccgccccgtcttcgccctcgccggcatgctcttcgctgccgctatcttcaccttctcttccccctccactttatctccgtccgaacccgccgcgtcggtcggcttcaaccaccttgccgtcagcgggcacccgtccttccgcgagtccgtcggcgggaaggttcccctggggctgcgtcggcgcgcgctgcgggtgctcgtgacgggcggcgccgggttcgtggggagccacctggtggaccggctgttggagcgcggcgacagcgtgattgtggtggataacttcttcacggggcgcaagggcaacgtggcgcaccatctccagaaccccaggttcgaggtgatccgccacgacgtcgtcgagcccatactgctcgaggtcgaccagatctaccaccttgcctgtccagccagccccgtgcactacaagtacaaccccatcaagaccatcaagacaaatgttgttgggacactgaacatgcttggattggccaagaggattggggcaaggttcctacttacaagcaccagtgaggtttatggtgatcccctccagcaccctcaggtggaaacctattggggcaatgtcaaccctataggtgtcaggagctgctatgatgagggaaagcgtacagctgaaacattaaccatggactaccatcgtggtgccaaccttgaggtaaggattgcccggatctttaacacatatggtcctcgcatgtgcattgatgacggccgtgttgtcagtaatttcgttgctcaggcgctgaggaaggagcctttgacagtctatggtgatggcaagcagactaggagctttcaatatgtctcagatttggtggaagggctgatgaagctcatggaaggggagcacattgggccgttcaacctcggcaaccctggagaattcagcatgctggagctggctaaggtggtccaggacaccatcgacccagaggcgcacatcgagttccgtccgaacaccgcagatgatccgcacaagcgcaagcctgacatcagccgcgcgaaagagctcctcggctgggagcccaaggttcccctccgtgagggccttccccgcatggtcactgacttccgcaaacgtatcttcggggaccaggaagggtccaccgagtcagctggtggcctttcttaagtgctcaaaacttgttgaagtgacacgtttgtatggtatatgacttgatacagttttggcgctgtgctctatacgtagttgttatatagggatataaatgtttgttaaagtacggaaaatagcctggcacgctatactatgtaacgacgtaccattttgtaatgtcattgttaacgggttatccagaatgctaatagcgttataatcttacattacatatatctgagcatgagtttgaatctgcaccagactgggaatgattggtcatacataactttgacaagcataataagacctctatattataaaccgcaggtcatcattcctttatttgccatggttgaagaaagcaggcgcccatctgatccgggaccgagacggcgattctatctttcacatctccgcgtggtgatgcgtccggccggcaagcccgcagaggaagccctggcgccgccgagggcgcccttgttgtgtgtgcactttgccgtccacggtgccgtggccttcgatggacttggccggagctggcgccagcttcctggtcatatggcgttcctccacggcccagctccggctgcggtggttgagccaggacacgatgtcggagaagatggcctccacgttctcgtcgggctccccggcggtgaggccgtgccacatccccgggtacagcttgatggtcttgtcggcgctggccgaacgctcgtacagcgcgcggctcacctccgggtccgtcaccgtgtcg

SEQ ID NO: 3499 - DNA, 1727 bp, Panicum virgatum
aaaaaaaaaaagactccttccgtcctctcctacttcgcagaccggtccaaatccccaactgaaattttgcgcccaggcccttcgccggagatggcgtcggagctcacgtaccggggcgccgccgcggcgcacggctccgcctccaacggcggggagtactccccgaagccctccaagccgctctcctggctctcgcgcgccgcccgctacgccgccgccgagcaccgccccgtcttcgccctcgccggcatgctcttcgccgccgccctcttcaccttctcctcctcctcctcctcctccacatccgactcgtcctacgccgccgcgtcggccggattcagacacctcgccatcgccgggcacccgtccttccgcgagtcctccgtcggcggcaaggtgcccctgggcctgcggcggcgcgcgctgcgggtgctcgtgacgggcggcgccgggttcgtggggagccatctggtggaccggctggtggagcgcggcgacagcgtgatcgtcgtggacaacttcttcacggggcgcaaggggaacatcgcgcaccacctccagaaccccaggttcgaggtgatccgccacgacgtcgtcgagcccatactgctcgaggtcgaccagatctaccacctcgcctgcccggccagccccgtgcactacaagtacaacccaatcaagaccatcaagacaaatgtagttgggacactgaatatgcttggattggcaaagaggattggggcaagatttctactcaccagcaccagtgaggtctatggtgatcctctccagcaccctcaggtggaaacttactggggcaatgtcaatcctattggtgtcaggagctgctatgatgagggtaagcgcactgctgaaacattaaccatggactaccatcgcggtgccaaccttgaggtaaggatcgcccggatctttaacacatatggtcctcgcatgtgcatcgatgatggccgtgttgtcagcaatttcgttgctcaggcgctgaggaaggagcctttgactgtctatggtgatggcaagcagactaggagctttcagtacgtctcggatttggtggaagggctgatgaagctaatggaaggggaccacattggaccgttcaacctgggaaaccctggtgaattcacgatgctggagctggctaaggtggtccaggacaccattgacccagaagcgcgcattgagttccgtccaaacactgcagatgatccacataagcgcaagcctgacatcagccgagccaaagagcttcttggctgggagcccaaggttcccctacatgagggccttcctctcatggtcactgacttccgcaaaagaatcttcggggaccaggaaaaatccactgaggcagctggtggcctttcataatcctcaacatgtcaaagttacgcatttgttcagtctctatgatcacatgacacgaaaatgggaggaagggagcaaacgatctggacagttttggtggtatatgccctttggctgctctgtacaacacggacaaaaggtcatggctgtacgtagttcttagaagatgttggatactaccaaaatatcttggtattgctgtaatgatgttcttttctttttggttcttttgccagtaataattctatatgtaacaacatacaatttgtaatggtgtcgttaacagataatctgggttgctaataatacattaaggttataagctcatagtacatgtt

SEQ ID NO: 3500 - DNA, 2544 bp, Panicum virgatum
tttgactctctaagatttttaaaatgatttataatttggaacgctgagagtacgttgttaaaacctactttatccttttttaggagatctgttttagcgttggtgaggtcgtggagcaagaagcggggaaagcggtgagcgttggcgaggtggcgtgccgcaccggcaaaactaccatatctgccgtccaccgccgatccgacgtcccgtatcgtttcaacgcgcagctctggttcacctctcgtctcgcacatataaaccttttcttcgctccctgccgactccttccgtcgtcctacttcgcagaccgatccaaatccccaactgaaatttgcgcccgggcccttcgccggagatggcgtcggagctgacgaaccggcgcggcgccgcggcgcacggctccgcctccaacggcggggagtactccccgaagccctccaagccgctctcctggctctcccgcgccgcccgctacgccgccgccgagcaccgccccgtcttcgccctcgccggcatgctcttcgccgccgccctcttcaccttctcctcctcctcctccacatccacctcgtcctaccccgccgcgtcggccggattcggccacctcgccatcggcgggcacccgtccttccgcgagtcctccgtcggcggcaaggtgcccctgggcctgcggcggcgcgcgctgcgggtgctcgtgacgggcggcgccggcttcgtggggagccacctggtggaccggctggtggagcgcggcgacagcgtcatcgtcgtggacaacttcttcacggggcgcaaggggaacgtcgcgcaccacctccggaaccccaggttcgaggtgatccgccacgacgtcgtcgagcccatactgctcgaggtcgaccagatctaccaccttgcctgcccggccagccccgtgcactacaagtacaacccaatcaagaccatcaagacaaatgtagttgggacactgaatatgcttggattggcaaagaggattggggcaaggtttctactcaccagcaccagtgaggtctatggcgatcccctccagcaccctcaggtggaaacttactggggcaatgtcaatcctattggtgtcaggagctgctatgatgagggtaagcgcactgctgaaacattaaccatggactatcatcgtggtgccaaccttgaggtaaggatcgcccggatctttaacacatatggtcctcgcatgtgcatcgatgatggccgcgttgtcagcaatttcgttgctcaggcgctgaggaaggagcctttgactgtctatggtgatggcaagcagactaggagctttcagtacgtctcggatttggtggaagggctgatgaagctaatggaaggggaccacattggaccattcaacctgggaaaccctggtgaattcacgatgctggagctggctaaggtggtccaggacaccattgacccagaagcacgcattgagttccgtccaaacactgcagatgatccacataagcgcaagcctgacatcagccgtgccaaagagcttcttggctgggagcccaaggttcccctacatgagggccttcccctcatggtcaccgacttccgcaaacgtatcttcggggaccaggaagaatccactgaggcagctggtggcctttcttaatcctcaccatgtcaaagtgacgcatttgttcagtctatgatcacatgacacgaaattggaagacgggagcaaacgatctggacagttttggtggtatatgccctttggctgctctgtacaacacggacaaaaggtcatggctgcatacgtagttcttagaagatgttggatactaccaaatatcttggtactgctgtaatgctgttcttttctttttttggttcttttgcctgtaataattctatatgtaacaacatacaatttgtaacggtgtcgttaacagataatatgggttgctaataatacattaaggttataagcacattgcacatgtttcagcatgagtgtcaaactgatatggggcaaaagctttgatcattattgagcaaatgtttactgcaatggaagtaagggaatggttggtcatacagaaccctgacaaaaatatcgagacctatacataacaaaatgcccatcaccacttccttattcgccattgttcaaccaagtgcacgtctgatcagtgctggcagttctatctttcacatctcagcgtggtgatgcgtcctgccggcaagcccgcagaggaagcctcggcgctgtccctgaggtcgcgctcgaaccggcgcctcaccgcggttctcgctatcaacgaacttgccgggagctggcgtcatcttcgtgaggcggtcctccatggtccagctgcggctgcgctcgtagagccaggcgacgatgtcggagaagatggcctccacgttctcgtcaggctcgccggcggtaaggccgtgccacatctccgggtagagcttgatagtcttgtccgcgctggcagcgcgctcgtacagcgcgcggctgatctccgggtccgtcaccgtgtcggcctcgccgtg

SEQ ID NO: 3501 - DNA, 3400 bp, Brachypodium distachyon
cgaccgccgtagaccccgtcgagcggcaaccgacgaggcccgattgttccgcgaatcaacccgtcgctcttcttctcacacccacccgcagccgagcgttgtgtttataagatctcccctgcctcccgcaggtctccccgcagcgttaaacctcggcgacgcatcgccgagccgagctaggaccccctgaaatttgccatatttacagtcaggaacccacgatctgtaaagaaaagtcaactttgcatccacccccttcgccggagatggcgtcggagctaacgtaccgcggcggggcagccacgggctccgcctccgacggcggggagtactctcccaagccctccaagccgctctcctggctcacccgcgccgcccgctacgccaccgccgagcaccggcccctcttcgccctcgtcggcatgctcttcgccgccgccctcttcaccttctcctcgtcttcctcctcggcgggatacacctccccctccggccccgccgccgtctccttcaagcatctcgccaacatcgcgcacccgtcgctgcacgagtccgtcggcggcaagatgcccctggggctgcgccggcgcgggctacgggtcctcgtgactggcggcgccgggttcgtggggagccacctggtggatcggctcatggagcgcggcgacagcgtgatcgtggtggacaatttcttcacggggcgcaaggggaacgtcgcgcaccacctcgggaaccccaggttcgaggtcatccggcacgatgtcgtcgagcccatactgctcgaggtcgaccagatctaccacctcgcttgccctgccagccccgtgcactacaagtacaacccaatcaagacaatcaagaccaatgtggtcgggacactgaacatgcttggattggcaaagaggattggtgcaaggtttctcctcaccagcacaagtgaagtctatggtgatcccctccagcaccctcaggtggagacttactggggcaatgtcaatcccattggtgtcaggagttgctatgatgagggtaaacgcacagctgaaacactgaccatggattaccaccgtggtgccaaccttgaggtcaggattgctcgaatttttaacacgtatggtcctcgcatgtgcattgatgatggccgtgttgtcagtaactttgttgctcaggcactgaggaaggagcctttgactgtctacggtgatggcaagcagactaggagctttcaatacgtctctgatctggtggaagggttgatgaaactgatggaaggggagcacataggaccattcaacctgggtaaccctggtgagttcaccatgctggagctggctaaggtggtacaggacaccattgactcgagtgcaagcattgagtaccggccaaataccgctgatgatccacataagcgcaagccagacattacccgcgcaaaagaactcctgggttgggagcccaaggtccctctacatgaggggcttcccctcatggtcaccgacttccgcaaacgtatctttggggatcaagaggagtcgactaccacagctggtggcatgtcttaacttgaacctggcacaaattatagggaacttgtataattaattgtgtacaagagggtagaactgattacaggatttgaagaattttggtggtaacacgaggtcatggctgcatacatatatagttctttgggcaatatggaaatgataataagaatgtccttgcgctgcttaacgttgtaagctgtttcttcatttccctggcctcgttttctgagtcattcaagttgtatcatcacaatgtcaacagataactaatgtgggttggaaattcgatattcagatcatagtggtatgagcttttgtttcaacatgagcactccacttgtatagctgtatatccatgaaacatatatatttgctttaaaactgcaatggaactagagatttatttatctgttgagcaaacggcaatgggggtgattgaaggggaatgatttgtctgcctggttatattacacggatgttacacaagcatcgctacttccttattggccattggttctaggtgcacacaactgatgagaagtcttgtagcactatatctttacatcacatatttctgagtggcgatgtgtccggccggtgagaccacagaggaagcccctgcgcctctgccgccgagggcgcgactcgacgtttccagtgctgttctcgccatcaacgacgagcttgtcgggcgccgccatcatcttcatcagacggtcctcaggcgtccagctgcggctccggtcgctgagccacacgacgatgtcagagaagatggcctcgacgttctcgtcgggctcgccggcggtgaggccgtgccacatcccagggtagagcttgatggtcttgtccgtgctggcggcgcgctcgtacagcgcgcggctcacctccgggtccgtgaccgtgtcggcctcgccgtgcaggaccaagaacggcagcttcacctgcgacaagctgtcctccacgtacatgctggtcctcagcatctcgagcgctgtcttgagccggggcttgtcttggtagatcagcttgttcttcctgatctgcgtggcatgcattgcagataggatcagctcgcaaaacatatatacgctcaaaattggaaacaaatgtgctcgtttcggactttcagagcactgaaaaatgaagaaaaatgctctcgccctgcctctgaaggtatgattgaaaccaggccaggaggtgatctgaaggagagtttgatttcaccgacctgttcacgcttggcggggtccttgaaggcggcgtcaataacgtcttttgtcggaacaatcttccacttgggtattacgtcctccacctgcgtcagggcagcgatcaccagcgggtgcggcttcaccttctccgatatctgaatcaggattcaggcgcgtttccaagtaaaaacttcagttcagaaggggaaaaaaaggcgagaattcaggtgaagacagttgaggcgcagaccttgcacatgggcgcgacgagaacggcgccatcccagaaggtggggtcgttcctgtgcagcaggagcgtcacggcgccgcccatggactcgccgtagaggaaccggctcttgctcctgtactcttcaaggtctgcacgaatttttacacggcaggcaagttcaccatccggattgagttctactgatgttctgtagttagtgagggatcagtcgttggcttaccgcagacggacttgaagaatctctcgcagtcttggacgaggcgtctgaagctgcggatgtagcagcgggcgcccatggacttgccgtgcccctcgtagtccatcccgaacacgccgtaccccgccgccgcaagccgcaccccgcaagctgccatattacccgcccc

SEQ ID NO: 3502 - DNA, 2305 bp, Setaria italica
taaaccttttctcgctgccgactcctcccctccgtcctcctacctcacagaccggtccaaatccccaacagaaatttacacccaggcccttcgccggagatggcgtcggagctcacataccggggcggcgccgcggcgcccggctccgcctccaacggcggcgagtactccccgaagccctccaagccgctctcctgcctctcccgcgccgcccgctacgccgccgccgagcaccgccccatcttcgccctcgccggcatgctcttcgccgccgccctcttcaccttctcctcctccaccacctccacctcgtccccgtcgtaccccgcagcgtcggtcggattcaaccacctcgccgtcgccgggcacccatccttccgcgagtccgtcggtggcaaggtgcccctgggcctgcggcggcgcgcgctgcgggtgctggtgacgggcggcgccgggttcgtggggagccacctggtggaccgcctggtggagcgcggcgacagcgtgatcgtggtggacaacttcttcacggggcgcaaggggaacgtcgcgcaccacctccagaaccccaggttcgaggtgatccgccacgacgtcgtcgagcccatactgctcgaggtcgaccagatctaccaccttgcatgccctgcgagccccgttcactacaagtacaaccccatcaagaccatcaagaccaatgtagttgggacactgaatatgcttgggttggccaagaggattggagcaaggtttctgcttactagcaccagtgaggtctatggtgatcccctccagcaccctcaggtggaaacttattggggcaatgtcaatcctattggtgtcaggagctgctacgatgagggtaagcgcactgctgaaacattaactatggactaccatcgcggtgccaaccttgaggtaaggattgcccggatctttaacacatacggtcctcgcatgtgcatcgatgatggccgtgttgtcagcaattttgttgctcaggcactgaggaaggagcctttgactgtctatggtgatggcaagcagactaggagctttcaatacgtctcagatttggtggaagggctgatgaagctgatggaaggggagcacattggtccgttcaacctgggcaatcctggtgaattcacgatgctggagctggctaaggtggtccaggacaccatcgacaaagaagcacgcattgagttccgtccaaacactgcagatgatccacataagcgcaagcctgacatcagccgtgccaaagagcttcttggctgggagcccaaggttcccctacacgagggcctccccctcatggtcacagacttccgcaaacgtatctttggggaccagggagaattcactgaggcagctggtggcctttcttaatcgtcaccatgtcaaagtgacgcatttgttcagtctgtatgatcatcacttacacgaaaaatgggaggctcggagcatacggtctggacagttttggtggtatatgccctttggctgctctatacaacacggacaaaaggtcatggctgcatatatagttcttaggaatatgttggatgttaccaaaatatctttgcactgctgtaatgctgttcttttcttttttggctcttttggctgtaatgctttgtataactaaatacactctataatggcgtcgttaacagataatctggttgataataaattaataatacattgaggtttgcaagctttagtatatgtttcagcatgagtgtcgaactgcaatggaacaaaagctttgattattattgagcaaatgttcactgcaatggagggaagggaatggttggttggtcatacaaaactctgacaaagcatcgagacctctctatattttacaaattgcacatcaccacttccttattcgccattgttcaagcaggtgcacatcttatcagtgctgccagttctatcatcacatctcagcgtggtgatgcgtccggccggcgagcccgcagaggaagcctcggcgctgtctctgaggccgcgcgtgagccggcgctccgccgccgttctcgccatcgacgagcttgccggtcgccagcatcagcttcctcaggcggccttccatggtccagctgcggctgcgctcgttgagccaggcgactatgtcggagaagatggcctccacgttctcgtcgggctcgccggcggtgaggccgtgccacatccccgggtagagcttgatggtcttgtcgccgctggccgcgcgctcgtacagagcgcggctaacctccgggtccgtcaccgtgtcggcctcgccgtg

SEQ ID NO: 3503 - DNA, 1690 bp, Panicum virgatum
cttcgcagaccgatccaaatccccaactgaaatttgcgcccgggcccttcgccggagatggcgtcggagctgacgaaccggcgcggcgccgcggcgcacggctccgcctccaacggcggggagtactccccgaagccctccaagccgctctcctggctctcccgcgccgcccgctacgccgccgccgagcaccgccccgtcttcgccctcgccggcatgctcttcgccgccgccctcttcaccttctcctcctcctccacacccacctcgtcctaccccgccgcgtcggccggattcggccacctcgccatcggcgggcacccgtccttccgcgagtcctccgtcggcggcaaggtgcccctgggcctgcggcggcgcgcgctgcgggtgctcgtgacgggcggcgccggcttcgtggggagccacctggtggaccggctggtggagcgcggcgacagcgtcatcgtcgtggacaacttcttcacggggcgcaaggggaacgtcgcgcaccacctccggaaccccaggttcgaggtgatccgccacgacgtcgtcgagcccatactgctcgaggtcgaccagatctaccaccttgcctgcccggccagccccgtgcactacaagtacaacccaatcaagaccatcaagacaaatgtagttgggacactgaatatgcttggattggcaaagaggattggggcaaggtttctactcaccagcaccagtgaggtctatggtgatcccctccagcaccctcaggtggaaacttactggggcaatgtcaatcctattggtgtcaggagctgctatgatgagggtaagcgcactgctgaaacattaaccatggactatcatcgtggtgccaaccttgaggtaaggatcgcccggatctttaacacatatggtcctcgcatgtgcatcgatgatggccgcgttgtcagcaatttcgttgctcaggcgctgaggaaggagcctttgactgtctatggtgatggcaagcagactaggagctttcagtacgtctcggatttggtggaagggctgatgaagctaatggaaggggaccacattggaccattcaacctgggaaaccctggtgaattcacgatgctggagctggctaaggtggtccaggacaccattgacccagaagcgcgcattgagttccgtccaaacactgcagatgatccacataagcgcaagcctgacatcagccgtgccaaagagcttcttggctgggagcccaaggttcccctacatgagggccttcccctcatggtcaccgacttccgcaaacgtatcttcggggaccaggaagaatccactgaggcagctggtggcctttcttaatcctcaccatgtcaaagtgacgcatttgttcagtctatgatcacatgacacgaaattggaagacgggagcaaacgatctggacagttttggtggtatatgccctttggctgctctgtacaacacggacaaaaggtcatggctgcatacgtagttcttagaagatgttggatactaccaaatatcttggtactgctgtaatgctgttcttttctttttttggttcttttgcctgtaataattctatatgtaacaacatacaatttgtaacggtgtcgttaacagataatatgggttgctaataatacattaaggttataagcacattgcacatgtttcaac

SEQ ID NO: 3504 - DNA, 789 bp, Panicum virgatum
ttcgcctttgatagaccccgcgcaccccgtctctgtttccccaagctgcagttccgtctcgcggtctcgcctcgcctcgccgccgtctcgcgaaccgggggggcaagggcagcgcggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggctgctgttgcagagactataaagaactttgcagttatctacctcgttgacatcacggaggttcctgacttcaacacgatgtatgagctgtatgatccgtcaaccgtgatgttcttcttccggaacaagcacatcatgattgatctcgggacaggaaacaacaacaagatcaactgggccttgaaggacaagcaggagttcatcgacattgtggagactgtgtacaggggtgcccggaagggccgcggtctggtgattgctccaaaggactactccaccaagtaccgctactaggccatttgtcttgggtattgttgtgcaggttcgggtctaccatgttgggcaaatgccaactctcagacatgtaacgcataactcaatggttgtttacttgctgagtgctgcttaactttgttgacaatcaaataaaactgtaatctgattgatgatacttaaagctgaatatgtggtcaattggtaagactctggaacccaaccgggctttgccgttgtgttctgtttcctcagcctgcaa

SEQ ID NO: 3505 - DNA, 788 bp, Setaria italica
ggaatctaacggctccaccgtttgtcttcccccaaattccagttcctctctcgccgccgtctcgcgaaccggggcagcgcggagatgtcgtacctgctgccgcacctgcactctgggtgggcggtggaccaggccatcctcgccgaggaggagcgcctcgtcatcatccgcttcggccacgactgggacgagacatgcatgcagatggatgaagtgctggctgcagttgcagagactataaagaactttgcggttatctaccttgttgacatcaccgaggttcctgacttcaacacgatgtacgagctgtatgatccctcgaccgtgatgttcttcttccggaacaagcacatcatgattgatcttgggacaggaaacaacaacaaaatcaactgggccttgaaggacaagcaggagttcattgacattgtggagactgtgtacaggggtgcccggaagggccgtggtctggtgattgctccaaaggactactccaccaagtaccgttactaaagccatttgtgttggctattgttgtgtaagtaatttctggcctaccatgttggccaagttgcaactcgacttggtgaccgactccagggttctgagtgttggttaacttccttgacatctaataaaattgtagctgagctgattgatggaatattgaaattgtctccttggaatacgaacgcctgtttttgtgttccactcactctcctgcaagccagtcaatcacactggtcaccaaagttaggaatttcatcggtgacaactggctaaaggaa

SEQ ID NO: 3506 - DNA, 876 bp, Zea mays
ccgtattgggccttaccccggctgcttggcctgccgccagatccgcaggtttcggctttcgggcctcctctcccttttggcgaatcattccttctcgccgataagcagcagctcatcacctgaaggagagcagcccggaggagggggagcaagcagcagccgtccgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtgattgctccaaaggactactccaccaagtaccgttactaagaaggcaggcattccccttatgcaatctattggggatgtttacacggacagttagtccgacaggtgatccctaactgtatcttggcataccctagtaattcaagttgctggctggagtgatgcttatccatgtcttggcatgccatagtgaacatgtaaacctgtgatttgaggtgattattcgagtgtaaagaaaccaggattgcgttcgcctatgactatgtgtctagttgtctacttaataagaaacagttattggtttggaatatcgg

SEQ ID NO: 3507 - DNA, 827 bp, Oryza sativa
tccgtttcaaccactgtcgcggcctctttccccattccgtttcccccaaactatctcctcgtgaatccatcagcgagtcgccgaagcggaggaagaagcagcagcttgcggcggcggcggcgaggcggagatgtcgtaccttctgccgcatctgcactcggggtgggcggtggaccaggccatcctcgcggaggaggagcgcctcgtcatcatccgcttcggccacgactgggacgagacgtgcatgcagatggatgaggtgctagcggcagtagctgagaccataaagaactttgcggtcatctacctggtcgacatcaccgaggttccagacttcaacaccatgtacgagctgtatgatccgtcgacggtgatgttcttcttccgcaacaagcacatcatgattgatctggggacaggaaacaacaacaagatcaactgggccttgaaggacaagcaggagttcatcgacattgtggagaccgtctacagaggtgctcgcaaagggcgtggtttggtgattgctcccaaggactactccactaaataccgttactaagctatattttgccccacgctgccgttgagtggcccttagtacaagagctgtaagcttatggagttgtggtggggtgttgttgactaaaaactgtaatattgttcgaaactcgagtgtcggaacataatttacatgtcaattggtacatcaatgacaagttgattggtgtggataccaatcatccattaattatcaatactctttccagtcttataagttttaacattttggataaggttgaggtctaataattatacctttaaatatc

SEQ ID NO: 3508 - DNA, 1166 bp, Oryza sativa
ggagttactccttccatctaaaaaatcaaccttgtactacaacgaatctgtacatattcgtatctcatagtgcgaaattgtttttcggatagagggatagaaggtaaactgtagcacgaatcgtgaagcagatccgacggtcctagcaatccgaatccgccacttgcatgtgggccccgtcatctgacccttcgaaaggctttcagcccaaattccccttgcgaatcagcatcaacaggtcggcggaggcgaccggagaagttcgccgccgccgccggagaagagcgaggatgtcgtacctgctgccgcacctgcactccgggtgggcggtagaccaggccatcctcgccgaggaggagcgcctcgtcatcatccgcttcggccacgactgggacgagacctgcatgcagatggatgaggtgttggcagcagtggctgagaccataaagaacttcgcggtcatctacctggttgacatcactgaggttcctgacttcaacaccatgtacgagctgtatgatccatcaacagtcatgttctttttccgaaacaagcacatcatgattgatcttgggactggaaacaacaacaaaatcaactgggccctgaaggacaagcaggagttcatcgacattgtggagactgtctacaggggtgctcggaaggggcggggtctggtgatcgctccaaaggattactccacgaaataccgttattgaggcatttgtgttttgcctgttgcagtttctagcctactctgttaggtaaaatgctgctagcaatcaggtaagtgacaccaaaggcaaagcactgcggtctgtggacttgcaaaatgttggttagctatgtattggcatctcacaagcttgtaatgcttgacatgattgttgaaatattcatctatcaattgaaacggctgaatgatgtaaactgtttttccggtttgatgcatctggatgttgctggtgcatgttgcctttgccgtgattctacactcctaaactttctagtggtagaaactttgttggtgttctagtgtacgttgatatatctttggaaacttggtttacaactttattcaataattaatattaccatctttgttttatgtccgaagttgtcaattcatcaatattagcattttttgctctctaagttgttgccgg

SEQ ID NO: 3509 - DNA, 838 bp, Saccharum officinarum
ccgtattgggccttgccccggcgacttcgcctgccaccacatccgcaggtagctttcggccttcggggattctccaccacagcagcagctcagcaccggcaggagagaatctccgaggagcaggaaggggagcagcagccgtctgggggaagaagatgtcgtacctgctgccgcatctccactcggggtgggcggtggaccaggccatcctcgccgaggaggagcgcctcgtcatcatccgcttcggccacgactgggacgagacctgcatgcagatggatgaagtgctggcagcagtagctgagaccataaagaactttgcagtcatctaccttgttgatatcacagaggtccctgatttcaacaccatgtacgagctgtacgacccttcgacggtgatgttcttcttccggaacaagcacatcatgatcgatctcgggacaggaaacaacaacaagatcaactgggccctgaaggacaagcaagagttcatcgacatcgtggagactgtttacaggggcgcccggaaaggccgcggcctggtgatcgctccaaaggactactccaccaagtaccgttactaagaagtcaagcattcacgccgggccgcagctgctgtttgctagcccactagtatgggtgtttactcagacagtcagtccgactggtgatgcttaactgtatcttggcatgccctattatattcaagttgctggcgagtgatgcttaactatatcttggcatgccctaatatattcaagttgctggcgttaactatatcgtggcatgccatagtgagcttgtaaagttgtgatttcaggtgattggtggagtgacc

SEQ ID NO: 3510 - DNA, 865 bp, Saccharum officinarum
ctcgccgataagcagctcagcagggcaggagagaactcgagaagccccggaggagcaggagggggagcagcagccgtcgggggaagaagatgtcgtacctgctgccgcatctgcactcggggtgggcggtggaccaggccatcctcgccgaggaggagcgcctcgtcatcatccgcttcggccacgactgggacgagacctgcatgcagatggatgaagtgctggcagcagtagctgagaccataaagaactttgcagtcatctacctcgtcgacatcacggaggtccctgatttcaacaccatgtacgagctgtacgacccttcgacggtgatgttcttcttccgaaacaagcacatcatgatcgatctcgggacaggaaacaacaacaagatcaactgggccctgaaggacaagcaagagttcatcgacatcgtggagactgtttacaggggtgcccggaaaggccgcggtctggtgatcgctccaaaggactactccaccaagtaccgttactaagaaggcaggcattcgcgccgggcagcagcagccgcttgctagcctactagtatgttccccccttatgcaatctattggggatgtttactcagacagacagtcggacaggtgatgcttaactgtatcttggcatgccctagcatattctagtttctggcgagtgatgcttaactatatcttggtaagttgtgatttgaggtgattgttcgagtgtctgaaaatacaggatctgtgttctcgattatatctctactaattagaaaacggttactggtttggaagggaactgagtctatggcttccttttggtatttgtatccccccaaagaaccacaccgaaaatataa

SEQ ID NO: 3511 - DNA, 907 bp, Panicum virgatum
ggctcgttcgcgagccgttcgctcgtgggctcgccgttgtgctcgtctcctccacagaactttctaccgacttcgagaatcgagagttcgagtcggtttccgtcgtagagcccccacccggtgtggatattccaaggagggaatccaacggctcccacccaccccccgcaccacgtctttccccgagctccagttcttctcgctcgcggtctcgccgccgtctcgcgaaccgaggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggccgcagttgcagagactataaagaactttgcagttatctacctcgttgatatcacggaggttcctgacttcaacacgatgtacgagctgtatgatccgtcaaccgtgatgttcttcttccggaacaagcacatcatgattgatctcgggacaggaaacaacaacaagatcaactgggccttaaaggacaagcaggagttcatcgacattgtggagactgtgtacaggggtgcccggaagggccgcggtctcgtgattgctccaaaggactactccaccaagtaccgttactaggccatttgtatcgggtattgttgtgcaggtttgggtctaccatgttgggcaaatgccaactctcagacatttaacgcataactcaatggttgtttacttgctgagtgttgcttaactttgttgacaatcaaataaattgtaatctgatttgatccttagagcagaatatgtggtatattggtaagctctggaacctaaccgggctctgttcggctggcaatcttcatggtacctttatttg

SEQ ID NO: 3512 - DNA, 816 bp, Panicum virgatum
gacacacacccggtttcgcctttcatattccaaggacggaatcccaccggcacccaccccgcgcaccccgtctctgtttccccaagctccagttcctctcgcggtctcgcctcgccgccgtctcgcgaaccgggggggcaagggcagcgcggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggctgcagttgcagagactataaagaactttgcagttatctacctcgttgacatcacggaggttcctgacttcaacacgatgtatgagctgtatgatccatcaaccgtgatgttcttcttccggaacaagcacatcatgattgatctcgggacaggaaacaacaacaagatcaactgggccttgaaggacaagcaggagttcatcgacattgtggagactgtgtacaggggtgcccggaagggccgcggtctggtgattgctccaaaggactactccaccaagtaccgctactaggccatttgtattggatattgttgtgcaggttcgggtctaccatgttgggcaaatgccaactctcagacatgtaacgcataactcaatggttgtttacttgctgagtgctgcttaactttgttgacaatcaaataaaactgtaatctgattgatgatacttaaagctgaatatgtggtcaattggtaagactctggaacccaaccgggctttgccgttgtgttctgtttcctcg

SEQ ID NO: 3513 - DNA, 899 bp, Prunus mume
cgtcctcaagcctgttgcaatccaccaagtaggcaaaagggggatcaagattggcttggcaaacccataagtcaagttcttcaaagtgtcttctctccacactctattctccaggagctcctaccctacgcgttatccatcagatcgttgtgctagagtctaaacgctagagaggttgggactcgtggactgttgggagagaagagaaggttaacaaaaaccaatgtcgtatctactgcctcacctccactctggatgggccgtggatcaggccatcctcgctgaggaggagcgtcttgtcatcattcgtttcggccacgactgggatgagacctgtatgcagatggatgaagtgctagctgcagttgctgagacactcaaaaactttgctgtgatttaccttgttgatatcacggaggttcctgatttcaacacaatgtatgagctctatgacccatccactgtcatgttctttttcagaaacaaacacattatgatagaccttggtactgggaacaacaacaagatcaactgggctctcaaggacaagcaagagttcattgacatcgttgagacagtgtaccgtggggcaaggaagggacgcggtctcgtcattgctcccaaggattactccaccaagtaccgttactaagccctgctgacaatgtaattcatttcagacaaaaccttctagtttggatggagttaataggtgatttgtggacagaaacacaagtactgcacagtttgttgcatggactagggaagataatgtctctaaaattctgtattgttaatatttagtcatcttaatgcgataccgatgctttgtttgtgaaggctgttacctcgcagatccaaaatatgcatgatctagaagaaaactaatgttttatggc

SEQ ID NO: 3514 - DNA, 2430 bp, Panicum virgatum
aaaaatcgttaattcgatcgattcgcggctttgccggcgggcctagaaggcctcgtgacagtcgtgaagcccatgacagcgaggaatcccagtgggcctgatttgtctggcccggtggcatccgggccgtccaggccgaggcggacacgctctggcctccccggccgtggagaccagccttgacccaccagttcaccaccgctcgtgcgccgcgagacgcagcagcgaactctgcccaccctgacccgtcgtttccggggagcggatcgcccgacctgcctccacccgccaggcgcgtccgccgccgtctgcctccagatccgctggtggctctcaggctatccttctctgcgaaccgactcttcgcgcgagtcagcagctcggcgcccgcgctcgaacagaagagtcgagaggagggaggagcggccggcggcggaagaggatgtcgtacctgctgccgcatctgcactcggggtgggcggtggaccaggccatcctcgccgaggaggagcgcctcgtcatcatccgcttcggccacgactgggacgagacctgcatgcagatggatgaagtgctggcagcagtagctgaaaccattaagaactttgcggtcatctaccttgtggacatcaccgaggtccctgacttcaacaccatgtacgagctgtacgacccatcaacggtgatgttcttcttccgaaacaagcacatcatgatcgatctcgggacgggaaacaacaacaagatcaactgggccctcaaagacaagcaggagttcatcgacatcgtggagacggcctacaggggtgcccggaagggccgtggtctggtgatcgcccccaaggactactccaccaagtatcgttactaagaagacaattcgcgctagcttcgctgctgctgctgctgctgttctgcagtacaagttgctagcctagtgccttccccttgtgttagggggatgtttactcagacagtcaagcaaagggtgtttgatttgagtattgctctgtatcttgcatgtcgtaataaacctgtaaagttgtaactgtgagctgattgttcgggaatgctggtttggtactcgagactgcccaatccatggctttgttctggatattggcgcgtattcccctgtccgaagttctcctattggcggagtactgttttgctggtgccactaagactttgatttttttttttggcccgaactcaccgggttcggtactacgctctgatgcaaacactatggaatccattgtctttgtttcctgtcaaagcctgatagacatcatctcatgtcgctgccaaagtagttttaatggtacagatccaaatttctcttttttgaaacagtagtttgaatgtcactgccaaagtcttaaactaccatatggagacatcatctgatctgcccaacgggtggcaactcactcacctcctcttgtttatcttccccacgcgcccccggaagcgctccatcttcgtttgctagctaccatggttgcctcctcgacggccaccgccgatgacgcggcgccgcgcgtcgtcgaggactgccgcggcgtcctccaggtgctcagcgacggcactatcgtccggtccgtggcggtcgccgtggacgtccccgtcgacccgtccgtcgagtggaaggacgtcgtctacgacgccgcgctcggcctgggcctccgcgtgtacaagccgccagccgacggcggcgcgggaagcaagctccccgtcgtggtggccttccacggcggcggcttctgcctcaactcctacgcgacgccgcacttccacgcgcaccgcctgccggccgccatcgacgacgcggccgcggtcctactctggctccgcggccaggccgcccgctcccctgcttcctcctccgacgccgccggcgccgacccctggctgtccgagctcgccgacccgggccgggtcttcgttgcgggcgagtcggcgggcggcgtcctcgcgcaccacctcaacgtccgcttctccggcgcgccgggcgcgctccaccccgtccggctccgcggggtcgtggcgctgatgcccttcttcaccggcgccgagccgaccccctccgagctgcgctgcccggacgaggcgtacctgaaccgcgacatgtccgcccggttcgcgcggctgtgcctcccgccgggcgccaccgcggaccacccgttcctgaacccgttcgggccgggcgcgccggcgctggtggtggtggccggggacgacatcctgcgcgacaggaacgtggagttcgtgaggaggatgaggggcatggggaagcccgtggaggtggtggagttccccgggcaggggcacgccttcttctcgctccgggcgtggagcgagcccgtgggcgagctggtccgtgtcttcaagcggttcatggacgaggcctgccagctccagccttag

SEQ ID NO: 3515 - DNA, 1063 bp, Panicum virgatum
gttcgctcgtgggctcgccgtcgtgctcgtctcctccacagaactttctgccgacttcgagagttcgagtcggtttccgtcgtagagcccccacccggtgtggatattccaaggagggaatccaacggctcccacccaccccccgcaccccgtctttccccgagctccagttcttctcgctcgcggtctcgccgccgtctcgcgaaccgaggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggccgcagttgcagagactataaagaactttgcagttatctacctcgttgatatcacggaggttcctgacttcaacacgatgtacgagctgtatgatccgtcaaccgtgatgttcttcttccggaacaagcacatcatgattgatctcgggacaggaaacaacaacaagatcaactgggccttaaaggacaagcaggagttcatcgacattgtggagactctgtacaggggtgcccggaagggccgcggtctcgtgattgctccaaaggactactccaccaagtaccgttactaggccatttgtatcgggttaccgggtattgttgtgcaggtttgggtctaccatgttgggcaaatgccaactctcagacatttaacgcataactcaatggttgtttacttgctgagtgttgcttaactttgttgacaatcaaataaattgtaatctgctttgatccttagagcagaatatgtggtatattggtaagctctggaacctaaccgggctctgttcggctggcaatcttcatggtacctttatttgagctcttgttgtgcttatatcattattattatttatatgttaggatttgtcctcagtatgccagtaatcaccatcacagtcgtcctcaccgaggagtggctcggcctgcgataacttggccatcacagttcagagctgtctccttggcacaagaaactgtctacactctga

SEQ ID NO: 3516 - DNA, 444 bp, Panicum virgatum
atgtcgtacctgctgccgcatctgcactcggggtgggcggtggaccaggccatcctcgccgaggaggagcgcctcgtcatcatccgcttcggccacgactgggacgagacctgcatgcagatggatgaagtgctggcagcagtagctgaaaccattaagaactttgcggtcatctaccttgtggacatcaccgaggtccctgacttcaacaccatgtacgagctgtacgacccatcaacggtgatgttcttcttccgaaacaagcacatcatgatcgatctcgggacgggaaacaacaacaagatcaactgggccctcaaagacaagcaggagttcatcgacatcgtggagacggcctacaggggtgcccggaagggccgtggtctggtgatcgcccccaaggactactccaccaagtatcgttactaagaagacaattcgcgc

SEQ ID NO: 3517 - DNA, 843 bp, Cannabis sativa
aaaccactagaaagttccagagagagaaggttatattggtctcagttgttaattaatactgtaagagagagagagagagagagagagagagagagagagatgtcgtacttgcttccacatttgcactctggatgggccgtagatcaggccatcctcgccgaggaagagcgtctcgtcatcatccgatttggccacgactgggatgagacctgtatgcagatggatgaagttttggcatcagttgctgagacaatcaaaaactttgcagtgatataccttgtcgacatcactgaggttccagatttcaacacaatgtacgagttgtatgacccatctacggtcatgtttttcttcaggaacaagcacattatgatcgatctcggaactggaaacaataataagatcaactgggccctcaaggataagcaagagttcattgacattgttgagactgtgtaccgtggagcaaggaagggacggggtcttgtgattgctcctaaggattactctaccaaatatcgctactaagttcttttgcaaaagaacaccatttctttgatggaattcactggaacttgtttctctagaaaaccatttctttgagaatctgtcgaatttctcaaagatttatttctctcaaatcttgtgtacttagcatttaacctatttggacgctttagtgcgatgtccaggagaatgaaacagaatgtgacaacttgatataatgctgtgtgtagtacatatgcttttcatctaatggtttgtataaatttcacttgaataaaagttttgagcacttatcacccacctcaccaatttattcggtggcttgatcattttttt

SEQ ID NO: 3518 - DNA, 903 bp, Cannabis sativa
tatacatcaaaattagcctaaacctatggttattaattttaaccaacaatatgcgtcaaatttcccaatcttatccgtacgtagacccgggtgcaccccaacatagaattttccagaaactaattggtctcagttgttaattaatagtttaatactgagagagagagatgtcgtacttgcttccacatttgcactctggatgggccgtagatcaggccatcctcgccgaggaagagcgtctcgtcatcatccgatttggccacgactgggatgagacctgtatgcagatggatgaagttttggcatcagttgctgagacaatcaaaaactttgcagtgatataccttgtcgacatcactgaggttccagatttcaacacaatgtacgagttgtatgacccatctacggtcatgtttttcttcaggaacaagcacattatgatcgatctcggaactggaaacaataataagatcaactgggccctcaaggataagcaagagttcattgacattgttgagactgtgtaccgtggagcaaggaagggacggggtcttgtgattgctcctaaggattactctaccaaatatcgctactaagttcttttgcaaaagaacaccatttctttgatggaattcactggaacttgtttctctagaacaccatttctttgagaatctgtcgaattcctcaaagatttatttctctaaaatcttgtgtacttaacatttaacctatttggacgctttagtgcgatgtccaggagaatgaaacagaatgttacaacttgatataatgctgtgtgtagtacatatgcttttcatctaatggtttgtataaatttcacttgaataaaagttttgagcacttatcacccacctcaccaatttattcggtggcttgatc

SEQ ID NO: 3519 - DNA, 600 bp, Vigna unguiculata
gtttgagtcgaaagctggaagtgattctcagttagggttccaagaaatcaagaagaagaagaagatgtcgtatctgttgcctcacttgcactccggctgggccgtcgatcaagcaatcctcgccgaagaagagcgtctcgtcattatccgatttggtcacgattgggacgaaacctgcatgcagatggacgaggtgttggcctcggtggcggagacgataaagaacttcgcggtgatatacctggtggacataacggaggtgccggatttcaacaccatgtacgagctctacgatccttcgacggtcatgttcttcttcaggaacaagcacatcatgatcgatctcggcactggaaacaacaacaagatcaattgggctctcaaggacaagcaggagttcattgacatcgtcgagactgtttaccgcggcgcgaggaagggtcgcggtctcgtcatcgctcccaaagattactccaccaaataccgctactgattcatgcggatctgtaaagtaaaacaaacgaattactctgccatgttacttatgtggtggtggttgtgtgattgattgttctgatatgcaatctaaaccctgttgaa

SEQ ID NO: 3520 - DNA, 598 bp, Cynodon dactylon
gggggtcgacggtttcgcccaaatttctgtgtgaaatcaggcgctcgcggaagccgagaggaggaggagcgccgccgccggcgaggggaagggaggcgaagatgtcgtacctgctgccgcatctgcactcggggtgggcggtggaccaggccatcctcgccgaggaggagcgcctcgtcatcatccgcttcggccacgactgggacgagacttgcatgcagatggatgaagtgcttgctggagttgccgaaacaataaagaactttgctgtcatctacctcgtcgacatcacagaagttcctgatttcaacaccatgtacgagctgtatgatccatcaacagtgatgttcttcttccggaacaagcacatcatgattgatcttgggacaggaaacaataacaagatcaactgggccttgaaggacaagcaggagtttattgacatcgtggagactgtctacaggggtgcccgcaaaggtcggggtcttgtgattgctccaaaggactactccaccaaataccgttactaaggcatttgtgttactgttgtaatttctagcctgctgtttggcaaatgacacagcattcaaacatagtt

SEQ ID NO: 3521 - DNA, 972 bp, Setaria italica
ccggtcaaggccgaggcggacacaccacacgctctgccggccgagacccgccttgatccacctccacacgacgcggcagcaaacgcgtctcgtctccggggagcggagcacctgacctgcctccagccgccgtccacagacgcgtcctccgcctccgccgtatacctccagatccgcaggagagaagtcgagagaaggaggagcggccggcggcggaagaagatgtcgtacctgctgccgcatctgcactctgggtgggcggtggaccaggccatcctcgccgaggaggagcgcctcgtcatcatccgcttcggccacgactgggacgagacctgcatgcagatggatgaagtgctggctgcagtagccgagaccataaagaactttgctgtcatctacctcgtagacatcaccgaggtcccggacttcaacaccatgtacgagctgtacgacccgtcgacggtgatgttcttcttccgtaacaagcacatcatgatcgatctcgggacgggaaacaacaacaagatcaactgggccctgaaggacaagcaggagttcgtcgacatcgtggagaccgtctacaggggtgcccggaagggccgtggtctggtgatcgctcccaaggactactccaccaagtaccgttactaagaagttactaagaaggcaggcaatggtgtcggctgctgctactgctgctgtgttagcttgatatgttcccactcatgtaatgagggatgttttatccagacaggcagacaagggatgcttgcttgtgagcgtgttgcttaactatcttggcatgccataaacctgtaaagctgtaatatgagctgatcgttggagtgtcaaaaattgtgtttttcacaaaacagggctcatgttactataagagaccattgctggtttgacgcatactgccgagtccatagctttcttttatattctgatgagcaagttttcgcagtctgg

SEQ ID NO: 3522 - DNA, 762 bp, Humulus lupulus
agatctgaaagaggatattttggtctcgttcttggttaatcattctgtagagagagaaacaagagagagagtgagggaagggcagggatgtcgtacttgcttccacatttgcactctggttgggccgtagatcaggccatcctcgccgaagaagagcgtctcgtcatcatccgttttggccacgactgggacgagacctgtatgcagatggatgaagttttggcatcagttgctgagacaattaaaaattttgctgtgatataccttgtcgacatcaccgaggttccagatttcaacaccatgtacgagttgtatgacccatctacagtcatgtttttcttcaggaacaaacacattatgattgatcttggaactggaaacaataataagatcaactgggccctcaaggacaagcaagagttcatcgacattgttgagacggtgtaccgtggagcaaggaaagggcgtggtcttgtgattgctcctaaggattactctaccaagtaccgctactaagttcttttgtaaatatatatggctatatttgatagaattctcataaacttgtttcagaatcttcatttctcaagaaaccatttttttgagaatctgtcaaatttctagaagattcatgtctctcaagtccttgtgtatttaaaatttaactatttggatgcattattgcgaggtccagaagaatggaattgaatttctgtcataatttgatgaagtgtgtaaactaatgtctatttgcatattaga

SEQ ID NO: 3523 - DNA, 834 bp, Pennisetum glaucum
gtgatgccggccgagaccgacccgacttgatccacctacacacggcgcggcggcgcgacagcaaactctgattcgtctccagcggtccagccgcctccgccgcccgccgtcgccgccgtccgcctccagatccgcaggagagaagtcgagggaggaggagccggccggcggcggaagaagatgtcgtacctgcttccgcatctgcactcgggttgggcggtggaccaggccatcctcgccgaggaggagcgcctcgtcatcatccgcttcggccacgactgggacgagacctgcatgcagatggatgaagtgctggctgcagtagccgagaccataaagaactttgctgtcatctacctcgtcgacatcaccgaggtccctgacttcaacaccatgtacgagctgtacgacccatcaacggtgatgttcttcttccgtaacaagcacatcatgatcgatctcgggacaggaaacaacaacaagatcaactgggccctcaaggacaagcaggaattcaccgacattgtggagactgtctacaggggtgccaggaagggccgtggtctggtgattgctcccaaggactactccaccaagtaccgttactaagaaggcaggcatcggcatctgcttctgctgttgctgatgctgttgtattagcctgatgtgttcccactgatgtaaatgggggatattttatgcatacaggcagacaaggtattcttgcttgctgagtgttgcataactgtatcttgactcgccaattgccataaacatgtaaacctgtaatatgagctgattgttctgattgtcaaattcatgtttttcacaaaa

SEQ ID NO: 3524 - DNA, 769 bp, Pennisetum glaucum
cccgacttgatccacctacaccacacggcgcggcggcgcgacagcaaactctgattcgtctacagagcggagaccttgtctccagcggtccagccgcctccgccgcccgccgtcgccgccgtccgcctccagatccgcaggagagaagtcgagggaggaggagccggccggcggcggaagaagatgtcgtacctgctgccgcacctgcactccgggtgggcggtggaccaggccatcctcgccgaggaggagcgcctcgtcatcatccgcttcggccacgactgggacgagacatgcatgcagatggatgaagtgctagctgcagttgcagagactgtaaagaactttgcggttatctatcttgttgacatcactgaggttcctgacttcaacacgatgtacgagctgtatgatccatcaaccgtgatgttcttcttccggaacaagcacatcatgattgaccttgggacaggaaacaacaacaagatcaactgggccttgaaggacaagcaggagttcattgacattgtggagactgtgtacaggggtgcccgaaagggccgtggtctggtgattgctccaaaggactactccaccaagtaccgttactaaaaagccatatgtgttggctattgttgtgtaatttctggcatactgtgttgggaaattgcaactcgaccgactccagggttttgagtgttgattaactccttacatataataaaattgtgcttgagctagaaaaaaaaaaaaaaaaaaaaaagtacta

SEQ ID NO: 3525 - DNA, 864 bp, Elaeis guineensis
ctttgccctgcttgctatcgttcccgtccttctcgtttgccttgctgcgagagaacagagcgagataggagttgccgtgtgtgcgagagagagagagaggatgtcgtaccttctgccgcatctgcactcaggggtgggcggtggatcaggccatcctggccgaggaggagcgcctcgtcatcatccgcttcggccacgactgggacgaaacttgcatgcagatggatgaagtgctggcttcagttgcggagaccataaagaactttgcggtgatatacctggttgacatcacagaggtgcctgactttaacaccatgtatgagctttatgacccctcaacagtgatgttctttttccggaacaagcacatcatgatcgatcttgggacggggaacaacaacaagatcaactgggcccttaaggataagcaggagttcatcgacattgttgagacagtatacaggggtgccaggaaaggccgtggtttggtgattgctcccaaggattactccaccaagtatcgctactaaattgatgatttctgtgaaatgtttatcagactggcagcttgcccagtactttgtgaaactatattctgaattgcattagaagtactaaaactgcttgatatgaagtgctggatgggttacatgattactcttttaaaatttgaccaagttacagtctggggcttggtgtaaattgttatcatgtattcagaaccccttctttatcagatttgtaaactcaaacacacttttatcagaaccatctgcccccttgtaatcttatccatggaacccttctgaccaaaaaaaaaaaacaaaacagagactcgaccgaacggacaacaacggagggaag

SEQ ID NO: 3526 - DNA, 832 bp, Prunus persica
tgcaatccaccaagtaggcaaaaggggatcaagattggcttggcaaacccataagccaagttcttcaaggtgtcttctctccacactctattctctaggagctcctcccctacgcgttatccatcagatcgttgtgctagagtttaaacgctagagaggttgggactcgtggactgttgggagagaagagagggttaacaaaaaccaatgtcgtatctactgcctcacctccactctggatgggccgtggatcaggccatcctcgctgaggaggagcgtcttgtcatcattcgtttcggccacgactgggatgagacctgtatgcagatggatgaagtgctagctgcagttgctgagacactcaaaaactttgctgtgatttaccttgttgatatcacggaggttcctgatttcaacacaatgtatgagctctatgacccatcgactgtcatgttctttttcagaaacaaacatattatgattgaccttggtactgggaacaacaacaagatcaactgggctctcaaggacaagcaagagttcattgacattgttgagacagtgtaccgtggggcaaggaagggacgcggtctcgtcattgctcccaaggattactccaccaagtaccgttactaagccctgctgacaatgtaattcatttcggacaaaaccttctagttgggatggagttacattgaacttttataggtgatttgtggacagaaacacaagtactgcacagtttgttgcatggactagggaagataatgtctctaaaattctgtattgttaatatttagttgtcttaatgcgataccgatgttttgtttgt

SEQ ID NO: 3527 - DNA, 924 bp, Panicum virgatum
ggagcgaactctgaccaccctgacccgtcgtttccggggagcggatcacccgacctgcctccacccgccaggcgcgtccgccgccgtctgcctccagatccgctggtggctctcaggctatccttctctgcgaaccgactcttcgcgcgagtcagcagctcggcgcccgcgctcgaacagaagagtcgagaggagggaggagcggccggcggcggaagaggatgtcgtacctgctgccgcatctgcactcggggtgggcggtggaccaggccatcctcgccgaggaggagcgcctcgtcatcatccgcttcggccacgactgggacgagacctgcatgcagatggatgaagtgctggcagcagtagctgaaaccattaagaactttgcggtcatctaccttgtggacatcaccgaggtccctgacttcaacaccatgtacgagctgtacgacccatcaacggtgatgttcttcttccgaaacaagcacatcatgatcgatctcgggacgggaaacaacaacaagatcaactgggccctcaaagacaagcaggagttcatcgacatcgtggagacggcctacaggggtgcccggaagggccgtggtctggtgatcgcccccaaggactactccaccaagtatcgttactaagaagacaattcgcgctagcttcgctgctgctgctgctgctgttctgcagtacaagttgctagcctagtgccttccccttgtgttagggggatgtttactcagacagtcaggcaaagggtgtttgatttgagtattgctctgtatcttgcatgtcgtaataaacctgtaaagttgtaactgtgagctgattgttcgggaatgctggtttggtactcgagactgcccaatccatggctttgttctgtatattggcgcgtattcccctgttcgaagt

SEQ ID NO: 3528 - DNA, 748 bp, Panicum virgatum
aggagggaatccaacggctcccacccaccccccgcaccccgtctttccccgagctccagttcttctcgctcgcggtctcgccgccgtctcgcgaaccgaggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggccgcagttgcagagactataaagaactttgcagttatctacctcgttgatatcacggaggttcctgacttcaacacgatgtacgagctgtatgatccgtcaaccgtgatgttcttcttccggaacaagcacatcatgattgatctcgggacaggaaacaacaacaagatcaactgggccttaaaggacaagcaggagttcatcgacattgtggagactctgtacaggggtgcccggaagggccgcggtctcgtgattgctccaaaggactactccaccaagtaccgttactaggccatttgtatcgggttaccgggtattgttgtgcaggtttgggtctaccatgttgggcaaatgccaactctcagacatttaacgcataactcaatggttgtttacttgctgagtgttgcttaactttgttgacaatcaaataaattgtaatctgatttgatccttagagcagaatatgtggtatattggtaagctctggaacctaaccgggctctg

SEQ ID NO: 3529 - DNA, 683 bp, Phaseolus vulgaris
atggtggaggaagcagttgcctccaatcaaaatcaatatctgttgtgtttgagtcgaaagctgaaaccgaatcaattagggttccaagaaattaagaagaagaagaagaagaagatgtcgtatctgttacctcatttgcactcaggatgggccgtggatcaagcaattcttgccgaagaagagcgtctcgtcatcatccgattcggtcacgattgggacgaaacctgcatgcagatggatgaggtgttggcgtcggtagcggagactttaaagaacttcgcggtgatatacctggtggatataacagaagtgccggatttcaacaccatgtacgagctctacgatccttcaactgtcatgttcttcttcaggaacaagcacatcatgatcgatcttggtactggcaacaacaacaagatcaattgggctctgaaggacaagcaggagttcatcgacattgtcgagaccgtctaccgcggtgcgaggaagggtcgtggtcttgttatcgctcccaaagattactccaccaaatatcgctactgattcaagctgatctgtaaagtaaaacaaacgaattactctgtcaaacttttggcagcaatacctgcttgttgttgtttgttatcggaacttgctacgttttataaataaaaatctggaactgagtgtttttaatgtttaca

SEQ ID NO: 3530 - DNA, 724 bp, Ricinus communis
gtggaatctacgcaagaattgtaggattagggattggagtcggtggacagattagagacagagaaagatgtcgtacctgcttccacacttgcactcaggatgggccgtcgatcaggccatcttggccgaggaagagcgtcttgttgtcatccgattcggccacgactgggacgagacctgcatgcagatggatgaagttttggcctcagttgctgagacaataaagaactttgctgtcatataccttgtggacatcacagaggtgcctgattttaacacaatgtatgagctttatgatccatccacggtcatgttcttctttaggaacaagcacattatgattgatcttggtactggaaataacaacaaaatcaattgggctctcaaggacaagcaggagtttattgacattgttgagactgtgtaccgtggggcaagaaagggccgtggtttggttattgctcctaaagattactccaccaagtatcgctactaagttttaagggaagttattaatttgaccttgcaagaacttgtactgaaaactatatgtttgtgtagaattcgaaaattttaatagatgtgcaatgttctggttaattagtttctagtagtaatgctacttctgttccagttttacacgttaatgcatagacaatgcatttaaatttgacataatgacatttatcttgagttaaatacttaaattcatgcaattttcacc

SEQ ID NO: 3531 - DNA, 645 bp, Olea europaea
aaggagagacgatgtcgtacttgctaccccatctccactctggatgggcggtggatcaggcaatcctcgctgaagaagaacgcctcgtcattatccgatttgggcacgactgggacgatacctgcatgcagatggatgaggtgctggcttctgttgctgaaacaataaagaattttgctgtgatttacttggtggatataactgaggtgcctgatttcaacacaatgtacgagctgtacgatccgtcgactgtcatgttctttttcaggaacaaacacatcatgattgaccttggcactgggaacaacaacaaaattaactgggctctcaaggataaacaggagttcattgacatagtcgagactgtctaccgtggtgccaggaagggccgaggattagttattgccccgaaagattactccaccaagtatagatactaagtacttgaattggtgtgtgtgatttcatcatgtgatttaggctaccttggcagctcataggttattgctgcaaaattctgtgtaccaaatatcgatacaatgatatctgagtaatgattcgtgggcagacaattcaattgagtcctttgaaccatcggagtacaaagattctcccgtgttttaaaaaatgcgactctgcgagcct

SEQ ID NO: 3532 - DNA, 726 bp, Glycine max
aaagctacgcgaaattagggttgatcgaggaagaagaagaagatgtcgtacctgttgcctcacttgcactctgggtgggcggttgatcaagcaatcctggcagaagaggagcgtctggtcgtgatccgtttcgggcacgactgggacgaaacctgcatgcagatggacgaggtgttggcgtcggtggcggagacgataaagaactttgcggtgatatacctggttgacataacggaggtgccggatttcaacaccatgtacgagctctacgacccttccacggtgatgttcttcttcaggaacaagcacatcatgattgatctgggaaccggtaacaacaacaagatcaactgggctctcaaggacaagcaggagttcatcgacattgttgagaccgtctaccgtggagccaggaagggacgtggtctcgtcatcgctcccaaagattactccaccaagtaccgttactagtttcattcatctgtaacatacaacaaactaaatattatctcttttcttacttctctggtgtggtgctggttgtggttgtatgatcattctgatttctgcttattcacaactctgttacatgaattgcttttgtcatatgctaaagtgttgttagaataattccttagttttgcaactttgctttagtagtttaggatcgttggtgaagcaaacacaatttgattttttcaataaaagttgacatttttactttga

SEQ ID NO: 3533 - DNA, 866 bp, Amborella trichopoda
gttacaagacgatagaataacttttccttccctcccgctcctatttattctagagtgagagtacggggggtccctgagagaggctggttttagagagagattggggttttcgacagagaggggagagagtagggtttagagagagaaaggaggaggatgtcttatttgctgcctcatcttcactctggttgggccgtggaccaggccatccttgctgaggaggagcgcctcgttgtcatccgcttcggccatgactgggacgagacttgcatgcagatggatgaggtgctcgcctcagtggccgaaactatcaagaactttgcagtcatatacttggtggacatcacagaggtaccagacttcaacacaatgtatgagctctacgacccctccactgttatgttcttctttcgtaacaagcacatcatgatcgatctcggcaccggtaataacaacaagatcaactgggctcttaaggacaagcaagagttcattgacattgtcgagactgtctatagaggggctcgaaaggggcgcggtttggtgattgccccaaaagactactcaaccaaatatcgatactagagtcatctttctcattgttatgaagagctgagacttcattttacgcctgtaatttgatggtgcaactgcaatttgtaattgttgggatgttggattcgtttttagaaactttcatatttggccttgactaaacgaaaaatatctggtgagttggttctcatgagtgccgtgcccgacttggcttttgagggaactaggacttgaaacacattttaaatcactacgaatcaatttccgcaatggatccatgatgtggtgctcaaaaaagaatgtggatttga

SEQ ID NO: 3534 - DNA, 824 bp, Amsonia hubrichtii
acattatatacttcattattcacgaaccgcgatataagcataaaccttacgcagcagtcatcagaggagaaaaggtaggaagaagtaacgatgtcgtacttgctgccgcaccttcactccggctgggccgttgatcaggcaattctggccgaagaagaacgccttgtgattatccggttcggacatgactgggacgaaacgtgtatgcagatggatgaagtgttggcatcagttgctgagaccataaagaactttgcagtgatatacctggtggatataactgaggttcctgattttaacacaatgtacgagttgtacgatccatccaccgtcatgttcttctttaggaacaagcatattatgattgatcttggcactggtaacaacaataagatcaactgggcactgaaggacaaacaagagttcattgacattgttgagaccgtgtttcgtggtgcaagaaaaggccgtggtctagtcatagcccccaaagattactctacgaagtatcggtactgagcacctatttgtctgcatcattatatgtggtgccgcctattgtactcttgtataacattgctactgatcaaaccatttgcatctactgaactgatatttgccgagatgggatgtatccgaatatatatagatgatgttcttggcagttaatgaatgagtttcgatgtggctattctgaatcatttttaccacaagtacttggtttcacttttcatttgaaggattcattggtgtaaagatttttttatcagttgctggtctttgaaacatttctccaaatggtttgtttagtcatctttaattat

SEQ ID NO: 3535 - DNA, 513 bp, Musa acuminata
ctgcttgctctgctcgttttgttctgttttcgcagagagagagcgagcgagcgagagagagagagatgtcgtaccttttgccgcacctgcactcagggtgggcggtggatcaggcgatcctggcagaggaggagcgcttggtcgtcatccgcttcggccatgactgggacgagacctgcatgcagatggatgaagtgctggcttctgttgcagaaaccataaagaactttgcagtgatctacctggttgatatcacggaggtgccagacttcaataccatgtacgagctgtatgatccctcgaccgtgatgttcttcttcaggaacaagcatatcatgatcgatcttgggacagggaacaacaacaagattaattgggccctcaaggataagcaggaattcatcgacatcgtggagactgtgtacaggggtgcaaggaaaggccgtggcctggtgattgctccaaaagactactccaccaagtatcgctactgatatatatatatatatatat

SEQ ID NO: 3536 - DNA, 746 bp, Musa acuminata
atgaccgactttggcctttcgaagggtataattgtaagtttgtttgcttgtcgatacctctgcttgcgcgaggcggcggagggagaaggagggtcgagtggaggcgcgaagaagatgtcgtacttgttgccgcatctgcactcggggtgggcggtggatcaggcgatcctggccgaggaggagcgcctcgtcgtcatccggtttggccacgactgggacgagacctgcatgcagatggatgaagtgctggcttcagttgcagagaccataaagaactttgcagtgatttacttggttgatatcaccgaggtgcctgacttcaatactatgtacgagctgtatgatccttcaaccgtgatgttcttcttcaggaacaagcatatcatgattgacctcgggacgggtaacaataacaaaataaattgggcgctcaaggacaagcaagaatttattgacattgtggagactgtttataggggagccaggaaaggtcgtgggctggtgattgctcccaaagattactccaccaagtaccgctattaaacctattgatctgtgtgacagattgtgacatcgcctctgaaggttgacgatattgtgttcaagttgctcctgtattagaaatctttgatgtttgagattttactgctggtctaccaaaacttggtttgtgtattctactctgcgtgacattccgatgagcagcagatgcatttaaaggctttcctacttgcctttctgtttgc

SEQ ID NO: 3537 - DNA, 643 bp, Ocimum basilicum
tgcgaaacgatgtcgtatttgctgccgcatctccactctggatgggccgtcgaccaggcgattctcgccgaggaagaacgcctcgttatcatccgtttcggccacgattgggacgaaacctgcatgcagatggacgaggtgctggcttcagtcgctgaaacaataaagaactttgctgtcatatacctggtggatatcacggaagtgccggatttcaacacgatgtatgagctgtacgacccctcgacgtgcatgttcttcttcagaaacaaacacattatgatcgatcttggtactggaaacaacaacaagatcaactgggccttgaaggataagcaggagttcattgacattgtggagaccgtctatcgcggtgccagaaaggggcgcggtctggttattgctccgaaagattactccacgaaataccggtattaagctttgcatattcctttgaacaaatttttctggcatggatttgtaatggctgctgctcaagcttgtaagcaaattgcgtttatgtttattgtgggattgtttgttggtaccatgtttgtgtagataactttccaacaagattgtttgaaatggaaaaactttgaactggcgtttgtaccttgacgtaaaaaaaaaaaaaaaaaaa

SEQ ID NO: 3538 - DNA, 702 bp, Ocimum basilicum
gcacgagccctcgtgccgaattcggcacgaggccttctcctcctcctttcagctttgagagaccgcaaaacgatgtcgtatttgctgccgcatcttcactccggatgggccgtcgatcaggcgattctcgccgaggaggaacgcctcgtcatcattcgatttggccatgactgggacgaaacatgcatgcagatggacgaggtgttggcttccgttgctgagacgataaagaactttgctgtcatatacttggtggatatcacagaggtccccgacttcaacacaatgtacgagctgtacgatccttcgacgtgcatgttcttcttcaggaacaagcacattatgattgatcttggcactggaaacaataacaaaatcaactgggccttgaaggacaagcaggagttcatcgacattgttgagaccgtctatcgaggagccagaaaaggacgcggtctggttattgctcctaaagattactccacaaaatatcgctactgagttctacatatcatcttcaacaatatggtgtgtgattacttgttttgaaccatctcggagtaactaactccatcttgcaagattgtttgtaatggcaaaactttgaactgccatttggtcttaatgtgacatcttggttgagattgtgttattcaaatccatagaccaatgatagatctaatgaataaagttgtattttct

SEQ ID NO: 3539 - DNA, 659 bp, Phaseolus vulgaris
aatcaaaatcaatatctgttgtgtttgagtcgaaagctgaaaccgaatcaattagggttccaagaaattaagaagaagaagaagaagaagatgtcgtatctgttacctcatttgcactcaggatgggccgtggatcaagcaattcttgccgaagaagagcgtctcgtcatcatccgattcggtcacgattgggacgaaacctgcatgcagatggatgaggtgttggcgtcggtagcggagactttaaagaacttcgcggtgatatacctggtggatataacagaagtgccggatttcaacaccatgtacgagctctacgatccttcaactgtcatgttcttcttcaggaacaagcacatcatgatcgatcttggtactggcaacaacaacaagatcaattgggctctgaaggacaagcaggagttcatcgacattgtcgagaccgtctaccgcggtgcgaggaagggtcgtggtcttgttatcgctcccaaagattactccaccaaatatcgctactgattcaagctgatctgtaaagtaaaacaaacgaattactctgtcaaacttttggcagcaatacctgcttgttgttgtttgttatcggaacttgctacgttttataaataaaaatctggaactgagtgtttttaatgtttaca

SEQ ID NO: 3540 - DNA, 559 bp, Beta vulgaris
gggtgttggcgaggtggtgattttggagagacgaagagagagaaaaggagatgtcgtacttgcttccacacttgcactcaggatgggcggtagatcaagctatcctcgctgaggaagaacgtctcgtcatcatccgcttcggccatgactgggatgaaacctgcatgcagatggatgaagtgttggcctcagtagcagaaacgataaagaattttgctgtgatttaccttgtggacataacggaggtgcctgattttaacacaatgtacgagctgtatgacccctctacaataatgttcttcttcaggaacaagcacataatgatagatcttggcaccgggaacaacaataagatcaactgggcccttaaggacaagcaggaatttatcgacatcgttgaaactgtttatcgtggtgcccggaagggtcggggtctggtgatcgcaccaaaagattattccacaaaataccgctattgagcatttttgcagaatacatgtggtggaactcttatcacaagtgtattattatcaaactcgataagtttggtctacactct

SEQ ID NO: 3541 - DNA, 1143 bp, Theobroma cacao
ttaaaattgcatgaattgagtttaaattcagaattccaacaagtgaaaattacaaatgttaaaactttcttaattaattacttttttttttttactaattatcttcattcataaccttggtggactgatatctcctgcaataaggtttagggtaaacatattgtgcttgcccattcgagaagatccaaacgctgcgttttgataggttttattcgtaattttagttagcaaatgtgctcgattgcgccggcttgcgtgtggtcaacgcattgggctaactctaccgacatttcaaaatgtttggtttataaactagggtttcagacccaaaattagagggcaaaagcatttcatcggtgaaaaggaaatttagattttggagagagagggaaaacgaagtaacgatgtcgtatctgctaccacatctgcactccggatgggctgtagatcaggccatcctggcggaggaagagcgtctcgttgtcatccgattcggccacgactgggacgaaacctgcatgcagatggatgaagtgcttgcttcagttgccgaaacgataaagaactttgctgtgatttatcttgtggacataacagaagtgcctgattttaacacaatgtatgagctgtacgatccttccacggtcatgttcttcttcagaaacaagcatattatgattgatcttggcactggaaataacaacaagattaactgggctctcaaggacaagcaggagttcatagacattgttgagactgtataccgtggggcaaggaagggtcgtggtctagtaattgctccaaaagattactctactaagtaccgctactgagtattcttgcaagctgtagtggatcagatagatatatgatctacttttgcaaacttgatgcagagtatttcattagaaattatctggatgtgaatgtcattggcaatgattgcatgtatttggaagatgaaaatttgaagcatttcttgtgtttatgatgcatgttaccggtatagcatcttgtgcttgtactacagacattcgagcgctgcactgctaccgaaaggtatggtatgtgaaagcatgaaattaaatatcaattctaatatatattggttcccataagaaacaaaaaacagatgattgttgg

SEQ ID NO: 3542 - DNA, 1150 bp, Cannabis sativa
aaaaatagtatatggtaatcccccattaaaaacaccacgatttctttctttttctctctctttctttctcctcgacgaaaaaaccagaccacttctacggctctaccattcttcttcgattcgattcccttcttcttcttcttcttcttcgattcgattcccacttgctgatctactaccagttggtgctctacattcattgatttactattaacacaattacaagagagagatgtcatacttgcttccacatttacactctggatgggctgtagatcagtccattctcgccgaggaagagcgccttgtcatcatccgatttggccacgactgggatgagacctgtatgcagatggatgaagttttggcatcagttgctgagacaataaaaaactttgctgtgatataccttgtggacattactgaggttccagatttcaacaccatgtacgagttgtatgacccgtctacggtcatgtttttcttcaggaacaagcacattatgatcgatctcggaactggaaacaataataagatcaactgggcccttaaggacaagcaagagttcattgacattgtcgagactgtgtaccgcggagctaggaaaggacggggtcttgtgattgctcccaaggattactctaccaagtatcgctactaagctcttatgcaaatctatatatatttgttagaattcactgtaacttgtttctctaagaatctgtcgaatttctcaaagctttatttctcccaaaagtcaaagttcttatgttaactatttggacgctaagtgcgatgtccagaagaatgaaatacaatgttacaacttgattgaatggtgtgttagtacatattcttatcttctaatggtttaaattatatgaatttcaattgaatttggtttttgagcacagttatcactaggactgaaaattttggctgggattgactcggacttggccaacctgcgcagaccgattcgaccaacccggtcaattgagaaaacccattccctagtggcgggtcgggtctaagccggtcaattctttcgggtgggtttgggtctaatttttgctgtgaacccatttgactacttattattttgtgtataagattttagtaaaaattatatgtatatgtaatgtgtaat

SEQ ID NO: 3543 - DNA, 694 bp, Catharanthus roseus
cttgcaactcgcgcttctttagactcaagaaggagaagaacgatgtcgtacttgctgccgcaccttcactccggctgggccgtcgatcaggcgattctcgccgaagaagaacgccttgtgatcatccggttcggccatgactgggacgaaacctgtatgcagatggatgaagtgttggcatcagttgctgagaccataaagaactttgccgtgatatacttggtggatataactgaagtacctgattttaacacaatgtatgagttgtacgatccatcaacaatcatgttcttctttaggaacaagcacataatgattgatcttggcaccggtaacaacaataagatcaattgggctctaaaggacaaacaagagttcattgacattgttgagactgtctaccgaggtgcaagaaaaggacgtggtctagtcatagcccccaaagattattctaccaagtaccgttattgagcgccgtttgtcagcattgtcatatatatggtgccacctgattcttcttgtgtccatgtgtagcattgctattaatattagactatttgcattgtactgtatggtttaactgatattgctgagacatcatgtttaatgtcctcgttaatgaagcttgagtggcaaaagggcaattctggatctgtttttacgattgtggtactttatttctgttctagcaaaa

SEQ ID NO: 3544 - DNA, 825 bp, Cleome gynandra
tgttcatcaattctacataacctagcgatcgacgaacctctgtgtatactttctctcgctcttcgccttgtccgcgccatcatcaccaccggtagtgtgaacgggaggagacgaataagaggccatctcccctcagttccaggttccttttgtattggttgtcatccgacagattttacagagagagaggaaaagatgtcttatctgctaccgcacttgcactcgggatgggcggtggaccaggcaatccttgccgaggaagagcgacttgttgtcatacgctttggccatgattgggacgagacctgcatgcagatggatgaagtgctagcatctgttgccgagaccataaagaatttcgctgtgatatatctggtagacattacagaggtgccagattttaacacaatgtacgagctgtatgatccctccacggtcatgtttttcttcaggaacaagcacatcatgattgatcttggaaccggaaacaacaacaaaattaactgggcactcaaagacaagcaagagttcatcgatattgttgaaactgtctatcgtggtgcgaggaaaggtcgtggtctggtgattgctccaaaggactactcaaccaaataccgctactaatccgcttttccaacagtgtcccatagtgtgacatgccatgtataaacgtcgctcgaacatccatgaactggcgtatgattgttgtctgttattccgatttgctctttacttatccagcgatgatgtaatgctagaaacataattgactgaaactcacaagccaatgtgggagttatttacatgggtttcatcttcattact

SEQ ID NO: 3545 - DNA, 657 bp, Cyamopsis tetragonoloba
gtgaaatcgatcgagagcagcgttaaggttgaggatgtcgtacctgttgccacacttgcattcgggatgggccgtcgatcaggcaattctggcggaggaggagcgtcttgtggtgatccgattcggccacgattgggacgagacctgcatgcagatggatgaggtgctggcatcggtggcggagacgataaagaacttcgcggtgatatacctggtggacataacggaggttccggatttcaacaccatgtatgagctgtatgacccctccaccgtcatgttcttcttcaggaacaagcacatcatgatcgatcttggcactggtaacaacaacaagatcaattgggctctcaaggacaagcaggaattcattgacatagtcgaaaccgtttaccgtggtgctcgcaagggtcgtggtcttgtcatcgctcccaaggattactccaccaagtaccgttactaagtttcctgcctgcctgcctggatagatatgtaaaaccaccattctcaaactctgtatttttcttcttttaccaaacctaactcaaactcaatattattacaactacaattgtgtgtgtgactcccccgttcaagtttttactaagtgcatatgcttaattgcttgtttatactttatagtgtcttttggctcac

SEQ ID NO: 3546 - DNA, 659 bp, Cynodon dactylon
gacgggcagcggaaaaagagaggcgagaggaaggaggagcagccggcggcgggagatgtcgtacctgctgccgcacctgcactcggggtgggcggtggaccaggccatcctcgcggaggaggaacgcctcgtcatcatccgcttcggccatgactgggacgagacctgcatgcagatggatgaggtgctggcaggagtagctgagaccataaagaattttgcagttatataccttgttgacatcacagaggttcctgatttcaacaccatgtacgagctgtatgatccatcgacagtgatgttcttcttccggaacaagcacatcatgattgatcttgggacaggaaacaataacaagatcaactgggcattaaaggacaagcaagagttcattgatattgtggagactgtctacaagggtgccaggaaaggccgtggtctggtgattgctcctaaggactactctactaaataccgttactaagggttttgtgttgccgctagtggcatctcttgcctaatatgttttctaagggggcagcacttgggtaaaggatgcttacttgacgagctttgcttaactgtacaacttggcatgtcaaaacctgtaaatttgtaacatgagttgattgagtatccaaacagaatttgtgttgtct

SEQ ID NO: 3547 - DNA, 655 bp, Solanum melongena
aaattcgtccgcgcctcccgcctcaactctcttgcctcacagaagctctcagctaccaatagagagagatgtcgtatttgttgccacatcttcattctggatgggcagtggatcaagctatccttgctgaagaagaacgccttgtcatcattcgatttggacatgattgggatgatacttgtatgcagatggacgaggtgctggcttcagttgccgagacaatcaagaactttgctgtgatttacctggttgacatcaccgaggtcccagattttaacacgatgtacgagctgtatgatccatccactgtcatgttcttcttcaggaacaagcacattatgattgatcttggcaccgggaacaataacaagatcaattgggcgcttaaggataaacaagaattcatcgacattgttgagactgtctatcgtggtgccagaaagggccgcggtctagtcattgcaccaaaagattactctaccaagtacagatactaagcatttgtacatgctgttacttggttgctggaattatgatatgtactttatgataaagctggaagaactgatagaacaatgtccaattgaaatgtaaaaaattgatgaagtgtggttatgaggagttttctgataaggcttgtttggagatataaaaa

SEQ ID NO: 3548 - DNA, 2261 bp, Eucalyptus grandis
taaaattaaaaaataggctaaataaacacgcgccgagccgcctcgaaacgcagcgtagagcgcgtgggccccacgtgcgaggaagaaattccgcataaaatatatacacggcgtatccagcttgcaagcgacgcatttttcagacgctcgtcttccaactccaagtccgttgctctgcatcctttcgctagggctcggaaaagcagcagcgaggcgaagccatccgatcgtccgatcggtcgggtcggttcgagccatgtcgtatctgctgccccacttgcactccggatgggccgtcgaccaggccatcctggccgaggaggagcggctcgtcgtcatccgcttcggccacgattgggacgagacctgcatgcagatggatgaagtgctggcatcagttgcggagaccataaagaactttgctgtcatataccttgtggacataactgaggtgcccgatttcaacaccatgtacgagctttatgacccgtccacagtcatgttcttcttcaggaacaagcacattatgatagatcttggaactggaaacaataacaagatcaactgggctctcaaggataagcaggaattcatcgatattgtcgagacggtgtatcgaggtgctaggaagggtcgtggtctggtcattgctcccaaggactactccactaagtaccgctattaattctttgtgccaaactgtagttattgggtgcatgtaagtcttcagaaacccattgcgacctttgtctcctcaatttgactgaaactgtcatttagtgaatactccatacgaacttttctgcatggagcttttctgacttggtacagcgtattggataatttgataaaagttatgactgctcccttattgtgtgttgtctggctgatatgatgtttcttttgtgtatgaataatgttattgaatcgacaagagcaagaagggatagctcctaagagtttcgtaaagatttggccaagttcagccaacaatggcgatgaaatcattagtgcatttcagaatcttgaaaaggtaatcaagatgattttgtgaatattgacgccaaggtagagtttgtcagtctggtgcgatttttttttttttttttttaacgtctggtcggactgttcttcctctatcatcgagatgcagaagtcaccttgccaaatttgatagcaagggcggaggcaagctctcttgtgctcggatgtcgctcaatgtacgcctcatcttcaataattcaatatatctagtggcagggatgccagcaagcgaaatctgtgattagttttggtcatgacaaaaggctgaagcctcgagttttggaaaactgcgcgggtagaatatagaatacaaccatcaagtcccaccttgaatgtttcgtttccaattctgttgggacgatgatatgaaggtttaatatgttagcagctaaatgatggaaacatttatggcatcaatcatctatatcataggcaattcgataattgcatcgagcatctgtatcagatattcccccgacttcgggggtggttatcgaaattgtcctgcgtacctgtgacttctttgggtatgttctaacaatacaatgtgatgtcacatcttcttttgctctttagctgatcccactttgcttagagctgcttctactagatctacgaccgttacaccaatgaaataccacgtgatcccggctaacagtacctgcatccacgagctgttaacgatgtccagcgctagagatccgccgacgtgctgttgcaaatccccaaccattccatccccaacctgtgacctcacaattgcagcggcaaccgaggctgcacagactggaaacgcccgccatagtgggttccttgaagtattcctctttgtgctcggacggggatcgcgtctcttttgctttgtgttagatgaggactccttggaaactctaggagcagattcctcctcagttgcggttgcaggcggaagcgcatggagagtgggaatccaatactcatcatggtatgagaggcttgcggtggttcgtctggcattcgcagatttgacacctgccaatttcctagaagccgcagcatcgcggagtttcttgaggtctggatcccttgaatctccagttctacgtgtcagggctttgcttcccatgtcgggcgattgccagtatatccagtttgagatcgacctgattgcctggatagctgaaactcgagccttcatttgcagatcagtctgctggaaatgaacttcccattactac

SEQ ID NO: 3549 - DNA, 593 bp, Euphorbia peplus
gatgtcgtaccttctccctcacttgcactcaggctgggccgtcgatcaagccatcctggctgaggaagagcgcctcgttgttatccgtttcggccacgattgggatgaaacctgcatgcagatggatgaggtgctggcatcagtagcagagacaataaagaactttgcagtgatatatctagtagatataacagaggtgccggatttcaacacgatgtatgagctgtatgatccatcaacagtgatgttcttcttccggaacaagcacataatgatagatcttggaactggtaataacaacaaaattaattgggctctcaaggataagcaggaattcatcgacattgttgaaaccgtctaccgtggtgccaggaagggccgtggtttagtcattgctcccaaggattactccaccaagtaccgttactaagtctctcccgaactagtctgtataattactgttgcataaaatgactaaactttgtttttaagctagtcttctacccagatgccaagataatgcatctgacttttatgttgattgatactccctcctacgattcagtgtggatgaatatgttcgtattaatacg

SEQ ID NO: 3550 - DNA, 858 bp, Fagopyrum esculentum
aaggaaatccgtaattggtctcgttgtttttgagtgcaccgaaatttggaaggcgtgagaagagcagagaaggaggaagaagatgtcgtaccttttgccgcacttgcactcgggatgggcggtggatcaggccatccttgccgaggaagaacgcctcgtcatcatccgcttcggccatgactgggacgaaacttgcatgcagatggatgaagtgctgtcttcggtagcagagactataaagaactttgctgtgatataccttgtggacataacagaggtgccagacttcaacacaatgtatgagctgtatgatccatcaactgtgatgtttttctttagaaacaagcacatcatgatagatctgggaaccggaaacaacaacaagatcaactgggctttaaaggacaagcaggaattcatagacattgtggagacagtctatcgtggtgccaggaagggtcggggtctggtgattgcacccaaagactactccaccaagtatcgctattgagatcttgtgtacaagaatgggccggattaccatacctgtaaaactccacttatcattgtggctcgtgggatatggcgcctttattcataatatgaagtaatattggccctgatttgtgttttggatagttgttatgtatgctgcacatactttcaatcttgtaagatccaaagttcagagtggcaggagccaccagtcttgtgctagtagttctttgaaatgttcgagattctgaacttattgcacctttttatttggccataagagacctgttctgaccaaaaaaaagaaaacaaaactaaactgtcgtgtatacacctagctcttgagactcgccgaacggacga

SEQ ID NO: 3551 - DNA, 896 bp, Fagopyrum esculentum
tccgtaattggtctcgttgtttcctagttcaccgaaatttggaaggcttgagaagagcagggaaagaggaagaagatgtcgtaccttttgccgcacttgcactcgggatgggcggtggatcaggccatccttgccgaggaagaacgcctcgtcatcatccgcttcggccacgactgggacgaaacttgcatgcagatggatgaagtgctgtcttcagttgcagaaactataaagaactttgctgtgatataccttgtggacataacagaggtgccagactttaacacaatgtatgagctgtatgatccatcaactgtgatgttcttctttagaaacaagcacattatgatagatctgggaaccggaaacaacaacaagatcaactgggctttaaaggacaagcaggaattcattgacattgtggaaacagtctaccgtggggccaggaagggtcggggtctggtgattgcacccaaagactactctaccaagtatcgctattgagatcttgtgtacaagtatgggccggcttaccatacccgtaaaacttcacttatcatacattgttgtggctcgtgggatatgaagcctttattcataatatgaagcaatattggccctgatttgtgttttggatagttgttttgtatgctgcacatactttcaatcttgtgaaagatccaaggcttgagagtggcaagagccagtcttgtgctagtgctttgaaatgttggagattctgaacttattgcacgtttttatttggccataagagacttgttctgcttgttctcctctatttttagtgattgtgtaaatttctgcataatcttactctttttatggtaggtgtttacatctgagtttaaagcttaatagtgagactatttgccttc

SEQ ID NO: 3552 - DNA, 1002 bp, Vitis vinifera
taagaaataaaaaattttaattttaaccacaaagcgtgggaggttctagtcatctcgagacttcattcgaatattacgaattgggggttttaggtctaggtttcaggcgtgaagagagaaagcagaggagagtcgaggataagctgagagatgtcgtatctgctaccgcaccttcactctggatgggccgtcgatcaggccattctggccgaagaagaacgcctcgttgttattcggttcggccacgattgggacgaaacttgcatgcagatggatgaagttctggcttcagttgctgagacgataaagaactttgctgtaatatacctggtagacatcacagaggtgcctgatttcaacacaatgtacgagctttatgacccatccacagtcatgttcttcttcaggaacaagcacattatgattgatcttggcactggaaacaacaacaagatcaactgggccctcaaggacaagcaagagttcattgacattgttgagacagtttaccgtggggcgaggaagggtcgtggtctggttattgcacccaaagactactccaccaagtaccgatactaaaccccttgtagttggctggagatttactaaaggtcatatctccaagacctgttgtaacgaacataaatcatttcaactgttgagaatattgtgatcatgcacaaggagtttcaggtagcttctgatatgtggtatggcgtgcagtctggacacagtagtgcatgtttgacatacattatatatatgaatgtcaaacaaggaaactgcctaaaatcttggacatggaagcacatttgagtgttaatatatatttgtcccttgtggttgtcttataactttcctcattgactgcatacgaatggtattactcgtgccaagagtttgagcgatgagctggtttgaaagcttttttggagctttatttttgaacctggcctaatgctcaggcgcctcatactcttgcagttacaatgattttcaaaa

SEQ ID NO: 3553 - DNA, 674 bp, Mesembryanthemum crystallinum
  misc_feature (7)..(7): n is a, c, g, or t
  misc_feature (9)..(9): n is a, c, g, or t
  misc_feature (11)..(11): n is a, c, g, or t
  misc_feature (13)..(14): n is a, c, g, or t
  misc_feature (17)..(18): n is a, c, g, or t
  misc_feature (20)..(20): n is a, c, g, or t
  misc_feature (22)..(23): n is a, c, g, or t
  misc_feature (25)..(26): n is a, c, g, or t
  misc_feature (29)..(29): n is a, c, g, or t
ttttgcntngngnnganntngnnannagngagagaaagaggagagagaaagaggagagagagagagaggatgtcttacctgctacctcacttgcactcaggatgggcagtggatcaagccatcctcgccgaagaagaacgtctcgtcatcatccgtttcggccatgactgggacgaaacttgcatgcagatggatgaagtactggcttcagtggcagaaacaacaaagaatttcgctgtgatataccttgtagacataacagaggtgcctgatttcaacacaatgtacgagctgtatgatccatccacagttatgttctttttcagaaacaagcacatcatgatagatcttggaacggggaacaacaataagatcaactgggccctcaaggacaagcaggagttcatagacatcgttgagactgtctatcgtggagcacggaaaggtcgaggtcttgtgattgcaccgaaagattactccactaagtatcgctattaagtcattgttgttgctaatctatcagattgcaactcgagaagtgtaatattaagttgataagccctgcatctaggattcgtaaggttctcttgaattcatgtgacagtgagtgatgtactttctattgatgttaactgtacccacaatgagaaattgagaaggtaagttccaaccgg

SEQ ID NO: 3554 - DNA, 738 bp, Ipomoea nil
gagtaatttctattgatttcctgatcgttcttctcctctttctgttgtcttggtgacctacaaaccctaacacgctaccatctgctccaccggcttcatctgatttcagaggaaagaggataaaggatgtcttacttactgccccatctccactccggttgggccgttgaccaagccatccttgccgaggaggagcgcctagtcattatccgcttcggccacgactgggacgagacttgcatgcagatggatgaagtcttggcttcagtagctgagacattaaaaaactttgctgtcatataccttgtagatatcactgaggttcctgacttcaacacgatgtacgaattgtatgatccgtcgactgtgatgttcttctttaggaacaaacacatcatgatcgatcttggcactgggaacaataacaagatcaactgggcactgaaggacaaacaagagttcattgacatcgtggagactgtttatcgtggtgctagaaagggtcgcggtcttgtcattgctccaaaagattactcgacaaagtatcgatactgagcacttgcatcgcatctgctgcaacttgttggtacacacaaacatgagtttgtttcttgctgcacaaatgtttgtgaataatcttgacctatatatatatataggaaaatacttggtgtctctcattttaaactcccaacttttattctctcgcacatgtttttgatttaaacacttttcagt

SEQ ID NO: 3555 - DNA, 864 bp, Actinidia deliciosa
  misc_feature (18)..(18): n is a, c, g, or t
  misc_feature (483)..(483): n is a, c, g, or t
cgactatctcgtcgctgntcgcagtcgccctcgcagtcgccgaccagccacgaccttctcctaccagccgtgaccttctccgatcagctcaaagcctcaagccatctccgagaccacctctgatagtctcaagagagagagagaatgtcgtacttgctgccgcatctgcactcgggatgggcggtggatcaggccatcctcgccgaagaagaacgcctcgtcatcatccgatttggtcacgattgggacgaaacttgcatgcagatggatgaggttctggcttcagttgctgagacaataaagaactttgcagtcatttacctggtggacatcacagaggtgcccgacttcaatacgatgtatgagctgtatgacccatcaactgtcatgttcttcttcagaaacaaacacataatgattgatcttggcactggaaacaacaataagatcaactgggcaatgaaggataagcaggaattcatngacattgttgaaacagtgtatcgaggggccaggaagggacgtgggctcgtcattgcacctaaagactattccactaagtaccgttattgagcccttgcgtactttcgggtcatgggaaactgtatgatcaagcaaataatgtttgcatttggctttgaattctaactggtggaaactgtatgatcaagcaaataatgtttggatttggctttgaattctaactggtttatggtaccgagtaccagtactctgttaggcctttgccttttcattgggttatataggcacggaccgaagtattgcaatctgaaacatttgcggtaatttgtctagaaattcactgaagcatgtttgtctgaatttataacgacaaaaaaaaaa

SEQ ID NO: 3556 - DNA, 675 bp, Catharanthus roseus
atccaaagaattcggcacgaggcttgcaactcgcgcttctttagactcaagaaggagaagaacgatgtcgtacttgctgccgcaccttcactccggctgggccgtcgatcaggcgattctcgccgaagaagaacgccttgtgatcatccggttcggccatgactgggacgaaacctgtatgcagatggatgaagtgttggcatcagttgctgagaccataaagaactttgccgtgatatacttggtggatataactgaagtacctgattttaacacaatgtatgagttgtacgatccatcaacaatcatgttcttctttaggaacaagcacataatgattgatcttggcaccggtaacaacaataagatcaattgggctctaaaggacaaacaagagttcattgacattgttgagactgtctaccgaggtgcaagaaaaggacgtggtctagtcatagcccccaaagattattctaccaagtaccgttattgagcgccgtttgtcagcattgtcatatatatggtgccacctgattcttcttgtgtccatgtgtagcattgctattaatattagactatttgcattgtactgtatggtttaactgatattgctgagacatcatgtttaatgtcctcgttaatgaagcttgagtggcaaaagggcaattctggatc

SEQ ID NO: 3557 - DNA, 706 bp, Lippia dulcis
ctcattcacgcgcacttcctctcggtggaactctcttttctgcagaaggatttgtgggaggcgaaagctaaacgatgtcgtatttgctgccgcatcttcactcaggatgggccgtcgatcaggcgattctcgcggaggaggaacgcctcgtcatcatccgtttcggccacgactgggacgaaacttgtatgcagatggacgaggtgctggcttcagttgcagaaacaataaagaactttgctgtcatatacttggtggatatcacagaggtgcccgatttcaacactatgtacgagctttacgatccctcaactgtcatgtttttcttcaggaacaagcacatcatgattgatcttggcacgggaaacaacaataagatcaactgggccatgaaggataagcaggagttcatcgacattgttgagaccgtgtatcgtggcgctaggaagggccgtggtttagttattgctccgaaagattactccaccaagtatcgttactgagtgttatgtgtatatcttgacatgatttatttgcaatcttgcttacgatgttgtcacggtttgcaaacaaacaacattcctttatgtagctgaatgatgtgaacagtgttcctgcaaatgccatttcataaatttcaatactgatgaggataagattgaatctggttatatatgcgtggaataaaaatttaaacttgtatttt

SEQ ID NO: 3558 - DNA, 881 bp, Cajanus cajan
agaatacattgggccattggtgataaggaagaggcaaaagcccagcccaacgtagttgtaacgcattaaaatccgaatcgatagcagaaaccctaagcgaagaatcagaatcgaaatcaagatgtcgtacttgttgcctcacttgcactcgggatgggccgtggatcaggcaatcctcgccgaagaggagcgtctcgtcgtcattcggttcggccacgattgggacgagacctgcatgcagatggacgaggtgctggcgtcggtggcggagacgataaagaacttcgcggtgatatacctggtggacataacggaggtgcctgatttcaacaccatgtacgagctctacgacccttccacggtgatgttcttcttcaggaacaagcacatcatgatcgatctcggcaccggcaacaacaacaagatcaattgggctctcaaggacaagcaggagttcatcgacatcgttgaaactgtctatcgtggcgccaggaagggacgcggtctcgtcatcgctcccaaagattactccaccaagtaccgctactgattcggattcggatatatgtataataaaacaatttacttgtgttggctaattgtatcattgttcccatttcgcctcattttatatacgcacactttaaaccctaactttgtgaatttggtattgtcatctgctaaattgtgaatttggtttgaataattatttagtttaatgactttgagtgatacagcacataggtgctctaatttaatactgcacgtcccctgattttttgggttacctcttgattggaaacgttgagtggcagattataagtttatgaatcactagttcattagtgtattatccacactcttgtaataatgaactttga

SEQ ID NO: 3559 - DNA, 969 bp, Plantago ovata
gccggggaatttcgcaagcactagaatcttcccaagtaaaatcaaatctctgcacctgcgtagcaatcaagcaatcaagcgaggaggagaagatagcaatcaagcgaggaggagaagatgtcgtacttgctacctcatctccactctggttgggccgtcgatcaagctatcctcgccgaggaggagcgccttgtcatcatccgtttcggtcacgattgggatgaaacttgcatgcagatggatgaggtgctgtcctctgtcgcagagaccataaagaactttgctgtcatatatctagtggacatcacggaggtaccagatttcaacacgatgtatgagctgtatgacccctcaactgtgatgttctttttcagaaacaagcacattatgattgatctggggactggaaacaacaacaagatcaactgggctttgaaggacaaacaggaattcatcgacattgtcgagactgtgtatcgtggggcaaggaaaggccgtggtctggttattgcaccaaaggattactcaaccaagtaccgctactgattggcttgcaatatgctcatgtgataggtttacctgtcgagtgtcattgaactatttgtcaatttgccgtaaggattctggtttcagatttcaaacttttgttataatgattctggaaatggtttcagactattgttataatctccaactaatgattgcagcactgcaacttatgctatttgatgtaactatgggtctctatgactatgctatatttttgagattatagttgttggttgcccgttggtttgaaatctaatcgcacagtatctagctcactttctgttttacttggaagaaacatgtctgcaaaaaaaataattaaagaaaacaatgttcttaaatagctttgtatgtctataacagttactcgaacgctttggctttaaactgaacatggaaaaacagatttttgtgtcattc

SEQ ID NO: 3560 - DNA, 690 bp, Platanus occidentalis
attgatttgaagtttcgtagggaacgatttggagttttggagagagagagagagagagaaacgatgtcttatcttctgcctcacctgcactccggctgggcagtcgaccaggcgatacttgccgaggaagaacgtctcgtcatcattcggtttggccatgactgggacgaaacttgcatgcagatggatgaggtgctggcttcagttgcagagacaataaagaattttgctgtgatctacttggttgacattacggaggtgcctgatttcaacaccatgtatgagctatacgacccctcgacgatcatgtttttcttccgcaacaaacacatcatgattgacctgggcacaggaaacaataacaagatcaattgggctctcaaggacaagcaggagttcattgacattgttgagactgtctaccgtggggccaggaagggccggggtctggtcattgcccccaaagactactccaccaagtaccgttactaagccttggtgtacaatatctggtttattgactgtgttaactccacatctgtagaactatttatcatttcactttgaacataaaaatgtggacgaattctcaggcttaaacatggggatgccaaacttctcgattgttattaaatagctctctttttttcccaagatgctcgtttgatttattttggaggagcaggaatc

SEQ ID NO: 3561 - DNA, 701 bp, Platanus occidentalis
gaaattaggcatctcgtcgtttgcagaagacattctaagattgatttggagtttggaaggagagaggaaagagagagagacgatgtcttaccttctgcctcacctgcattcgggctgggccgtcgatcaggctatccttgctgaggaagaacgtctcgtcatcattcggtttggccacgactgggatgaaacttgcatgcagatggatgaggtgctggcctcagttgcagagacgataaagaactttgctgtgatctacctggtcgacattacggaggtgcctgatttcaacacaatgtatgagctgtatgatccctcaacaatcatgtttttcttccgcaacaagcacatcatgattgacctgggcactggaaacaataataagatcaattgggccctcaaggacaagcaggagttcatcgacattgttgagactgtctaccgtggggccaggaagggtcggggtctggtaattgcccccaaagactactccaccaagtaccgttactaagccttggtacagtatgtggtttattgactatgtgactctacatctgtagaactatatttcactttgaacataaatgtggacgaatgagttctcaggtttaaacacggggaggtcaaaacttctcgattgttattaaattgtatggttttttcttttattctctaggtacttgtttcattaattttggagg

SEQ ID NO: 3562 - DNA, 1052 bp, Populus trichocarpa
attgaatcgaagatagcgtagaaaattctagtccgagagagagagagagagagagagatgtcgtacctgctacctcacttgcactcaggatgggctgtagaccaggcgattctagctgaagaagagcgattggtagtcattcgatttggtcatgattgggatgagacttgtatgcagatggacgaagtgttggcatcagtagcagaaacgataaagaattttgctgtgatatacctggtggacatcacagaggttcctgattttaacacaatgtatgagttgtatgatccatctactgtcatgttcttcttcaggaacaagcatattatgattgatcttggaactggtaataacaacaagatcaactgggctctcaaagacaagcaggaattcattgacattgttgagactgtctaccggggggcaaggaagggtcgtggtcttgtcattgctccgaaagactactccacaaagtaccgctactaggtacttttgctaattgtttgaactgtaggagattgccttgaaaacatcatgcttgtgtcaaacttgtcttttagaacaaaagggggggtgccctggttaattcaaaatctcatgttgtaatactggttggtgtggataaccagttccatgctttggacatttaagacgcattgaactcggcaactattctagaattgaaacagcattcatacatgttttgtaatagttgtttctgtctctggtaattgtcagtatgtagtacacgcgcacacacacacgggtcatcatgtacgaaaatgcaattgagcagtcgacgatgagcttccacagcgtgtgattcacaggtgtcaagaaagtgttgatggaaggacagtgctcaagagataagaaagcaataaccttgaatgcacaacaataatgaattttgcattttatgtttccagaagttctgttattttgttggagttatttacaaatagtcgagaaatctaacaaacctgtcccccaaaagaggagacttgactttaatagaaattggcaagacagtatatgagagggcatgttcc

SEQ ID NO: 3563 - DNA, 1109 bp, Populus trichocarpa
gtacagtgaacgcgcacggagaaaaatctccataagaatcacggactatttcgttttaattcaatcgaagatagcgtagaaaattctagtccgagagagagagagagagagagagatgtcgtacctgctacctcacttgcactcaggatgggctgtagaccaggcgattctagctgaagaagagcgattggtagtcattcgatttggtcatgattgggatgagacttgtatgcagatggacgaagtgttggcatcagtagcagaaacgataaagaattttgctgtgatatacctggtggacatcacagaggttcctgattttaacacaatgtatgagttgtatgatccatctactgtcatgttcttcttcaggaacaagcatattatgattgatcttggaactggtaataacaacaagatcaactgggctctcaaagacaagcaggaattcattgacattgttgagactgtctaccggggggcaaggaagggtcgtggtcttgtcattgctccgaaagactactccacaaagtaccgctactaggtacttttgctaattgtttgaactgtaggagattgccttgaaaacatcatgcttgtgtcaaacttgtcttttagaacaaaagggggggtgccctggttaattcaaaatctcatgttgtaatactggttggtgtggataaccagttccatgctttggacatttaagacgcattgaactcggcaactattctagaattgaaacagcattcatacatgttttgtaatagttgtttctgtctctggtaattgtcagtatgtagtacacgcgcacacacacacgggtcatcatgtatgaaaatgcaattgagcagtcgacgatgagcttccacagcgtgtgattcacaggtgtcaagaaagtgttgatggaaggacagtgctcaagagataagaaagcaataaccttgaatgcacaacaataatgaattttgcattttatgtttccagaagttctgttattttgttggagttatttacaaatagtcgagaaatctaccaaacctgtcccccaaaagaggagacttgactttaatagaaattggtaagacagtatatgagagggcatgttc

SEQ ID NO: 3564 - DNA, 681 bp, Silene vulgaris
ggacagtcgatattggtgtttgagtgggtggaataaagcgttggagaagaagatgtcgtatctgctaccacacttgcactctggatgggctgttgatcaatccatcctcgccgaagaagaacgtcttgtcatcatacgctttggccacgattgggatgagacctgtatgcagatggatgaagtcttagctggggtggccgagactataaagaactttgctgtcatttatctagttgatataaccgaggtccctgatttcaacaccatgtatgagctgtatgacccgtcgacagtcatgttctttttcaggaacaaacatataatgattgacttgggaactgggaacaacaacaaaatcaattgggctctcaaggacaagcaggagtttattgatattgttgagaccgtctatcgtggtgcacgcaagggccgtggtcttgtcattgcacctaaggattactccactaagtaccgctattaactgcttcacaacacgctgttttgctccatcacagagaaactggcacttattgtacaatgttatacttattcataagcctgtgttttgtggaattctggttattcactgaggaactatctttaatgactctactgtttaataatttgcgtgaagatcgttggtgatttcaccggcttctattctactgttaatgtttgatt

SEQ ID NO: 3565 - DNA, 688 bp, Silene vulgaris
tggggagagtaattgtataaaggaaggcggttggtaatcaaattggattgggtgggaattggaaggaaggatgtcgtacctgctaccgcatctacactcaggatgggctgtggatcagtcaatcctggccgaagaagaacgcctcgtcatcatccgcttcggccatgattgggatgaaacctgcatgcagatggatgaagtgctagccggggtggcggagaccataaagaactttgctgtgatttatctagtggacataaccgaggtgcctgatttcaacacaatgtatgagctttatgacccgtccacagtcatgttcttcttcaggaacaaacacataatgattgatcttggtaccgggaacaacaacaaaatcaactgggccctcaaggacaagcaggagttcatagacattgttgagaccgtctatcgtggtgcaaggaagggccgaggtcttgtcattgcaccaaaggattactccaccaagtaccgctattaagtgcctgtacaactcaccttttagctccatatcctatctctgtaacccattggcactcattgtcttatgttatagttgttactcgtaaccctttcttttaatggaattcaggttatccactgtggaactatcttgtaatgattatacttcttaatgacctgctttcagattgttggtaatctcgattat

SEQ ID NO: 3566 - DNA, 684 bp, Glycine max
aattgtgtgttgttgagtggaaacgtgaaattagggttcatcgaggaggaagaagaagaagaagatgtcgtacctgttgcctcacttgcactctggatgggccgtcgatcaagcaatcctcgccgaagaggagcgtctcgtcgtcatccgtttcggccacgactgggacgaaacctgcatgcagatggacgaggtgttggcgtcagtggcggagacgataaagaactttgcggtgatatacctggtggacataacggaggtgccggatttcaacaccatgtacgagctctacgacccttccacggtgatgttcttcttcaggaacaagcacatcatgattgatctcggaaccggtaacaacaacaagatcaactgggctctcaaggacaagcaggagttcatcgacattgttgagaccgtctatcgtggagccaggaagggacggggtctcgtcatcgctcccaaagattactccaccaagtaccgttactagtttgattccttcaagtcatgtactcacccacccacccacccctatggatcggatctgtaacatacagcaaacaaaattttatctgttttcttacttctgtggtggtggtggttgtatgatcattctgatttctgcttattcacagaccttaaactccaactctgtgaaatgaattgcttttgtcatatgcc

SEQ ID NO: 3567 - DNA, 1189 bp, Glycine max
gggtcggcagtgataattgggcccggtgaaacccaaacccgaaggaactaaaataaaatctgtacctaaatgaaaataaataattgtgtgttgttgagtggaaacgtgaaattagggttcatcgaggaggaagaagaagaagaagatgtcgtacctgttgcctcacttgcactctggatgggccgtcgatcaagcaatcctcgccgaagaggagcgtctcgtcgtcatccgtttcggccacgactgggacgaaacctgcatgcagatggacgaggtgttggcgtcagtggcggagacgataaagaactttgcggtgatatacctggtggacataacggaggtgccggatttcaacaccatgtacgagctctacgacccttccacggtgatgttcttcttcaggaacaagcacatcatgattgatctcggaaccggtaacaacaacaagatcaactgggctctcaaggacaagcaggagttcatcgacattgttgagaccgtctatcgtggagccaggaagggacggggtctcgtcatcgctcccaaagattactccaccaagtaccgttactagtttgattccttcaagtcatgtactcacccacccacccacccctatggatcggatctgtaacatacagcaaacaaaattttatctgttttcttacttctgtggtggtggtggttgtatgatcattctgatttctgcttattcacagaccttaaactccaactctgtgaaatgaattgcttttgtcatatgccaaagtgttgttagaataattacttagttttgcaactttgctttagtagtttaggatcattggtgatcaagatgctctaataacaacaatatcacttggttcaacaccctacccatatactgcaggacctctcggatttggtttggctcgtaaggtaattaaacccctaatccgaaattttaagtagcagatggtttggtggagagtggacacctagaagaaagtactaaaatagtttttagtttttagttttgtggacagagggaccaagaagggcattgggtatatggtaaatatttatgaaggtttggtttgtaagaaggccaaatggtttttgttcttctcgttaattgtaagaaggccaaatgcatctaaacttttattataatgtgtatgaaaaaataataattgtgttttattgtttg

SEQ ID NO: 3568 - DNA, 734 bp, Glycine max
gagtgggagcaaagctacgcgaaattagggttgatcgaggaagaagaagaagatgtcgtacctgttgcctcacttgcactctgggtgggcggttgatcaagcaatcctggcagaagaggagcgtctggtcgtgatccgtttcgggcacgactgggacgaaacctgcatgcagatggacgaggtgttggcgtcggtggcggagacgataaagaactttgcggtgatatacctggttgacataacggaggtgccggatttcaacaccatgtacgagctctacgacccttccacggtgatgttcttcttcaggaacaagcacatcatgattgatctgggaaccggtaacaacaacaagatcaactgggctctcaaggacaagcaggagttcatcgacattgttgagaccgtctaccgtggagccaggaagggacgtggtctcgtcatcgctcccaaagattactccaccaagtaccgttactagtttcattcatctgtaacatacaacaaactaaatattatctcttttcttacttctctggtgtggtgctggttgtggttgtatgatcattctgatttctgcttattcacaactctgttacatgaattgcttttgtcatatgctaaagtgttgttagaataattccttagttttgcaactttgctttagtagtttaggatcgttggtgaagcaaacacaatttgattttttcaataaaagttgacatttttacttt

SEQ ID NO: 3569 - DNA, 839 bp, Glycine max
aatcaaaataaataattgtttgtgttgttgagtgggagcaaagctacgcgaaattagggttgatcgaggaagaagaagaagatgtcgtacctgttgcctcacttgcactctgggtgggcggttgatcaagcaatcctggcagaagaggagcgtctggtcgtgatccgtttcgggcacgactgggacgaaacctgcatgcagatggacgaggtgttggcgtcggtggcggagacgataaagaactttgcggtgatatacctggttgacataacggaggtgccggatttcaacaccatgtacgagctctacgacccttccacggtgatgttcttcttcaggaacaagcacatcatgattgatctgggaaccggtaacaacaacaagatcaactgggctctcaaggacaagcaggagttcatcgacattgttgagaccgtctaccgtggagccaggaagggacgtggtctcgtcatcgctcccaaagattactccaccaagtaccgttactagtttcattcatctgtaacatacaacaaactaaatattatctcttttcttacttctctggtgtggtgctggttgtggttgtatgatcattctgatttctgcttattcacaactctgttacatgaattgcttttgtcatatgctaaagtgttgttagaataattccttagttttgcaactttgctttagtagtttaggatcgttggtgaagcaaacacaatttgattttttcaataaaagttgacatttttactttgactcctgtagtgaaagtctaccacgtatggttctgcgtgtttgtttggatttacactattaagaatctcatttct

SEQ ID NO: 3570 - DNA, 652 bp, Euphorbia esula
ggcacgaggcagaaagttggaattgcagggttcgttcccggcggttaacgatgtcgtaccttctccctcacttgcactcaggctgggccgtcgatcaagccatcctggctgaggaagagcgcctcgttgttatccgtttcggccacgattgggatgaaacctgcatgcagatggatgaggtgctggcatcagtagcagagacaataaagaactttgcagtgatatatctagtagatataacagaggtgccggatttcaacacgatgtatgagctgtatgatccatcaacagtgatgttcttcttccggaacaagcacataatgatagatcttggaactggtaataacaacaaaattaattgggctctcaaggataagcaggaattcatcgacattgttgaaaccgtctaccgtggtgccaggaagggccgtggtttagtcattgctcccaaggattactccaccaagtaccgttactaagtctctcccgaactagtctgtataattactgttgcataaaatgactaaactttgtttttaagctagtcttctacccagatgccaagataatgcatctgacttttatgttgattgatactccctcctacgattcagtgtggatgaatatgttcgtattaatacgttttttgttt

SEQ ID NO: 3571 - DNA, 757 bp, Tabernaemontana elegans
gggggaaaaagagagggagaagaaacgatgtcgtatttgttgccgcaccttcactccggctgggccgtcgatcaggcaattctcgccgaggaagaacgccttgtgatcatccggttcggccatgactgggacgaaacttgtatgcagatggacgaagtgttagcatctgttgctgagaccataaagaactttgcggtgatatacctggtggatataactgaggttcctgattttaacacaatgtacgagttgtacgacccatcgacaattatgttcttctttaggaacaagcacatcatgattgatcttggcactggtaacaacaataagatcaactgggctctgaaggacaaacaagaattcattgacattgttgaaactgtgtaccgtggtgcaaggaaaggccgtggtctagtcatagcacccaaagattactctaccaagtaccgttactaggcgcctacttttctacgcaatgcgcctgattgtacttgtgtatgaccttgctattgatcaagcaatttgcattgtactgaatgctttaattgatattgctgagacgggatgtttcgaatttatatatagatgatgttcatgttcttggcagtaaatctaagtgaatgccagagaggctactgaatcttttcattagctagatctggcccctgtttggttccagttcaaggttcctggaatcggaaccagacatgtcaaatgacctctctctatgccaaccctctcaaattcttggaaatat

SEQ ID NO: 3572 - DNA, 672 bp, Utricularia gibba
gtggagaaccagagagctaggtcgcagcttctagaagaaaaagcttcggagcaacgatgtcgtaccttctgccacaccttcactccggctgggccgtcgatcaagccatcctcgcggaggaggagcgcctcgttatcatccggttcggccatgactgggatgaaacctgtatgcagatggacgaggtgttggcgtcggtggcggatacgatcaagaacttcgcagtgatatatcttgttgatatcacggaggtaccggacttcaacacgatgtacgagctgtacgatccctcgacggtgatgttcttcttcaggaacaaacatataatgattgatctggggactggaaacaacaacaagatcaactgggcattgaaggacaagcaggagttcatcgacatcgtggaaaccgtgtaccgcggcgcaaggaaggggcgtggtctcgtcattgctcccaaagattactccaccaaataccgctactgagtgactgcggaaggtaccgtcgttcacccttcccctgctcaaaaacatatgcttctatgtattgcaacccgtgcaattgtaagacttatttctgtcattatgctgaagaagctgaacaaccaagcttcgatgcatcttcatcacccgtgtatataatcgtgattagaaaaagaagacccatttgggg

SEQ ID NO: 3573 - DNA, 813 bp, Mimulus guttatus
tgaatcttccacagctataaaaaaatcagaacccccaaacaaaggcttcttccgcgcacattagcacagcgaattcatttcccaccaaagcgatgtcgtatttgctgcctcaccttcactctggatgggccgtcgatcaggctatactcgccgaggaggagcgcctcgtcatcatccgtttcggccatgactgggacgaaacttgcatgcagatggatgaggtgttggcttcagttgcggaaacactaaagaattttgcagtgatatacctagtggatatatcagaggtgcctgatttcaacacaatgtacgagctgtacgacccgtcaacagtcatgttcttcttcagaaacaaacacattatgatcgatctcggcactggaaacaacaataagatcaactgggcattgaaggacaagcaggaatttattgacattgtcgagactgtgtaccgtggtgctaggaagggccgtggtcttgttattgctcctaaagactactccaccaaatatcgctactgacttcttacatctatctttcgagcagtatcagtggttactcgcgtattatttatgcataattgcgatgctcaaaacatctgttcgataactgaatcaatcctcagggaatattggtgtgttgtaactcaagaatgctattatctgctattattgttatatgtgattttcacatctatgaattatgatatgaatggtatatgctaaataaatgatgagctgtaacttgtgtagtattgtaccatttttctgggtttgttggctaaaatttgactaattttcttttacaggcgta

SEQ ID NO: 3574 - DNA, 534 bp, Mimulus guttatus
atagcacatcgaatcctttgaccaaaacgatgtcgtatttgctgcctcaccttcactctggatgggccgtcgaccaggccatactcgccgaggaagaacgcctcgtcatcatccgcttcggccacgactgggacgaaacttgcatgcagatggatgaggtgttggcttcggtagcagaaacactaaagaattttgcggtgatatacctggtggatatagcagaagtgcctgatttcaacaccatgtacgaactgtacgacccttcgactgtgatgtttttcttcagaaacaagcatattatgatcgatcttggcacagggaacaacaataagatcaactgggctttgaaagataagcaggagtttatcgacattgtcgagactgtgtaccgcggtgctaggaagggccgtggtcttgtcattgctcctaaagactactccaccaaatatcgatactgagtcggttacatgcatatgtctctctcattaaatttagggtaagttacaaccacccctgatgtaagatctatttacg

SEQ ID NO: 3575 - DNA, 1521 bp, Prunus mume
gtcacgacaccacaatggcaccatgggcatgtgatttcctccttttatattgtaaatgagatgagagagagatccatgattgagggccgcctcctgttctgctcctgtgttcccgcgaaacacagagagagagagagagagatcagatatacaatacatacatatataattactattaataatgtcgtatttgctacctcacctgcactcaggttgggccgtggaccaggccattcttgctgaggaagaacgtgtcgtcgtcatccgattcggccatgactgggacgacacttgcatgcaggtaaattcaattcaattccctcgcttcccttcctttttttcaaaactctctttcatttaattcaatttaatttatttaactgattgccttagatttgataaatattgcttgcttcattcttcttaattatgtgcttgttttcttcttaaaccaaaaagaaattcaacaaatacggattacggacggactgagggaggggaggggaggggagaggggggaggagggccattacaaatacaagttacaatctgggctcattacaaatacttttgaaagtttagggacctacttaggaagaaaaaacaatttgggtaccaaagtgggacaaacatacaagttcagggggcagtttcaaaataatccaaaaaaatgtgttaattaattggtagatttttctctctgagacgagagaaagccagaaaggttggggactcggggcactactcttgtgagagaactagaagagagcgaggaacgatgtcgtatttgctgccccacctccactctggatgggccgtcgatcaggccatccttgctgaggaggagcgtctcgtcctcatccgcttcggccacgactgggacgagacctgtatgcagatggatgaagtgcttgcttcagttgctgagacactcaaaaactttgctgtgatttaccttgtcgatatcacggaggttcctgatttcaacacaatgtatgagctctatgacccatccactgtcatgttctttttcagaaacaagcacattatgattgaccttggcactgggaacaacaacaagatcaactgggctctcaaggacaagcaagagttcattgacattgttgagacggtgtaccgtggggcaaggaaggggcgcggtctggtcattgctcccaaagattactccaccaagtaccgttactaagccctgctgctgaaaatgtaattcatttcagacaaaaccttctagtttggatggagttacgttgaccttttataggtgatttagggaagctaatgtatctgaatgttttctatgcatactgcatttaattgtttctcatgccgactggatggggtgggcaaatgtttgttattcagcgtgtttggtgtgtgttccagagatatcctttatgaaccaaactatctatttataaaatgtcgtgttgataattctatttggctgattcttttgcaagagaaatgactgtggaaggataataaagctagttctagtaa

SEQ ID NO: 3576 - DNA, 678 bp, Ambrosia trifida
gtgttgtgtgcaactactctaagtgtagagcattcacaggttcctgaaagatgtcgtatttgctaccacacttgcactcgggatgggccgtggatcaggcaattctggcggaggaagagcgtctggtggtcatccgcttcggccatgattgggacgaaacttgtatgcagatggatgaagtgcttgctgcagttgcagagacattaaagaactttgctgtaatatacttggtggacataacagaagtacccgacttcaatacaatgtatgaactttacgacccatcaactgtaatgttctttttcaggaataaacatatcatgattgatcttggtaccggtaacaacaataagatcaactgggccatgaaggacaaacaggagttcattgacatcgttgaaactgtctatcgtggggcccggaagggacgtggtttggtcattgcacccaaagattactccacaaagtaccgttactaaactcattcaggcctatggttctatggatttgaatcgttattaaaacggtcgtgacttttgaattgttataacattggtgtgattgtagtcttttgaaatcgtatatcatggtgcaactttgcagtgataaatgttgtatttcctattacttaaattcgagacttgtggtattataaaatacatatgcaaatatatgttt

SEQ ID NO: 3577 - DNA, 616 bp, Persea americana
atagacaaatcgcactctcccactaccttacacaaagaaggaaggagaaaggcaagagccagagagagaaggagagatgtcgtaccttctgcctcacctgcactcaggctgggccgtggatcaggcgatcctggccgaggaagaacgccttgttgttatccgattcggtcacgactgggacgagacttgcatgcagatggatgaagtcctggcttcagttgcagaaaccatcaaaaactttgctgtcatatacctggtggacatcaccgaggtgcctgacttcaacacgatgtatgagctgtatgacccctccacagttatgttcttctttcgcaacaagcacatcatgattgatctgggcactggcaacaacaacaagatcaactgggctctcaaggacaagcaagagttcattgacatcatcgagactgtctaccgtggagcaaggaagggtcgaggtctggtcattgccccaaaagactactcgaccaaataccgttactgagttactgaaattgggctgttctttaatgtaaggaccatagctttatcaaatgttgaaggtactgtgtcattgttaacttgaaagtttccatattgtgtactggatttcatt

SEQ ID NO: 3578 - DNA, 732 bp, Vaccinium corymbosum
cgggaaagttgtaatcagtgttcgcaggagattaggcagaggaagaggggagaggatgtcgtacttgcttccgcatctgcactcgggatgggcggtggatcaggcgatccttgccgaagaagaacgcctcgtcatcatccgattcggccacgattgggacgaaacttgcatgcagatggacgaggttctggcttcagtcgctgagacaataaaaaactttgcagtcatatacctggtggacatcacggaggtgcccgacttcaatacaatgtatgagctgtatgacccatcgaccataatgttctttttcaggaacaaacacataatgattgatcttggcacgggaaacaacaacaagatcaactgggcaatgaaggacaagcaggagttcattgacattgttgagactgtgtaccgtggggccagaaagggtcgcgggctggttattgcgcccaaagactactccactaagtaccgttattaagtgaacaacctgggttattcgctgtgtcattgaaactgtacaatcaagcaaaaatgtgtgagcttattatgcattgaaaatctaactggggttaacaatgtgtgatgattatgcacaattactattactatgttggacttcttctttttcatgtggttcagggcatggaccaaactctagcaatttgaggcatgtttgtgtgaagtgtattctatattctcttgatggcttatgagtacgtgtgatta

SEQ ID NO: 3579 - DNA, 726 bp, Vaccinium corymbosum
aagttgcacccagtgttcgcaggagactagatagaggacgaggggagaggatgtcgtacttgcttccgcatctgcactcgggatgggcggtggatcaggcgatcctagccgaagaagaacgcctcgtcatcatccgattcggccacgattgggacgaaacttgcatgcagatggacgaggttctggcttcagtcgctgagacaataaaaaactttgcagtcatatacctggtggacatcacggaggtgcccgacttcaatacaatgtatgagctgtatgacccatcgaccataatgttctttttcaggaacaaacacataatgattgatcttggcacgggaaacaacaacaagatcaactgggcaatgaaggacaagcaggagttcattgacattgttgagactgtgtaccgtggggccagaaagggtcgcgggctggttattgcgcccaaagactactccactaagtaccgttattaagtgaagaacctgggttattcgctgtgccattgaaactgtacaatcaagcaaaaatgtgtgagcttattatgcattgaaaatctaactggggttaacaatgcgtgatgattatgcacaattactattactatgttggacttcttctttttcatgtggttctgggcatggaacaaactctagcaatttgagacgtgtttgtgtgaagtgtattctatattctcttgatggcttatgagtacgtgtgatt

SEQ ID NO: 3580 - DNA, 710 bp, Manihot esculenta
gcattgaagaattaacctctagggattcgacgacttggtagagagaaatgtcgtacctgcttccacatttgcactcaggatgggcagtagatcaggcaatcttggcggaggaagagcgcctcgtcgtcatccgattcggccacgactgggacgagacttgcatgcagatggatgaagtgctcgcatcagttgctgagacaataaagaactttgctgtcatataccttgtggacatcacagaggttcctgatttcaacacaatgtatgagttgtacgatccatccactgtcatgtttttcttcagaaacaagcatattatgatcgatcttggaactggaaataacaacaaaatcaattgggccctcaaggacaagcaggagttcatagacattattgagacagtctaccgtggggcaaggaagggtcgtggtttggttattgctccaaaagattactccactaagtaccgctactaaatccctaaggaaattattccttgtactatccaactattaagaacttgttatgaaaaaagaaaaaaaggatgcacgcataaaacttggcttcagatgtttctagattggaatatcctgttaactaactaggagttccttgtgattgtatggttttcatcttttgccttgtgcatagacaatgtctgacgtttattttgagctaaaatcgttgaagtttctcatgttcttttttct

SEQ ID NO: 3581 - DNA, 731 bp, Castanea mollissima
gtgaatcaatcgagagggaggatgtcgtacctgctaccacatctgcactcaggatgggcggtggaccaggccatcctcgccgaggaagaacgactcgtcgtcatccgcttcggtcatgactgggatgagacctgcatgcagatggatgaagtgctggcttctgttgctgagactatcaaaaactttgctgttatctatcttgtggacatcactgaggtgcctgatttcaacactatgtacgagctctatgacccatccacagtcatgttcttcttcagaaataagcacattatgattgatcttggcactggaaataacaacaagataaactgggctctcaaggacaagcaagagttcgttgacattgtcgagacagtctaccgtggggcaaggaaaggtcgtggtctggtgattgctcctaaggactactccaccaagtaccgttactaaggccttgttcaagctgtagttgatttggagcatgtaagatcgtatattgaaaacctgttgcatcatattacattctctagaagttgtttgtttgaaacctgtaatattagatcttgaaaacttgttgcttgaaactttgattctctagaaatcaatgttttggagctatcatattcttaaattacaaggtgtttcacaccaggtactatctctatacttgatatgactattgctcatgtattgctatttgaattaaataatagttccaatcctggaatttt

SEQ ID NO: 3582 - DNA, 942 bp, Cicer arietinum
tcgttgttccgtgccacacacggttacgaactagttaaatataatagataaccagaaatactgtacctcttccactgagaacccacgccaccttcctcatcactgtaaattaaagagtagtgataaagaagaagaaagatgtcgtacctgttgcctcacttgcattcaggttgggctgttgatcaggcaattctcgccgaggaagagcgtcttgttgtcatccgttttggccacgattgggatgagacttgcatgcagatggatgaggtgctggcatcagttgcagagacaataaaaaactttgctgtgatataccttgtggacatcacagaggtgcctgactttaacactatgtatgaactgtatgatccttccacagttatgttcttctttaggaacaaacacatcatgatagatcttggaactggaaacaacaacaagatcaattgggctctcaaggacaaacaggagttcattgacatcattgaaactgtctacagaggtgcaaggaagggacgtggtcttgtcattgctcccaaagattactccactaagtaccgttactagaatatatcgatcgctattgggatatgtgtttgaactcagtattttcgtccaaaacctatcatttggttcaccctttattaagtgtgtaactgtcactaatctatcaaattacacacccgactttcatctcaaactgtaattgatatgctgtttatcccccatatggtggtttgacactggtgatgatgttaaaaaaactgcacttgaactgattttagatggaaggtcctcatgagatagaacttatttatcacatgacaagctacttttttctatgtgttgattatttcttagtttatttctctgtttatgatttcttcattgtgttcattccttgctcggttgattttggcatctggccatgtttgtaatatc

SEQ ID NO: 3583 - DNA, 981 bp, Cicer arietinum
atagttgtttccgcgcgacgtacagttaaatataatagataaccagaaatctgtacctcttccactgagaacccacgccaccttcctcatcactgtaaattaaagagtagtgataaagaagaagaaagatgtcgtacctgttgcctcacttgcattcaggttgggctgttgatcaggcaattctcgccgaggaagagcgtcttgttgtcatccgttttggccacgattgggatgagacttgcatgcagatggatgaggtgctggcatcagttgcagagacaataaaaaactttgctgtgatataccttgtggacatcacagaggtgcctgactttaacactatgtatgaactgtatgatccttccacagttatgttcttctttaggaacaaacacatcatgatagatcttggaactggaaacaacaacaagatcaattgggctctcaaggacaaacaggagttcattgacatcattgaaactgtctacagaggtgcaaggaagggacgtggtcttgtcattgctcccaaagattactccactaagtaccgttactagaatatatcgatcgctattgggatatgtgtttgaactcagtattttcgtccaaaacctatcatttggttcaccctttattaagtgtgtaactgtcactaatctatcaaattacacacccgactttcatctcaaactgtaattgatatgctgtttatcccccatatggtggtttgacactggtgatgatgttaaaaaaactgcacttgaactgattttagatggaaggtcctcatgagatagaacttatttatcacatgacaagctacttttttctatgtgttgattatttcttagtttatttctctgtttatgatttcttcattgtgttcattccttgctcggttgattttggcatctggccatgtttgtaatatctcagaatcttgccaatttcaacattatgtttagatgaaatcaattgacg

SEQ ID NO: 3584 - DNA, 762 bp, Cichorium intybus
ttgacaaccgccgtttctcgagagaacgagaaagaaggagaaagatgtcgtacttgctaccgcacttgcactccggctgggccgtcgatcaggcgatcctcgccgaggaggaacgtctcgtcgttatccggttcggccatgattgggacgaaacttgtatgcagatggatgaagtgcttgcttcagttgcggagacaataaagaactttgctgtgatatacttggtggacatcactgaagtgcctgacttcaatacaatgtatgagctttacgatccatctactgtcatgtttttcttcaggaacaagcacatcatgatcgatcttggtactggtaacaacaataagatcaactgggccatgaaggacaagcaagagttcatagacattgttgaaactgtgtaccgtggggccaggaagggtcgcggtttggtcattgcacccaaagattactccaccaagtatcgttattagagatgttcacaaatcactactgatgctgtggatttgaacccaattccaacgtttgtatgggtaacattgaacttaaaccggttggtgtgattgtgatcttattggaaactaagtttgaagtctaataaatttgtatatccagttgcttaaattatgaattaccaagagagattatgtgcatcaactgaaatgcattcttgttaaaaagaactgtcatggccattgttaaatcttgaaacattgtagtttactcatgagccagtgtcatacatagggttaacaaaaaaaa

SEQ ID NO: 3585 - DNA, 853 bp, Cleome spinosa
ccgccaccgccgtaataccagggcagaaaaaggggtggcattggttagattcgtcgatcatatttcaaacgcagagagaaagggaagagtgcaacgatgtcgtatctgctgccgcacttgcactcgggatgggcggtggaccaggcgatcctcgccgaggaagagcgtctcgtcgtcatacgcttcggccacgactgggacgagacctgcatgcagatggatgaagtgctagcatctgttgccgagaccataaagaatttcgctgttatatatctggtggatatcactgaggtgccggatttcaacacgatgtatgagctgtacgatccctcgacagtaatgttcttcttcaggaacaagcacatcatgattgatctcggaactggaaacaacaacaagatcaactgggctctcaaggacaagcaggagttcatcgatatcatcgagactgtctatcgtggtgcgaggaagggtcgtggtctggtgattgctcccaaggactactccacgaaataccgctattaattggcttctgccgtatataagcatcgctcgggcatgttgtgggtgattctcgtcagccagaatatccgcgaactggcatatgattgttgactgtaattccgatttgctctacagttatccagcattttatgtaatgcttgaaacacaatcgaatgtaactcaaggccagaagtcaaactgggagttatgtacattggtttcatctttgtctcttcttgtgggtttcctgttgtagcttatcctttgtgcttaaggaagctgaactagctgtttgtgtccactatacttttatcattacattattatacacatgcaggtgaacgagagc

SEQ ID NO: 3586 - DNA, 821 bp, Gossypium hirsutum
gtttcttgttccaaattagggtttgatatcacaaattttgcgagaggaaaagcatttcatcgtcagccaaaaaaagggaattttagtcttcaggggaacgatcgaacgatgtcgtacctactaccacacctgcactcaggatgggccgtagatcaggccatcttggcagaggaagagcgtctcgtcgtcatccgattcggccacgactgggacgaaacttgcatgcagatggatgaggtgcttgcttctgtcgctgaaacaataaagaactttgctgtgatttatcttgtagacataacggaagtacctgattttaacacgatgtatgagctttacgatccatcaacagtgatgttctttttcagaaacaagcacattatgattgatcttggcactggtaataacaacaagattaactgggctctcaaggacaaacaggagttcatagacatcattgagactgtataccgtggggcaaggaaaggtcgtggtctggtaattgctccgaaagattactcgacaaaataccgctactgagtattcttgcaacctgttgttgatcagaaagatttaatggtcatatttcgcgaatttaatatggactattttcattatgaactgtgtatgtcatttgcaatgcttgcatgaacgtggtggataatccagtttgagatgaaactttgaaatatatattttatgtgtttttcttatgcttgttaacggtatggcacctttgcttggagtgattttccttactgatatttgataagggaacatgctttttaatttaacgtataaaaatataaatgattaattatttt

SEQ ID NO: 3587 - DNA, 816 bp, Gossypium hirsutum
gtgggggttccaaattagggtttgatatcacaaattttgcgagaggaaaagcatttcatcatcagcgaaaaaaagggaattttagtcttcaggggaacgatcgaacgatgtcgtacctactaccgcacctgcactcaggatgggccgtagatcaggccatcttggcagaggaagagcgtctcgtcgtcatccgattcggccacgactgggacgaaacttgcatgcagatggatgaggtgcttgcttctgtcgctgaaacaataaagaactttgctgtgatttatcttgtagacataacagaagtacctgattttaacacgatgtatgagctttacgatccatcgacagtgatgttctttttcagaaacaagcacattatgattgatcttggcactggcaataacaacaagattaactgggcactcaaggacaaacaggagttcatagacatcattgagactgtataccgtggggcaaggaaaggtcgtggtctggtaattgctccgaaagattactcgacaaaataccgctactgagtattcttgcaacctgttgttgatcagaaagatttaatggtcatatttcgcgaattcaatacagactattttccttatgaactgtgtatgtcgttcgcaatgcttgcgtgtacgtggaggataatccaatttgagatgaaactttgaaatatatattttatgtgtttttcttattgcttgtttacactatggcacctttgcttggagtgacttcccctgcggttgtttgacaaggaaacatgcgttttatttaagatatgaaaatataaatgatgctaaa

SEQ ID NO: 3588 - DNA, 655 bp, Taraxacum officinale
cgtttctcgagaaaagaaagaaaagagggagagagagatgtcgtacttgctaccgcacttgcactccggctgggctgtcgatcaggcgatcctcgccgaggaggaacgtctcgtcgttatccggttcggccatgattgggacgaaacttgtatgcagatggatgaagtgcttgcttcagttgcagagacgataaagaactttgctgtgatatacttggtggacatcactgaggtacctgacttcaatacaatgtatgagctatacgatccatctactgtgatgttcttcttcaggaacaaacacatcatgattgatcttggtactggtaacaacaataagatcaactgggcaatgaaggacaagcaagagttcatagacattgttgaaactgtgtaccgtggggccaggaagggccgtggtttggtcattgcacccaaagattactccaccaagtatcgttactagagtggtgcaccagtcgctggttcatggtgctatggaattgaatcatgtattaaaaaccatgtctatggataacattgaagttaaactgatagatgtggttgtgatcttatctgaaactatgtttaaagtctaataaacttgtatatccagttatgattgggatgattatgaaattttgatgatgttaat

SEQ ID NO: 3589 - DNA, 851 bp, Eschscholzia californica
gcacgaaagtggatttctccctgttctctcgagaaagtaaaggattccctgaggaattgaaagaagatgtcgtaccttctacctcacttgcactctggttgggcagttgatcaggctatccttgctgaggaagaacgtcttgttgttattcgatttggacatgactgggatgaaacctgcatgcagatggatgaggtactggcttcagttgcagaaacaataaagaactttgctgtgatctatctagtagacattacagaagttccagacttcaacaccatgtacgaactctatgacccttcaacagtcatgttctttttcagaaacaaacacatcatgatcgatcttggaactggaaacaacaacaaaattaactgggccctcaaagataagcaagagttcatcgacatcattgagactgtttatcgtggagctagaaaaggcagaggtctcgtcatcgccccaaaagattactccaccaagtatcgttactagtcctttctaccctttcgtagttattactatgaatgcatgaatatgtgcctccctatgtttctcttaaaacctaggttaggctttcaagccggactaaatttgaaggtgaccctttgaaactgcttaggaaatatgactatgaactattcaagatgtgtgatgattgagaaactatgaaaaaactcaaacttggttattaggcgtatcgttagaatttattactctgtttttactgtcttggagactgaatgctgtgatcatgttgctttttcgtcatgggcactctggccacactcagtagtgactggggcgtaattcgatcactccatcatgaaagtggtgagcctgagcaaaat

SEQ ID NO: 3590 - DNA, 696 bp, Euphorbia peplus
cagataacttctgagagaaattggtaaaggaggatctggaaagtaggagtgtgtcggggaagggatgtcgtacctgcttcctcacttgcactcaggatgggcagtcgatcaagccatccttgctgaagaagaacgcctcgttgttatccgtttcggccacgattgggatgaaacctgcatgcagatggatgaagtgctgtcgtcagttgcagagacaataaagaactttgcagtgatatatctggtagatatcacagaggtgcctgatttcaacacaatgtatgagctgtatgatccatcaacagtgatgttcttcttcaggaacaagcacattatgattgatcttggaactggaaataacaacaaaattaattgggctctcaaggataagcaggaattcatcgacattgttgaaaccgtctaccgtggagcaaggaagggccgtggtttagttatagctccaaaggattactccaccaagtaccgttactaagtctgggggaaagtgttattactggaccatgtaagcatgggtgtgtaattgttgcataaaatgataaatcttgtttttaagtttgtatacatgtggatttagtttcgccttccgcttgatgccaagaaaagacatctgactttgacgcttatctttatgttgattgatcctcctatgattcaatgtagatgaatatgttggta

SEQ ID NO: 3591 - DNA, 600 bp, Flaveria ramosissima
agagagatgtcgtacctgctaccacacttgcactccgggtgggccgtggatcaggcgattctggcggaagaggagcgtctcgtcgtcatccgattcggtcatgattgggacgaaacttgtatgcagatggatgaagtgcttgcttcagttgcagagacaataaaaaactttgctgtaatatacttggtggacatcacagaagtacctgacttcaatacaatgtatgaactttacgacccgtcaactgtaatgttctttttcaggaacaaacatatcatgattgatcttggtactggtaacaacaataagatcaactgggccatgaaggacaaacaggagttcatagacattgttgaaactgtctaccgtggggctcggaagggccgtggtttggttattgctcctaaagattactccaccaagtaccgttactaaactcattcgtgtcagagtttgttggatctgaactgtatttcaaaagatttaaaccggttgtggcttttgaattgttataaaactagtgtaattgtggtatattgaaacctatgttttttaagttcaacaacttttgcttaattatcttgtgtatccagttacttg

SEQ ID NO: 3592 - DNA, 486 bp, Flaveria ramosissima
gttgaaagaggtagagagatgtcgtacctgctaccgcacttgcactccggttgggcggtggatcaggcgattctggccgaagaggagcgtctcgtcgtcatccgattcggtcatgattgggacgaaacttgtatgcagatggatgaagtgcttgcttcagttgcagagacaataaaaaactttgctgtaatatacctggtggacatcacagaagtgcccgactttaatacaatgtatgaactgtacgacccgtcaactgtaatgttctttttcaggaacaaacatatcatgattgatcttggtactggtaataacaataagatcaactgggccatgaaggacaaacaagagttcatagacattgttgaaaccgtttaccgtggggcccggaagggccgtggtttggttattgctcccaaagattactccaccaagtatcgttactaaactcattcgtgtcggagtttgttggatctgaactgtatt

SEQ ID NO: 3593 - DNA, 577 bp, Flaveria ramosissima
cgaggttcgataacaatcgtgtttggagtatcccgaaagacaaaagaagagagatgtcgtacttgctaccacacctgcactccgggtgggccgtcgatcaggcgattctggccgaggaagagcgtctcgtagtcatacgcttcggtcatgattgggacgaaacatgtatgcagatggatgaagtgcttgcttcagttgcagagacgataaagaactttgctgtaatatacttggtggacataacagaagtacctgacttcaatacaatgtatgaactttacgacccgtcaactgtaatgttttttttcaggaacaaacatatcatgattgatcttggtaccggtaacaacaataagatcaactgggccatgaaggacaaacaggagttcatagacattgttgaaactgtctatcgtggggcccggaagggccgtggtttggtcattgcacccaaagattactccaccaagtaccgttactaaactcattcgggcctatgggtctgtggatttgaaccgaatttagaatggcataaaccagttgcgacttatgaattgtgctaacatttgtgtgactg

SEQ ID NO: 3594 - DNA, 634 bp, Flaveria ramosissima
attggggagagttctgattgtggaaagaggtagagagagatgtcgtacctgctaccgcacttgcactccggttgggcggtggatcaggcgattctggcggaagaggagcgtctcgtcgtcatccgattcggtcatgattgggacgaaacttgtatgcagatggatgaagtgcttgcttcagttgcagagacaataaaaaactttgctgtaatatacttggtggacatcacagaagtacctgacttcaatacaatgtatgaactttatgacccgtcaactgtaatgttctttttcaggaacaaacatatcatgattgatcttggtactggtaacaacaataagatcaactgggccatgaaggacaaacaagagttcatagacatcgttgaaaccgtctaccgcggggcccggaagggccgtggtttggtcattgctcccaaagattactcaaccaagtaccgttactaaactcatttgtgtcagagttttgtggatttgaattgtgttttgaaagatttaaagcggttgtggcttttgaattgttataacactagtaagattgtggtcttttgaaacctatgtttttaaactttgcttaatcatcttgtgtatccagttacttgatttgatgcaa

SEQ ID NO: 3595 - DNA, 565 bp, Flaveria ramosissima
cagattctcgaaggagcgagagagatgtcgtacctgctaccgcatttgcactccgggtgggccgtggatcaggcgattctggcggaagaggagcgtctggtggtcatccgattcggtcatgattgggacgaaacttgtatgcagatggatgaagtgcttgcttcagttgcagagacaataaaaaactttgctgtaatatacttggtggacatcacagaagtgcccgactttaatacaatgtatgaactgtacgacccgtcaactgtaatgttctttttcaggaacaaacatatcatgattgatcttggtactggtaacaacaataagatcaactgggccatgaaggacaaacaggagttcatagacattgttgaaaccgtctaccgtggggcccggaagggccgtggtttggttattgctcccaaagattactccaccaagtaccgttactaaactcattcgtgtcagagtttggtggatctgaactgtgttttgaaagatttaaaccggttgtggcttttaaattgttataaaactagtgtgattctggtctattgaaacctat

SEQ ID NO: 3596 - DNA, 659 bp, Flaveria ramosissima
ggggaaacataaatctgttgaggaacaatcacagattctcgaaggaggtagagagatgtcgtacctgctaccgcacttgcactctggatgggccgtcgatcaggcgattctggccgaagaagagcgtctcgtcgtcatccgattcggccatgattgggacgaaacttgtatgcagatggatgaagtgcttgcttcggttgcagagacaataaaaaactttgctgtaatatacttggtggacatcacagaagttcccgacttcaatacgatgtatgaactgtatgacccatcaaccgtaatgttctttttcaggaacaaacatatcatgatcgatcttggtactggtaacaacaataagatcaactgggccatgaaggacaaacaagagttcatagacattgttgaaaccgtctaccgtggggcccggaagggccgtggtttggttattgctcccaaagattactccaccaagtaccgctactaaactcattcgtgtaagagtttggtggatccgaactgtgttttgaaaaatttaaaccggttatgacttttgaattgttataaaactagtgtgattgtggtctattcaaacctatgtgtttaaggttcaacaacttttcttaatcatcttgtgtacccggttacttgatttgatgcaa

SEQ ID NO: 3597 - DNA, 597 bp, Gerbera hybrid cultivar
gccatttcttgagagaaagaggaagagggaaaaagaacgatgtcgtatttgctaccgcacttgcactcagggtgggccgtcgatcaggccatcctcgccgaggaggagcgtctcgtcgtcatccgtttcggccatgattgggacgaaacttgtatgcagatggacgaagtgcttgcttcagtggcggagacgataaagaactttgctgtaatatacttggtcgacattactgaagtgcccgacttcaatacaatgtatgagctttacgacccatcaaccgttatgttcttttttaggaacaaacacatcatgattgatcttggtaccggtaacaataataagataaactgggcaatgaaggacaaacaagaattcatcgatattgttgagacagtgtatcgtggggccaggaagggccgcggtttggttattgcaccaaaagactactctacaaagtatcgttactaaaatcattcattcaaactagtaataactgcttgtcgtcttctagttgtgttttgaaggtataaaattctctggctaaataagatttgattcgacagtttattggaagtgaatagcattgctattttgtac

SEQ ID NO: 3598 - DNA, 892 bp, Gossypium raimondii
ggcgccggagtagcgtggcgttgcatgtggccaacgcatcgtctataaattataagccagtatcaacgcagagtacatggggttccaaattagggtttgatatcacaaattttgcgagaggaaaagcatttcatcatcagcgaaaaaaagggaattttagtcttcaggggaacgatcgaacgatgtcgtacctactaccgcacctgcactcaggatgggccgtagatcaggccatcttggcagaggaagagcgtctcgtcgtcatccgattcggccacgactgggacgaaacttgcatgcagatggatgaggtgcttgcttctgtcgctgaaacaataaagaactttgctgtgatttatcttgtagacataacagaagtacctgattttaacacgatgtatgagctttacgatccatcgacagtgatgttctttttcagaaacaagcacattatgattgatcttggcactggtaataacaacaagattaactgggctctcaaggacaaacaggagttcatagacatcattgagactgtataccgtggggcaaggaaaggtcgtggtctggtaattgctccgaaagattactcgacaaaataccgctactgagtattcttgcaacctgttgttgatcagaaagatttaatggtcatatttcgcgaatttaatatggactattttcattatgaactgtgtatgtcatttgcaatgcttgcatgaacgtggtggataatccaatttgagatgaaactttgaaatatatattttatgtgtttttcttatgcttgttaacggtatggcacctttgcttggagtgactttcctacggttgtttgacaaggaaacatgcgtttttatttaacatatgaaaatataaatgatgctataat

SEQ ID NO: 3599 - DNA, 627 bp, Hevea brasiliensis
agtgttactcagaagagggaaacaaataatagcaatcgcagagaagaattgaaatctagggattcgaggagttgtttgagagatgtcgtatctgcttccacacttgcactcaggatgggctgtggatcaggcaatcttggcggaggaagagcgcctcgtcgtcatccgattcggccacgactgggacgagacttgcatgcagatggatgaagtgctcgcatcagttgctgagacaattaagaactttgctgtcatatatcttgtggacatcactgaggtgcctgatttcaacacaatgtatgagttgtatgatccatccactgtcatgttcttcttcagaaacaagcacattatgattgatcttggaactggaaataacaacaaaattaattgggctctcaaggacaagcaagagttcattgacattattgagactgtctaccgtggggcaaggaagggtcgtggtttggttattgctccaaaagattactccaccaagtaccgctactaagtgtaagaaaaattattcattggactatccgactatgtaagaacctgtgatgaaaacaatatgtatgcataaaacttggcttcagaaatttgtagattggaatttcctggttaact

SEQ ID NO: 3600 - DNA, 652 bp, Jatropha curcas
ggaagattagggattcaggacttggtagagagagaaagtcacggagagcgaaatagagagaagatgtcgtacctgcttcctcacttgcactctggatgggccgtcgatcaggcaatcctagcggaagaagagcgtctcgtggtcattcgattcggtcacgactgggacgagacttgcatgcagatggatgaagtgttggcatctgttgccgagacaataaagaactttgctgtcatataccttgtagacatcacagaggtgccagattttaatacaatgtatgagctgtatgatccatcgactgtgatgttcttcttcaggaacaagcacatcctgattgatcttggaactggaaataacaataaaatcaattgggctctcaaggacaagcaggagttcattgacattgttgagactgtctatcgcggggcaaggaaaggtcgtggtctggttattgctccaaaggattattccacaaagtaccgttactaagtgtgtctgaaggttactcattggaccatgtaagaacttgtatgaaaaaagtatatttgcttaaaactcttcagaatttggactgctctggttgaccagtactttaatatggtcccaatttcaaatttctatacacattatctgacttcgacgttttatt

SEQ ID NO: 3601 - DNA, 838 bp, Lactuca sativa
acggaataataaagaccgcgtgtgagcttctatatacatcggccttctttgatactcgccgtcgcttctcgagagaaaaagaaagagggagacagagatgtcgtacttgctaccgcacttgcattccggctgggccgtcgatcaggcgatcctcgccgaggaagaacgtctcgtggttattcggttcggccatgattgggacgaaacttgtatgcagatggatgaagtgcttgcttcagttgcagagacaataaagaactttgctgtgatctacttggtggacatcactgaggtacctgacttcaatacaatgtatgagctatacgatccatctactgtgatgttcttcttcaggaacaagcatattatgattgatcttggaactggtaacaacaataagatcaattgggccatgaaagacaagcaagagttcatagacattgttgaaactgtgtatcgtggggctaggaagggacgcggtttggtgattgctcctaaagattactccaccaagtatcgttactagagtggtgatgattttaaccatgtttgtatggataacattaaagtttaaactggttgatttcatgtggttgtgaacttatttgaaattatgtttgaagtctaataaatttgtatatctagttgcttaatttatgttgttgggatgattatgatttgtgtgggtgatgggttattttcttttttacaaaacgttattggttctaaaaaaaattactatcaaaaggtaactttgtgtttataaaatacttttattttaatggtattttgtgtaaaatagtatattgtgaatgacaataaatagttcagtactcag

SEQ ID NO: 3602 - DNA, 802 bp, Glycyrrhiza uralensis
gaaggcgtgctcgtttttgagccctagagtctagaactgcttctcttttcttctcttgtagacagtcacggatatagcagcaaagcgtcttctcgtttgagcccacggtgttgcacaactgaagcagagagagtagaagaggagggaagagaagatgtcgtacctgttgcctcacttgcattcggggtgggctgtggatcaggcaatcctcgccgaggaggagcgtctcgttgtcatccgttttggccacgattgggatgaaacctgcatgcagatggatgaggtgctggcatcggttgcggagacaataaagaactttgctgtgatataccttgtggacatcacggaggtgccggatttcaacactatgtatgagctgtatgacccctccacggttatgttcttctttaggaacaagcacataatgatagaccttggcactggaaacaacaacaagatcaattgggctctcaaggacaagcaggagttcattgacatcattgagactgtctacagaggtgcaaggaagggacgtggtctcgtcattgcccccaaagattactccaccaagtaccgttactagagtatatctctatctctctccagtctccactggatatgtaaaatttaaactctgtttttattctcttccaaaacctgcttaatttggatcaccctttatgtttattaagtgtgtaactgtcactcaaatatcagcttacacacctatttgtctgtcatgcaaaactataacggcactgctctgcctatataccatgtcatttaggtatgtatgcatagc

SEQ ID NO: 3603 - DNA, 746 bp, Liriodendron tulipifera
tttgattcgagaacacgcgaaagaaaatagtcgaagggagtaaagatgtcataccttctgccccacctgcattcgggctgggccgtcgatcaggcgatcctggccgaagaagaacggctggtagtcatacgcttcggccacgactgggacgaaacatgcatgcagatggatgaggtgctggcttcagttgcagagaccataaagaattttgctgtcatttacctggtggatatcactgaggtgcccgacttcaacaccatgtacgagctgtacgacccctcaactgtcatgttcttcttccgcaacaagcacataatgattgacttgggcactggaaataacaacaagatcaactgggctctcaaggacaagcaggagtttattgacatcattgagactgtctacaggggagcaaggaaaggccgaggtctggtcatcgcaccaaaggattactcaactaagtaccgatattgagtttcttctgagacgacctggtattggtctcagctattggtttgatcaaacaatgaattgtctatatacattgttaattatgtaactctatatttgctttggatattgaagggtgtacttgcagagtgctagaactaatgccaggtctcctgttaccaactgggtgagaggttgcttctgttattcaagctcgtaggtaccgttgttactattttccccaagttggcatttttccgtttgttaaatgatcaaatgctcagtttcttatcttt

SEQ ID NO: 3604 - DNA, 1001 bp, Cucumis melo
agccgtctttcgtacttcgtgttcgtgggtctcctctccttcgttcattttcattcgtgagtttcgtacctcgtgttcgtgggtttcgttttcacagtagctcccgacggtgtactgctgcaccatccgacgggaccaacaattcaaatcgcttaattctttcgacccactctccgatcgatctcaattcttgacacccacgatctcacggctgcagatctgcaagttttaacgcctttgaacgcagttcatcaagctcaagctcgtttggtgggaaatagtggaagctagttactgagcaagagatgtcgtacttgctgccacatcttcattcaggatgggctgttgaccaagcaatccttgcagaagaagagcgtcttgtggtcattcgttttggtcatgattgggatgaaacttgtatgcagatggatgaagtgttggcctcagtggcagagacgattaagaactttgctgtaatataccttgtggatatcacagaggttcccgacttcaacacaatgtacgagctgtatgatccttccaccgttatgtttttctttaggaacaagcacataatgattgatcttggaactggaaacaacaataagataaactgggcactgaaggacaagcaggagttcattgatatcattgaaacagtctaccgtggagcaaggaaaggacgtggtttagtcattgcacctaaggactattcaaccaaatatcgctactaagattttctgctgcatctaaaacttcttattcatcttaaatattatgtcctatatgacattaataacctcctaaaaaaagttatggttgattcaggcatattaagttactaccttgtttgtgaataaaagtgtatgatacacaattttaacgtttatttataatactgaattgaatcttaattatgctatctatgattagatatactttgtctttttaggaaatcaaacttttaattgaatacttaggtacgatccactttgtaccag

SEQ ID NO: 3605 - DNA, 628 bp, Momordica charantia
ttcagagagagagatgtcgtacttgctgccgcatcttcactccggatgggccgtcgatcaagcaattctcgccgaagaggaacgtcttgtggtaattcgtttcggccatgactgggacgagacctgtatgcagatggatgaagtgttggcctcagttgcagagacaattaagaactttgcagtaatataccttgtggatatcacggaggttcctgatttcaacacaatgtacgaactctatgatccttccactgtcatgttcttctttaggaacaagcacataatgattgatcttggtactggaaacaacaataagatcaactgggcactcaaggataagcaggagttcattgatatcattgaaaccgtctaccggggagcaaggaaaggacgtggtttagtcattgcacccaaggactattcgaccaagtatcgctactaagatgtcgtgcaagttcttgtcgttgatgttagatttaagacattgcatcttaaaaacatgtactatataacattgacccctgctgaggataaaggttaaggtttgttttcgatgtcagtttgtgttatgacttgtcaaaacattgaatcattgatgaagccattttattatggtatgaaaaggttg

SEQ ID NO: 3606 - DNA, 773 bp, Mimulus guttatus
cacagctataaaaaaatcagaacccccaaacaaaggcttcttccgcgcacattagcacagcgaattcatttcccaccaaagcgatgtcgtatttgctgcctcaccttcactctggatgggccgtcgatcaggctatactcgccgaggaggagcgcctcgtcatcatccgtttcggccatgactgggacgaaacttgcatgcagatggatgaggtgttggcttcagttgcggaaacactaaagaattttgcagtgatatacctagtggatatatcagaggtgcctgatttcaacacaatgtacgagctgtacgacccgtcaacagtcatgttcttcttcagaaacaaacacattatgatcgatctcggcactggaaacaacaataagatcaactgggcattgaaggacaagcaggaatttattgacattgtcgagactgtgtaccgtggtgctaggaagggccgtggtcttgttattgctcctaaagactactccaccaaatatcgctactgacttcttacatctatctttcgagcagtatcagtggttactcgcgtattatttatgcataattgcgatgctcaaaacatctgttcgataactgaatcaatcctcagggaatattggtgtgttgtaactcaagaatgctattatctgctattattgttatatgtgattttcacatctatgaattatgatatgaatggtatatgctaaataaatgatgagctgtaacttgtgtagtattgtaccatttttctgggtttgttggct

SEQ ID NO: 3607 - DNA, 849 bp, Quercus alba
aggcagcggactagttattagcttgttttggtgaatcaatcaacacagagagagagagagagagagagagagggaggatgtcgtacctgctaccacatctgcactcaggatgggcggtggaccaggccatcctcgccgaggaagaacgactcgtcgtcatccgcttcggtcacgactgggacgagacctgcatgcagatggatgaagtgctggcttctgttgccgagactatcaaaaactttgctgttatctatcttgtggacatcactgaggtgcctgatttcaacactatgtacgagctctatgacccatccacggtcatgttcttcttcagaaataagcacattatgattgatcttggcactggaaataacaacaagataaactgggctctcaaggacaagcaagagttcgttgacattgttgagacagtctaccgtggggcaaggaaaggtcgtggtctggtgattgctcctaaggactattccaccaagtaccgttactaagtccttgtgcaagctgtagttgatttggagcttgtaagatcgtatattgaaaacctgttgcatcatattacgttctctagaagttgtttgtttgaaacctgtaatattagatcttgaaaacctgttgcttgaaacttgaattctctagaaatcaatgttttggagctatcatatccttaaattacaaggtgtttcacaccaggtgctttctttatacttgatttgactattgcacatgtattgctctttgaattaaataatagatccaatcctggaattttaaatctgaaatcatgtaattgatatatgagtttttaagcataatgttagggctcaataaaaa

SEQ ID NO: 3608 - DNA, 961 bp, Quercus alba
atgggattttattttattgatttggtgaatccgatctgcggtaaatttataagaaacgcaaatggaaatggtagatttgaacggtgtcaaacgataacccgtggttaaaaataaataaataggtagcgtacttgctattatcttgtattggtgaatcaatcaagagagagagagagagagagggagggatgtcgtacctgctaccacatctgcactcaggatgggcggtggaccaggccatcctcgccgaggaagaacgactcgtcgtcatccgcttcggtcacgactgggacgaaacctgcatgcagatggatgaagtgctggcttctgttgccgagactatcaaaaactttgctgttatctatcttgtggacatcactgaggtgcctgatttcaacactatgtacgagctctatgacccatccacggtcatgttcttcttcagaaataagcacattatgattgatcttggcactggaaataacaacaagataaactgggctctcaaggacaagcaagagttcgttgacattgttgagacagtctaccgtggggcaaggaaaggtcgtggtctggtgattgctcctaaggactattccaccaagtaccgttactaagtccttgtgcaagctgtagttgatttggagcttgtaagatcgtatattgaaaacctgttgcatcatattacgttctctagaagttgtttgtttgaaacctgtaatattagatcttgaaaacctgttgcttgaaacttgaattctctagaaatcaatgttttggagctatcatatccttaaattacaaggtgtttcacaccaggtgctttctttatacttgatttgactattgcacatgtattgctctttgaattaaataatagttccaatcctggaattttaaatctgaaatcatgtaattgatatatgaagttttcaatcataatgttagggctcaaaaaaaa

SEQ ID NO: 3609 - DNA, 766 bp, Carica papaya
ggtaatcaaagcacgattgcacgatctactttgtataaaactagattctgcagcaacagacaggccattaactagttaactaggaaagagaagtggcaatttggaggagagtgagccgataaagtttttctagtcagagagaaagggaggagattagagatgtcatacttgctacctcatctgcactctggatgggctgtagatcaggccatcctggctgaggaagagcgtctcgtcgtcattcggtttggccatgattgggatgagacctgcatgcagatggatgaagtattggcatcagttgctgagacgctaaagaactttgctgtcatatatcttgttgacataacagaagtacctgattttaataccatgtacgaactgtatgatccatcgactgtcatgttcttctttaggaacaagcacattatgattgatcttggtactggaaacaacaacaagatcaactgggctttgaaggacaagcaagagttcatcgacattgttgagactgtttatcgtggggctagaaagggtcgtggtctggtgattgctcccaaagactattcaaccaagtaccgctactaagtattatacaagttgtggttaactgaaaacggtaagaacataatttggaaatgctgtaagaaacttatcagacgctcatagattgcaagtgtctcggtcttaagatcaatgtacctggtacagacaaaaaaggtaaagctttcaataagatcaatgtactgagagaggaggtaaagta

SEQ ID NO: 3610 - DNA, 871 bp, Arachis hypogaea
ccgccgctgcttcctcttccccgtgtcgttttcatcttcgctggcacgtcgttttcatctttctcttccccaggtagctcgggacgtcgttttcatcttcgctggcttctcggctcggaacccagcagttcttctaagtactgtacccctatccgttgagggtttgttgaaagaagaaaggagatgtcgtacctgttgccgcacttgcattcgggatgggcggtggatcaggcgattcttgcggaggaggagcgtctcgttgtcatccgcttcggccatgattgggatgagacctgcatgcagatggatgaagtgttagcatcagttgctgaaacaataaaaaactttgctgtaatttaccttgtggacatcacggaggttcctgatttcaacaccatgtacgagctctatgacccatccacagtgatgttcttctttaggaacaagcacattatgatagaccttggcactggaaacaacaacaagatcaactgggctctcaaggacaagcaagagttcatcgacattatcgagacagtttaccgaggggcaaggaagggccgtggtctcgtgattgcccccaaagattattcaaccaagtaccgttactaagcctcacaagcaaacattgctgctttcttgtaatcaccatatattgtgcatcatacctttgatgttctggatctgtaagacaattcctatgtttaatttttcttccaaaaactgcttagctgctattaccagcaatatatggtgtctttactgtttttatcatgttagcgtagcagtgctctgctctggtagcatgcaacgtgttatttggcgaaaattgcaacaggtgctcttacttataaattataatctatgattg

SEQ ID NO: 3611 - DNA, 608 bp, Petunia hybrida
tcgttgtgtagaaagagaaaaggcaggtgggagatcagatgtcgtacttgttgccgcatctgcactcaggatgggcagtggatcaagctattcttgctgaagaggaacgccttgttgtcattcgctttggccacgactgggatgacacttgcatgcagatggacgaggttctggcttcagttgcagagacaataaagaactttgctgtgatttacctggtcgacatcactgaggtccctgattttaacacaatgtacgaactgtatgatccatcaaccgtcatgttcttcttcaggaacaagcacatcatgattgaccttggcaccgggaacaataacaagattaactgggcgctaaaggataaacaggagttcattgacattgtcgagacagtttaccgtggtgcaagaaagggccgtggtctagttattgcaccaaaagattactcaaccaagtaccgttattaagcacctatacatgctgtgcaacctggttgccgcaacatgctgtacttgatgataaagctgtaagaactagtagaacagaatccactaaactgtaattaacaatttgatcaagttgtgtgcgtgatatgcactttaccgttg

SEQ ID NO: 3612 - DNA, 753 bp, Primula obconica
agagagatgtcgtacttgctgccgcatctgcactcaggatgggcggtggatcagggaatccttgctgaagaagagcgactcgtcatcatccgcttcggccatgattgggacgagacctgtatgcagatggatgaggtgctagcttcagttgcagagacgattaagaattttgcggtgatatatttggttgatatcacagaggtgccggacttcaacaccatgtatgagttgtacgatccctcaactgttatgttcttctttagaaacaagcacattatgattgatcttggcactggaaacaacaacaaaatcaactgggctatgaaggacaagcaggagttcatcgacattgtcgaaactgtttatcgtggggctcgcaagggccgtgggcttgtgatcgcacccaaagactactccacgaaataccgttattaaaccctattttccgggttttattggagtgtcttgcagaaatttgaaacttattttgagttgaagttggtactgtaataatattggcatgtgtacgtttgggtcttgttactgtggttggatattctgtttgatgtgaagaattcatagtatcttggtctgttttatgtgaaactgtgtggatcgatttagaattacatgtatttttttgcaaaattatgaacagccacaagttatagcttatttaggtatcattttgctttcttgggttgcccaaaatatgttgttctaaaaactgtgttgtatgatactgttttgtac

SEQ ID NO: 3613 - DNA, 720 bp, Prunus persica
gggcgagagaaagccagaaaggttgggactcggggcactacacttgtgagagaacttgaagagagcgaggaacgatgtcgtatttgctgccccacctccactctggatgggccgtcgatcaggccatcctcgccgaggaggagcgtctcgtcctcatccgcttcggccacgactgggacgagacctgtatgcagatggatgaagtgcttgcttcagttgctgagacactcaaaaactttgctgtgatttaccttgtcgatatcacggaggttcctgatttcaacacaatgtatgagctctatgacccatccactgtcatgttctttttcagaaacaagcacattatgattgaccttggcactgggaacaacaacaagatcaactgggctctcaaggacaagcaagagttcattgacatcgttgagacggtgtaccgtggggcaaggaagggacgcggtctggtcattgctcccaaagattactccaccaagtaccgttactaagccctgctgctgacaatgtaattcatttcagacaaaacctagtttggatggagttacgttgaccttttataggtgatttagggaagccaatgtatctgaatgttttctatgcatactgcatttaattgtttcttattcagcgtgtttggtgtgtgttccagagataccctttataaaccaaactatctatttataaaatgtcgtgttgataattcta

SEQ ID NO: 3614 - DNA, 1133 bp, Sarracenia psittacina
cgatgcctaaattgataaattgagtagccaacacagagtcggaacgacgcgacctgcagcttgttctgcttgctagggctgagagagagagagagagagacgatgtcgtacttgctgccgcaccttcactccggatgggcggtggatcaggcgatcctcgccgaggaagaacgcctagtcatcatccgattcggccacgactgggacgagacttgcatgcagatggatgaggtgctggcttcagttgccgagaccataaagaactttgcagtgatatatctggtggacatcacggaagtgcccgacttcaatacaatgtacgagctgtatgacccatcaactgtgatgttctttttcaggaacaaacacatcatgattgatctcgggactggaaacaacaataagatcaactgggcaatgaaggacaagcaggagttcatcgacatcgttgaaacgatatatcgcggggcccgcaagggacgtgggcttgtcattgcacccaaggactactccactaaataccgttattaagaactgctcttgggcgggctgcgtggcttgcagtgcactggaagctgtagcatgatcaatccagaatttatttaacatcaacatcctaaagtttgctgaggctgtgtaaggtttatgtccacgactatttgcattaagcctatgtttggcttagctttttctgaaagtcttttacttcaaagctttttaaaaagcctacttgtttggtctcattgtaatcaattggcctttttcacatcttttgatatcttcaaaaggccaaaagacctactgaaaaaaaaaaaaagaagaagctaggccaaacacaagctaagtccttttgcgtttcattgtttttctggcatggatgaaactactgcaatctgaactttgacctgactgtttattttgtctggcaatttaagctgaggcctagtgtgtaaaatgtgtgtgtggatggaattgtaggtttattctgttaaacggtcaaatttgtggaatctagtaacttaattgatacaaaacacaacagcagcaacagcaactcgttgagttgctaaaccattaaacggagagtgtgcatgccgaaagcatctctgaatgtgattctgagttattactat

SEQ ID NO: 3615 - DNA, 685 bp, Helianthus annuus
acgcggggatccagcaaaagttgacgcaacgcgtgattggcaacaatcatcacacagagaaggagagagagagatgtcgtacttgctaccgcacttgcactccggctgggccgtcgatcaagcaatcctcgccgaggaggagcgtctcgtcgtcatccgattcggtcatgattgggacgaaacttgtatgcagatggatgaagtacttgcttcagttgccgagaccataaaaaactttgctgttatatacttggtggacatcacagaagtaccagacttcaacacaatgtatgaactttatgacccgtcaactgtaatgttctttttcaggaacaaacatatcatgattgatctcggtactggtaacaacaacaagatcaactgggctatgaaagacaaacaagagttcatagacattgttgaaactgtctaccgtggggcccggaagggacgtgggttggtaattgcacccaaagattactccaccaaataccgctactaagctcattcgggtcagagtttctgtggatttgaactgtgtattggaagatttaaaactggctgtgacttttgaattgttataacatgtgtgtaattgtcgtcttctgaaactatgttctgagattcaataactttgcttaaatcataatgtgtgacgataagaagttggataatgaccaaaggg

SEQ ID NO: 3616 - DNA, 607 bp, Helianthus annuus
gagagagagagatgtcgtacttgctaccgcacttgcactccggctgggccgtcgatcaagcaatcctcgccgaggaggagcgtctcgtcgtcatccgattcggtcatgattgggacgaaacttgtatgcagatggatgaagtacttgcttcagttgcagagaccataaaaaactttgctgttatatacttggtggacatcacagaagtaccagacttcaacacaatgtatgaactttatgacccgtcaactgtaatgttctttttcaggaacaaacatatcatgattgatctcggtactggtaacaacaacaagatcaactgggccatgaaggacaaacaagagttcatagacattgttgaaactgtctaccgtggggcccggaagggacggggtttggtcattgcacccaaagattactccaccaagtaccgctactaagctcattcgggtcagagtttctgtggatttgaactgtgtattggaagatttaaaactggctgtgacttttgaattgctataacatgtgtgtaattgtcgtcttctgaaactatgttcttagattctacaactttgcttaaatcataatgtgtgacaataagaagttg

SEQ ID NO: 3617 - DNA, 760 bp, Helianthus annuus
gagagagagcgatgtcgtacttgctaccgcacttgcactccggctgggccgtcgatcaagcaatcctcgccgaggaggagcgtctcgtcgtcatccgattcggtcatgattgggacgaaacttgtatgcagatggatgaagtgcttgcttcagttgcagagaccataaaaaactttgctgttatatacttggtggacatcacagaagtaccagacttcaacacaatgtatgaactttatgacccgtcaactgtaatgttctttttcaggaacaaacatatcatgattgatctcggtactggtaacaacaacaagatcaactgggccatgaaggacaaacaagagttcatagacattgttgaaactgtctaccgtggggcccggaagggacgaggtttggtcattgcccccaaagattactccaccaagtaccgctactaaactcattcgggtcagagtttctgtggatttgaactgtgtattggaagacttaaaactggttgcgacttttgaattgctataacatgtgtgtaattgtcgtcttttgaaactatgttctgagattcaacaactttgcttaaatcataatgtgtgacgataagaagttggataatgaccaaagggcaaatgaaactcagtctgaatcgttaaaaccaactaatcgaattgaaacagcttgactggaccatgactctctaaggtcaagattcatggttgggaccgaaccatggaatcagatccagctttaagtgtggtttcac

SEQ ID NO: 3618 - DNA, 901 bp, Eutrema halophilum
ttatggtgttccactacccttttcaccgtccatttttctcaatctcgtgaactcatccttattgggcctaaacgttcgatccggttgggctgtcatatagcccaagtcactctgggcgggtcgggttatcattggtcggtcatcgtcgataacataagggcacgaaagcgaaagagtgaaattgaaacagatcggaatcgtcgagagagacaagagaagatgtcgtatcttctaccacacttgcactccggttgggctgtcgatcaggcgattctggctgaggaagagcgtctcgtcgtcatacgatttggccatgattgggatgagacttgtatgcagatggatgaggtactggcatctgttgctgagacgatcaagaactttgcagtgatatatctggtggacataacagaggttcctgacttcaacaccatgtacgagctgtacgatccatcaacggtcatgttcttctttaggaacaagcacattatgatcgatctcggaactggcaacaacaacaagatcaactgggctctcaaggataagcaagagttcattgatatcattgaaaccgtctaccgtggtgcaaggaagggtcgtgggttggtgattgctccaaaagattactccactaaataccgctactaaactgagcttcccaacacaatcctccggattgttcaaaaccattgctcaaaactctaatgtcgagtgattctggtcaattgaaatatcccttgaacttgttgcatatatgctttgatgaattgtgatttgcgtactctttcagggctgtgttgccatttatgtatgcaagtgcttcgaacatgattcagtgatatgaaacttagaagctgatatttgggttttatatgtattgacaggttgtagttattgatcc

SEQ ID NO: 3619 - DNA, 690 bp, Eutrema halophilum
aaaagagtgaaattgaaaccagatcggaatcgtcgagagacacagttgaggatgtcgtatcttctaccgcacttgcactccggctgggctgtcgatcaggcgattctggctgaggaagagcgtctcgtggtcatacgattcggccatgattgggatgagacttgtatgcagatggatgaggtactggcatctgttgctgagacgatcaagaactttgcagtcatttatctcgtggacataactgaggttcctgacttcaacaccatgtacgagctgtacgatccctcaacggtcatgttcttctttaggaacaagcacattatgatcgatctcggaactggcaacaacaacaagatcaactgggctctcaaggacaaacaagagttcattgatatcattgaaaccgtctaccgtggtgcaaggaagggtcgtgggttggtcattgctccaaaagattactccactaaataccgctactaaactgagcttcccaacactatcctccagtttgttcaaaaccattgctcaaaactatttatgtcgagtgattctggtcaatttaaatatccattgaacttgttgcatatatgctttgatgaattgtgatttgcgtactctttcagggctgtgttgccacttatgtatgcaggtgcttcgaacatgattcagtgaaatgaaacttagaagatg

SEQ ID NO: 3620 - DNA, 653 bp, Tragopogon dubius
ggtcgggggctatttgacaatcgccgtttctcgatagagggagagagagagaaagatgtcgtacttgctaccgcatttgcactccggctgggccgtcgaccaggctatcctcgccgaggaggaacgtctcgtcgtcatccggttcggtcatgattgggacgaaacttgtatgcagatggatgaagttcttgcttcagttgcggaaacaatcaagaactttgctgtgatatacttggtggacatcacagaggtgcctgacttcaatacaatgtatgagctttacgatccatctactgtgatgttcttcttcaggaacaaacacatcatgattgatcttggaactggtaacaataacaagatcaactgggcaatgaaggacaagcaagagttcatagacattgttgaaacggtgtaccgtggggctaggaagggccgtggtttggtcattgcacccaaagattactccactaagtatcgctattagagtggtgttcatcagggtgctctggattttaaccatgtattgaaagagatgaaccagttgtgattgtttgtatggataagattgaagttaaactggtggtgtgattgtgatcttattggaaactatgtttggagtgtaataaacttgcatatccaattgcttaattgac

SEQ ID NO: 3621 - DNA, 681 bp, Valeriana officinalis
gttagttgagagctgcagagagaagaagagatgtcgtatttgctaccacacttgcactccggatgggcggtcgatcagtccattctcgccgaagaagaacgcctcgttatcatccgatttggtcatgattgggatgaaacttgtatgcagatggatgaagtgctggcttcggttgctgaaacgataaagaactttgcggttatatacctagttgacataacggaggtgccagatttcaacacaatgtatgaactgtacgacccatcaaccataatgttctttttcaggaacaagcacatcatgatcgatctggggactggaaacaacaacaagatcaactgggcactaaaggacaaacaagagttcatcgacattgtcgagactgtttaccgtggtgctcgtaaaggacgtggtctggttatcgctcccaaggactactctaccaaataccgttactgagaaatatctacccattcaagaatgtgtagactcatttcattctttggaatcaattcgagtcttaatattgggggatatcaagaaattgtgaatgtatgatttgagaaggttaagattgtggtaataatgtgttttaattactctgtaatacaagtgcttatgagataatttctttgtgattcagttgtgtttatgttaattatgctacatctctgttttttt

SEQ ID NO: 3622 - DNA, 708 bp, Citrullus lanatus
gtgaaagctaattactgagtgagaaatgtcgtacttgctgccacatcttcattctggatgggctgttgaccaggcaatcctcgctgaagaagaacggcttgtggtcattcgtttcggtcatgactgggacgaaacttgtatgcagatggatgaagtgttggcctcagttgcagagacgattaagaactttgctgtaatataccttgtggatatcacagaggttcctgatttcaacacaatgtacgagctgtatgatccttccactgtcatgttcttctttagaaacaagcacataatgattgatcttggtactggaaacaacaataagataaactgggcacttaaggataagcaggagttcattgatatcattgaaacagtctatcgtggagcaaggaaaggacggggtttagtcattgcacctaaggactattcgaccaaatatcgctactaagattttctgctgcatctacaagttcttattgatcttaaatataaaacattgcatctagaaaatatgtactatatgatattaacctgctaagaagaagttatggtttatttagtatgtcattttgtgcaatacttctcaaaacattcagtcgacacctttgaagagggtatgtaaactgttaatggcataaagtcgattgatcaggtattttaaggttggataaattttctgacccattgatgtaatggatttat

SEQ ID NO: 3623 - DNA, 797 bp, Nicotiana benthamiana
gaggctgttactgtagtagatattttcttctctccccctttataccaatcgaggagaaccaaaacccttccttgagctacttttcctttgctatcctagcgacccgagaaagatgtcgtacttgttgcctcaccttcactcgggatgggcggtggatcaggccattctcgctgaagaggaacgcctcgtcattatccgcttcggccatgactgggacgaaacttgcatgcagatggacgaggtgctggcttcagttgcagatacattaaagaattttgctgtcatatacctggtggacatcacagaggtccctgattttaacacaatgtatgagttgtacgatccatccactatcatgttcttcttcaggaacaagcacatcatgattgatcttggcacaggaaacaataacaagatcaactgggctctcaaagataaacaagagttcattgatattgttgagacagtgtaccgtggcgcgagaaagggtcgtggtctagttattgcacctaaagattactctaccaagtatcgttactgagtgtctgtgatattgtactgaactataagatactttatgattcaactgaatcagctgtcaagacccagaagtgtacgataactttccattagttgcaagtggaaagacctctagtcttgttcaaaccatgttatgataaattatattgactgtattgaatttgtgcttttgtggtttcggcttcagcatgtgctaggtgccataagtgaacgagttgattagggagaagatttaactattcaggtaacttttagtt

SEQ ID NO: 3624 - DNA, 725 bp, Olea europaea
cgcaggggatcacagaaccagaataatttttctaatctcgaactctcgaagaacgtaacgatgtcgtatatgctgcctcacctccactcgggatgggccgtggatcaagccatcctcgccgaggaggaacgcctcgtcatcatccgattcggccacgactgggacgaaacttgcatgcagatggacgaggtgctggcttcagttgctgaaacattaaagaactttgcagttatttaccttgtggatatcacagaagtgccagattttaacacaatgtacgagttatatgatccgtccaccatcatgttcttcttcagaaacaagcacattatgattgatcttggcactggaaacaacaacaagatcaactgggcactgaaggataaacaggagttcatcgacatcgtcgagactgtctaccgtggtgcaaggaagggccgtggtctagttattgctccaaaagattactctactaaatatcgttactgagtactcgtcttaccctttatgcagtataatatcttacaatcttcttgtatgttgatttggtgaaaaccttcacaatttcagttcctatacggaactggattcttaagcttctatgctagttaaaggtctgaaagatttacgcagcaattaatgtctggtttgtgctgttattggatggtcttttgtactttatccatgtattcagatttgaggatttattatcaggtggcttgaat

SEQ ID NO: 3625 - DNA, 788 bp, Aquilegia formosa
cccaactcgcttgcaataagaatctatgcttttgttcctctctcctctctcctctctctctctctctcgtgtgttgttgttctgccattactacttactagtgaagctgttttgctgtttaggtttccagatccagatatgtcgtacctacttcctcatttgcattcaggatgggcagtcgatcaggcaattcttgccgaagaggaacgactcgttgtcattcgatttggtcatgattgggatgaaacttgtatgcagatggacgaggtgttgtcttctgttgcagagactataaagaactttgcagttatttaccttgtagacattactgaggttcctgacttcaacaccatgtatgagctttatgacccttccacagtcatgttcttttttcgcaacaaacacataatgatcgatcttggaaccggaaacaacaacaagatcaactgggcaatgaaggataagcaggagtttattgacatcgttgagactgtttaccgtggagcgaggaagggccgtggtttagtgattgctcccaaagactactccaccaagtatcgttactaggccttaggcctttcttattctatgctagtaatggctgtagctcatttactgatgagtgtatcaaattgtataacaagtacatcttttcgagtacagtcattaccttctttgctggatggcaagaaggagattgatcttgtgtgatctttgaactgagtaagaaagatactgtaatattaatattattcgactcaaatctgggaatcttaatgtttgtttaa

SEQ ID NO: 3626 - DNA, 680 bp, Arabidopsis lyrata
gaaacagatcggaaaatcgtcgagagagagagagagagagagagagagagaggatgtcgtatcttctgccgcatctgcactccggttgggctgttgatcaggcgattctggccgaggaagagcgtctcgtcgtcattcgtttcggccatgactgggatgagacttgtatgcagatggatgaggtgctttcctctgttgctgagacgataaagaactttgcagtcatttatctggtggacatcactgaggtgccagacttcaacaccatgtacgagctgtacgatccttcgacggtcatgttcttcttcaggaacaagcacatcatgatcgatcttggaactggtaacaacaacaagatcaactgggccctcaaggacaagcaggagttcatcgatatcatcgagactgtctaccgcggtgcaaggaagggtcgtgggttggtgattgctccaaaagattactccaccaaataccgctactaaccgggcttctcaacactatctagtttgttaaaaccattgagtcgagcgattctggtcagctgaaatatcccatgaactggtttcatatatgctttgatgattgtgattctggtttttgcttgctgtttcggttgttctccatttatttatgtaactacttgctttgaacatgattcagtgaaatgaaatttggaagcc

SEQ ID NO: 3627 - DNA, 721 bp, Arabidopsis thaliana
gcaagagagaaaaaaggttgaatcgaaacagatcggaaaatcgtcgagagagagagagagagagagaatgtcgtatcttcttccacatctgcactccggttgggctgttgatcagtcgattctggccgaggaagagcgtctcgtcgtcattcgtttcggccatgactgggatgagacctgtatgcagatggatgaggtgcttgcgtctgttgctgagacgattaagaactttgcagtcatttatctggtggacatcactgaggttccagacttcaacaccatgtacgagctgtacgatccttctacggtcatgttcttcttcaggaacaagcacatcatgatcgatcttggaactggtaacaacaacaagatcaactgggctctcaaggacaagcaggagttcattgatatcattgagactgtctaccgtggtgcaaggaagggtcgtgggttggtgattgctccaaaagattactccaccaaataccgttactaatcgagcttcccaacactatctagtttgttaaaaccattgagtctagtgattctggtcagctgaaatatcccgtgaactggtttcatttcatatatgctttgatgatgattgtgattctggtttttgcttactgtttcggttgttctccatttatgtatgtaactacttgcttcgaacatgattcagtgaaatgaaatttggaagccgttgggtttatgtatatgc

SEQ ID NO: 3628 - DNA, 966 bp, Musa acuminata
gaatcagtcatctcgcggaatatattctcccactggtacaccgaagagagagagagagagagagagaagagggaaaggaagaggcgcgggcggtggtggtagcgggagacgcaagtatgtcgtacctcctgccgcacctccattctgggtgggccgtggatcaggcgatcctggctgaggaagagcgcctcgtcgtcatccgcttcggccacgactgggacgagacgtgcatgcagatggatgaggtgttggcatctgttgcggagaccatcaagaattttgctgtgctatacctggttgacatcactgaggtgccagacttcaataccatgtatgagctgtatgatccatcaaccgtgatgtttttcttcaggaacaagcatatcatgattgatcttgggacgggaaacaataataagatcaattgggccctcaaggataagcaggagtttatcgatatcgtggaaaccatctataggggggcaaggaaaggtcgtggtctggtgattgctccaaaggactactctaccaagtatcgctactagtgaaatgagcttgtgtcattgactcatctcaattgcagcttgaaccgttacatgtacctaaagatggcatggggtaatgcttgtgtgatcgataccggtgtctagcaccaacaacttggcttgatcctgcttctaaaagaacttggatgtctcttgttgattcaatcggtaaatgaatgacggatccacggaaattagttcccttgtggatctgacttcatattcttgaagctgtctcttcttcctgctgatgccctcttctgctcaccccagttatcatctcgtgtgctctttgcttattaactcttattagcttatccttctctgctgtgattatgattggatagcacttgataggaagatgtcttcaggtatacagacgagtatctatgaatcccttgtgatttgtagcctgtacagg

SEQ ID NO: 3629 - DNA, 1161 bp, Brachypodium distachyon
gtcacgaacttgtcatcgtgagtaaacacctttatttttccgcttcgggctcacgtgtcatcttcaggtcgaaattatcacagccgattcgtgtctctgtatcgataattcgatatccatctcttcgtctggtcgttgcgaagacgaaacagagacagagaggagacgagaccagaggcacgagagagagagagcgcgcggagagaagaccgtcgccgccgctttacgttcaggcccaggcccagcccttaccaacccccacctttgctgttcaacccccacagattttctcgcgaatcagccgccgagggagagaagcgagccgccggcgacgaggcgaagatgtcgtacctgctgccgcacctgcactccgggtgggcggtggaccaggccatcctcgccgaggaggagcgcctagtcatgatccgcttcggccacgactgggacgagacctgcatgcagatggatgaggtgctggcaggggtagctgagaccataaagaactttgcagtgatctatctcgttgacatcaccgaggttcccgacttcaacactatgtacgagctgtatgacccgtcaacagtgatgttcttctttcgcaacaagcacatcatgattgatctcgggacaggaaataataacaagatcaactgggcaatgaaagacaagcaagagtttgttgacattgtggagactgtttacagaggagctcggaaaggtcgtggtctggtgattgctccaaaggattactccaccaaataccgttactaaggtgtttgtgtctagctgctcttggcctaatctatttgctaaaatgccagtactcaggcatgtgagccatgacatgaagtctgtcgactatcaagtgttgtgtaactgtatgtctttatcttgaatcttggtatctcataaacgaaacctgcaatccatagaaacaggctgtgttgttgtctatcggcatggccgataaaactgattgttggtttgaatcatatatgaattgctaaatccagagtcatctcctgtgtatggaatccctgctgaaattttccatttttgttagagcgtcagtgctcctgtgttgttcatgtatgtcaattcaacgctggaatttcaaaagcttgatgcatattagactcgccagctccacggttttctcaa

SEQ ID NO: 3630 - DNA, 710 bp, Manihot esculenta
ggatcaagtaatcgtagtgaagaattgaattctagggattcaacgacaaggtagagactagagagccatatgtcgtacctgcttcctcatttgcattcaggatgggccgtagatcaggcaatcttagcggaggaagaacgcctcgtcgttatccgcttcggccacgactgggatgagacctgcatgcagatggatgaagtgcttgcatcagttgctgagacgataaagaactttgcagtcatgtaccttgtggacataacggaggtgcctgatttcaacacaatgtatgagctatatgatccatccactgttatgttcttcttcagaaacaaacacattatgatagatcttggaactggaaataacaacaaaatcaattgggctctcaaggacaagcaggagttcattgacattattgagactgtataccgtggtgcaaggaagggtcgtggtttggttattgccccaaaagattactccaccaagtaccgctactaagtgtgtaagaaaattgttcattggactatgtaagaaattgttatgaaaacaatatgtatgcataaaacctagcttcaaaaattaatagattgtaatctcctggttaactaactaggagtttgttatgatggtatagttcctttttttcaccttttgcatggacaatgtatctgatgtttattttgagttgaaaccatagaattttctctgcc

SEQ ID NO: 3631 - DNA, 741 bp, Chelidonium majus
tagtaaggaagagaaggatgtcttaccttctccctcacttgcactccggttgggccgtcgatcaggctatccttgcagaggaagaacgacttgttgtcattcgattcggtcatgactgggatgaaacctgcatgcagatggatgaagtattggcttcagttgcagagacgataaagaattttgctgtgatctatctagttgacattacagaggttccagacttcaataccatgtatgaactctacgacccttcaacagtcatgtttttttcccgtaacaagcacatcatgattgatctgggaactggaaacaacaacaagatcaactgggccctcaaggataagcaggaattcatcgacatcatcgagaccgtctatcgtggggccaggaagggccgtggtctagtgattgctcctaaagactactccaccaagtaccgttactagctctttttactgttcgacagttatttctattaactcatgtagactttgtattctgtaatactcttaaaaccattgcttgggcttaacaaatgattgtgaacctattcaagctgtggggaaattgtgaaaatacttgagaactcaaccttcggctagttactcgtacagttgtagtcatgctgctcatgtttgcagaaagctctttgttttgattgtttttttttaaattttgctttccgaagttgagatgctgttgttttaggaaaaaaagttttaccgagacgcaacttatagg

SEQ ID NO: 3632 - DNA, 663 bp, Citrus clementina
aactaggggcgtgtagtggtgagagagggaattatagtttcgtcgtagagaagagagagggagagagaaagagagagagatgtcgtacttgctaccgcacttgcactcaggatgggcagtagatcaggccatcctggctgaggaagagcgtctcgtggtcatccgtttcggccacgactgggacgaaacctgtatgcagatggatgaagtgctgtcatcagttgccgagacaattaagaattttgctgtcatctacctcgtggacatttcagaggtgcctgattttaacacaatgtatgagctttatgacccctcaaccgtcatgttcttcttcagaaacaagcacattatgattgatcttggaactggaaataacaataagatcaactgggctcttaaggacaagcaggagttcatagacattgttgagactgtctaccgaggggcaaggaagggccgcggtctagtaattgcacctaaggattattccaccaagtaccgctactgagtacttgtgcaaaattgtaattcatttgtaagattatcatttgaaacctattgtgtgaaagttgtcttcaaaagtcaatggagtgagaacgcattgatctatcaatgaacagagaacacccctttaatgaagtgttcaacgttgaatttttatca

SEQ ID NO: 3633 - DNA, 597 bp, Cleome gynandra
ccggtagtgtgaacggaggagacgaataagaggccatctcccctcggttccaggttcttttgtatttgttatcatccgacagattttacagagagagagaggtgaaaagatgtcttatctactaccgcacttgcactcgggatgggcggtggaccaggcaatccttgccgaggaagagcgacttgttgtcatacgctttggccatgattgggacgagacctgcatgcagatggatgaagtgctagcatctgttgccgagaccataaagaatttctctgtgatttatctggtagacattacagaggtgccagattttaacacgatgtacgagctgtacgatccctccacggtcatgtttttcttcaggaacaagcacatcatgattgatcttggaaccggaaacaacaacaaaattaactgggcactcaaagacaagcaggagttcatcgatattattgaaactgtctatcgtggtgcgaggaagggtcgtggtctggtgattgctccaaaggactactccaccaaataccgctactaatccgcttttccaacagtgtcgtgtagtgtgacattcatgtataaacatcgctcgaacat

SEQ ID NO: 3634 - DNA, 674 bp, Cleome spinosa
ggggggggtttaggatcggatttcatttcactcgcgggcggagagagagagaggtgaaagatgtcgtatctgctaccgcacttgcactcgggatgggcggtggaccaggcgatcctcgcggaggaagagcgtctcgtcgtcatacgcttcggccacgactgggacgagacctgcatgcagatggatgaagtgctagcatctgttgccgagaccctaaagaatttcgctgttatatatctggtggacattacggaggtgccagatttcaacacgatgtacgagctgtatgatccctcgacgatcatgttcttcttcaggaacaagcacatcatgattgatcttggaactggaaacaacaataagatcaactgggctctcaaggacaagcaagagttcatcgatattgtcgagactgtctaccgtggtgcgaggaaggggcgtggtctggtgattgctcccaaggactactccaccaaataccgctactaattggctttttcgagcatgttctgtagctcgtcgatgccatgtataacattgctcacgcatgctgtggcctatgattgttgcctttaattccagtttgctttgtgtgatgcttgaaagataatcgaatgaaactcaaaagccaatatggaatttatgtacattgttacatcttcatctcgaaaaaa

SEQ ID NO: 3635 - DNA, 441 bp, Cucumis sativus
atgtcctaccttctacctcatttgcattctggatgggctgtggatcaagccattctagctgaagaagaacgtgtcgtcatcatccgtttcggccatgattgggacgacacttgtatgcagatggatgaagtgttggcctcagttgcagagacaattaagaactttgcagtaatttaccttgtggatatcacagaagttcctgatttcaacacaatgtatgaattgtatgacccttccaccgtcatgttcttctttaggaacaagcacataatgattgatcttggtactggaaacaacaataaaataaattgggcactcaaggataaacaagagttcattgatattattgaaacagtttatcgtggagcaaggaaaggacgtggtttagtcattgcacctaaggattattcaaccaaatatcgctactaagacattttgcta

SEQ ID NO: 3636 - DNA, 607 bp, Flaveria ramosissima
aaagacaaaagaagagagatgtcgtacttggtgcctcacctgcactccgggtgggccgtcgatcaggcgattctggccgaggaagagcgtctcgtcgtcatccgcttcggtcatgattgggacgaaacttgtatgcagatggatgaagtgcttgcttcagttgcagagacgataaagaactttgctgtaatatacttggtggacataacagaagtacctgacttcaatacaatgtatgaactttacgacccgtcaactgtaatgttttttttcaggaacaaacatatcatgattgatcttggtaccggtaacaacaataagatcaactgggccatgaaggacaaacaggagttcatagacattgttgaaactgtctatcgtggggcccgaaagggccgtggtttggtcattgcacccaaagattactccaccaagtaccgctactaaacttattcgggcctaggggtctgtggatttgaaccgaatttagaatggtataaaccagttgcgacttatgaattgtgctaacatttgtgtgactggtattttgaattcatgtatttattggagttgggtcaaaaattaaactgggttacttaaaccgttt

SEQ ID NO: 3637 - DNA, 538 bp, Flaveria ramosissima
tcgtacctgctaccgcacttgcactccggttgggcggtggatcaggcgattctggcggaagaggagcgtctcgtcgtcatccgattcggtcatgattgggacgaaacttgtatgcagatggatgaagtgcttgcttcagttgcagagacaataaaaaactttgctgtaatatacttggtggacatcacagaagtgcccgactttaatacaatgtatgaactgtacgacccgtcaactgtaatgttctttttcaggaacaaacatatcatgattgatcttggtactggtaataacaataagatcaactgggccatgaaggacaaacaagagttcatagacattgttgaaaccgtctaccgtggggcccggaagggccgtggtttggttattgctcccaaagattactccaccaagtatcgttactaaactcatttgtgtcggagtttgttggatctgaactgtatttcgaaagatttaaaccggttgtggtttttaaattgttataaaactagtgtaattgtggtctattgaaacctat

SEQ ID NO: 3638 - DNA, 728 bp, Gerbera hybrid cultivar
cgcacacctgtcgtttaggcgatccagagatgtcgtacttgctgccgcacttgcactcaggttgggccgtcgatcaggccatcctcgccgaggaagaacgtctcgtcgtcatccgcttcggccatgattgggacgaaagttgtatgcagatggatgaagtgcttgcttcagtcgcagagacgataaagaactttgcagtgatatacttggtggacatcacggaggtgcctgacttcaatacaatgtatgaactttatgacccgtctactgttatgtttttcttcaggaacaagcacataatgattgatcttggtaccggtaacaacaataagataaactgggcaatgaaggacaagcaggagtttatagatattgttgaaacggtctatcgtggggcccggaaaggccgtggtttggtcattgcacccaaagattactcgaccaagtaccgatactaaatccacaagctaatccttggtgtattttggggctgtggacttgaagtcttgaaccatgtctttatatttgaaagagataaactggatatgacttgtgtattgagcacattaaagtttcacttgtttgtgtgattgtatttgctttaattgtatatccaattacttatgtgttggttggtaacaattatgttttctgattaccgtttttttataatgtaaacacggttttgactgcgtatgaaagtgaaatgaaaatcagtttgttatttg

SEQ ID NO: 3639 - DNA, 776 bp, Leymus cinereus x Leymus triticoides
ttctgaggttcgaaatccccaaatctcctcgcccatcagcggggccgtcggcgacgagcgcgaggcggagatgtcctacctgctgccacacctgcactcgggatgggcggtggaccaggccatcctcgccgaggaggagcggctagtcatcatccgcttcggccacgattgggacgagacctgcatgcagatggatgaggtgctatcaggtgtggctgagaccataaagaactttgcagtgatctaccttgtagacatcaccgaggttcctgatttcaacaccatgtacgagttgtatgacccatcgacggtgatgttcttcttccggaacaagcacatcatgattgatcttgggacaggaaacaataacaagatcaactgggccatgaaagacaagcaagagttcgtcgacattgtggagactgtgtacaggggagcccggaagggccgtggtctggtgattgctccaaaggattactccaccaagtaccgttactaggccacttgtgtctggctgttcatgtgctatttctagcgtattctgtccggtaaaatgtctgtggtcacctgttaggcaggtgacccttaatgcaaaccgttaagtttgccagcttatccagtgttgtatcttggcatctcataagcatccgtaaaatccttaatgattgtttgaatgttcgacacataatatgttgtcattggtatgaccaatataactggtatatgagttgctgaatcatataggatagctggattgattgtttccttctttttca

SEQ ID NO: 3640 - DNA, 647 bp, Lotus japonicus
catcgcatcgcaacgcagacctaataagagaagggtgcagatatgtcgtacctgttgcctcacttgcattcaggatgggctgtggatcaggcaatccttgctgaggaagagcgtcttgttgtcatccgcttcggtcacgattgggatgagacctgcatgcagatggatgaggtgctggcatcggttgcggagacaataaaaaactttgctgtaatataccttgtggacatcacggaggtaccggatttcaataccatgtatgagctgtatgacccctccactgttatgtttttcttcagaaacaagcacatcatgatagatcttggcactggtaacaacaacaagatcaattgggctatgaaggacaagcaggagttcattgacatcattgagaccgtctacagaggggcaaggaagggacgtggtctcgtcattgcccccaaagattactccaccaagtaccgttactaaaagcatatctcttccaaaactatagtaaactctgtatttgcactctgctgcaaaacctgattcaagattttactatcccgtatgcctattgtgtataggactatgagtgtgactgtcattcagaatattaaacttatctgtcttcttaaactatgactagtctgctctgttctgct

SEQ ID NO: 3641 - DNA, 538 bp, Mimulus guttatus
atagcacatcgaatcctttgaccaaaacgatgtcgtatttgctgcctcaccttcactctggatgggccgtcgaccaggccatactcgccgaggaagaacgcctcgtcatcatccgcttcggccacgactgggacgaaacttgcatgcaggcagatggatgaggtgttggcttcggtagcagaaacactaaagaattttgcggtgatatacctggtggatatagcagaagtgcctgatttcaacaccatgtacgaactgtacgacccttcgactgtgatgtttttcttcagaaacaagcatattatgatcgatcttggcacagggaacaacaataagatcaactgggctttgaaagataagcaggagtttatcgacattgtcgagactgtgtaccgcggtgctaggaagggccgtggtcttgtcattgctcctaaagactactccaccaaatatcgatactgagtcggttacatgcatatgtctctctcattaaatttagggtaagttacaaccacccctgatgtaagatctatttacg

SEQ ID NO: 3642 - DNA, 722 bp, Nicotiana benthamiana
  misc_feature (458)..(458): n is a, c, g, or t
gcacgaggccaaaacccctccttgagctacttttcccttgctatcctagcgatcagagaaagatgtcgtacttgttgcctcaccttcactcgggatgggcggtggatcaggcaattctcgctgaagaagaacgcctcgtcattatccgcttcggccatgactgggacgaaacttgcatgcagatggacgaggtgctggcttcagttgcagatacattaaagaattttgctgtcatatacctggtggacatcacagaggtccctgattttaacacaatgtatgagttgtacgatccatccactatcatgttcttcttcaggaacaagcacatcatgattgatcttggcacaggaaacaataacaagatcaactgggctctcaaagataaacaagagttcattgatattgttgagacagtgtaccgtggcgcgagaaagggtcgtggtctagttattgcncctaaagattactctaccaagtatcgttactgagtgtctgtgatatcatattgagctataagatacttcatgatgaaactgaatcagctgtcaaggcccagaaatgtacaataactttccattagttgcaagtggaagacctctagtcttgttcaaaccatgttatgataaattatattgactgttttgaaattgtacttttgtgatttcggcttcaactgttttgaacaagttgattagggagaagatttaactattcaggta

SEQ ID NO: 3643 - DNA, 680 bp, Nuphar advena
  misc_feature (578)..(578): n is a, c, g, or t
  misc_feature (642)..(642): n is a, c, g, or t
ggcttcccttccacagagccacttttggacctcctagggttttctgtagcaagaggaagagctcttcgaggaaacaatgtcatacctgcttccccatcttcattctggctgggctgtagatcaggccatacttgctgaggaagagcggcttgtcatcattcgttttggacatgattgggatgatacctgcatgcagatggacgaggtgctctcttctgttgctgaaaccataaagaattttgcagttatttatctggttgatattacggaggtgccagactttaacaccatgtacgagctgtatgacccttccaccgtgatgttcttctttaggaacaagcacataatgatcgacttgggtaccggtaacaacaacaagattaactgggctctgaaggacaagcaagaattcatcaacattgttgagacggtgtatcgtggagctagaaaaggcagaggtttggtgatcgcacccaaagattactcaactaagtaccgttactaaaccatatgtgcatgaaacaactcacgtggctttatgccactccatattgcctcaggccaggtactttgtgctnatattatgaatgattcacagcagtctaacaattaaaaaacattattgggccagtaatcatgtangcttgatgccttatgtttcctcgaaaccctcactgtat

SEQ ID NO: 3644 - DNA, 738 bp, Avena sativa
gtcgactccacaaatttcctcacgaaccaggcgcggagagaggagaagcagagggcggccggcgacgaggcgaggcggagaagatgtcgtacctgctgccgcacctgcactccggctgggcggtggaccaggccatcctcgctgaggaggagcgcctcgtcatgatccgcttcggccacgactgggacgagacctgcatgcagatggacgaagtgctggcaggggtggctgagaccataaagaactttgcggtaatctacctcgttgatatcactgaggttcctgacttcaatacaatgtacgagctgtacgacccatcaacagtgatgttcttctttcgcaacaagcacatcatgattgatctcggaacaggaaacaataacaagatcaactgggcgatgaaagacaagcaggagtttgtcgacattgtggagactgtctacagaggagcccgtaagggtcgcggtctggtgattgctcccaaggactactccacgaaatatcgttactgagctacgatgtgtctggctgtcccatgtgtgtaacttctggcctactaggttcggtatgatgccagactgccagcatgtgaccgttgatgtgatgtcaaatcaactttcagagtgttgtgtaactaaatttctgtatcttgaatattgatgtgtcataataaaccggcaatccttggaacatgaccctgttggctatttgtatggctaatgaaacagattgttggtc

SEQ ID NO: 3645 - DNA, 706 bp, Olea europaea
agaacaaaattttctaaactcgaactctcgaagaacgtaacgatgtcgtatatgctgcctcacctccactcgggatgggccgtggatcaagctatcctcgccgaggaggaacgcctcgtcatcattcgattcggccacgactgggacgaaacctgcatgcagatggacgaggtgctggcttcagttgctgaaacattaaagaactttgcagttatttaccttgtggatatcacagaagtgccagattttaacacaatgtacgagttatatgacccgtccaccatcatgttcttcttcagaaacaagcacattatgattgatcttggcactggaaacaacaacaagatcaactgggcactgaaggataaacaggagttcatcgacatcgtcgagacggtctaccgtggtgcaaggaagggccgtggtctagtcattgctccgaaagattactccaccaaatatcgttattgagtactcgtcctaccctttatgcattataatatcttacaatcttcttgtatgttgatttggtgaaaaccttcacatttcagttcctatacggagctggattcttaagcttctatgctagttaaaggtttgaaagatttacgcagcaattaatgtctggtttgtggtgtcattggatggtcttttgtactttatccatgtattcagatttgaggatttattatcaggtggcttgaat

SEQ ID NO: 3646 - DNA, 779 bp, Olea europaea
cacagaaccagaacaaaattttctaaactcgaactctcgaagaacgtaacgatgtcgtatatgctgcctcacctccactcgggatgggccgtggatcaagctatcctcgccgaggaggaacgcctcgtcatcattcgattcggccacgactgggacgaaacctgcatgcagatggacgaggtgctggcttcagttgctgaaacattaaagaactttgcagttatttaccttgtggatatcacagaagtgccagattttaacacaatgtacgagttatatgacccgtccaccatcatgttcttcttcagaaacaagcacattatgattgatcttggcactggaaacaacaacaagatcaactgggcactgaaggataaacaggagttcatcgacatcgtcgagacggtctaccgtggtgcaaggaagggccgtggtctagtcattgctccgaaagattactccaccaaatatcgttattgagtactcgtcctaccctttatgcattataatatcttacaatcttcttgtatgttgatttggtgaaaaccttcacaatttcagttcctatacggaactggattcttaagcttctatgctagttaaaggtctgaaagatttacgcagcaattaatgtctggtttgtggtgttattggatggtcttttgtactttatccatgtattcagatttgaggatttattatcaggtggcttgaatctttagagaggcgactcatgaactctacttcgcgttctttttggtgtttcatgttaaaatttt

SEQ ID NO: 3647 - DNA, 761 bp, Olea europaea
cagtgcaacaaacaagagaggagcaagttgcaaggaaaaggttgaataaacgcgaggcgtctttcctgacaataaaaataccagtacccaaacaagaattctcgaagagtgaaactatgtcgtatatgctaccacacctccattcgggatgggcggtggatcaagctatcctcgctgaggaggaacgccttgtcatcatccgattcggccacgactgggacgaaacctgcatgcagatggacgaggtgctggcatcagttgctgaaacattaaaaaactttgctgtgatttacctggtggatatcaccgaagtgcctgattttaacacaatgtatgagttatatgacccttccaccatcatgttcttcttcagaaacaagcacattatgattgatctgggcactggaaacaacaacaagatcaactgggcactgaaggataaacaggagtttatcgacattgttgagaccgtctaccgtggtgcaaggaagggccgtggtctagttattgctccaaaagattattcaaccaaatatcgttactgagtactcgtcttacagttatgaggtatgctttcttgcaactctgtcgtgttatcaatttggtgaatactttcacaatttaagttcttatatggaactgaactctcaaactcctgtgctagttattgctcttagagactcaggctgcaattaaggtctggtttgtggtataattggatggtacttttgttatttatccatgtattcggatttattatc

SEQ ID NO: 3648 - DNA, 663 bp, Citrus sinensis
aactaggggcgtgtagtggtgagagagggaattatagtttagtcgtagagaagagagagggagagagaaagagagagagatgtcgtacttgctaccgcacttgcactcaggatgggcagtagatcaggccatcctggctgaggaagagcgtctcgtggtcatccgtttcggccacgactgggacgaaacctgtatgcagatggatgaagtgctgtcatcagttgccgagacaattaagaattttgctgtcatctacctcgtggacatttcagaggtgcctgattttaacacaatgtatgagctttacgatccctcaaccgtcatgttcttcttcagaaacaagcacattatgattgatcttggaactggaaataacaacaagatcaactgggctcttaaggacaagcaggagttcatagacattgttgagactgtctaccgaggggcaaggaagggccgcggtctagtaattgcacctaaggattattccaccaagtaccgctactgagtacttgtgcaaaattgtaattcatttgtaagattatcatttgaaacctattgtgtgaaatttgtcttcaaaagtcaatggagtgagaacgcattgatctatcaatgaacagagaacacccgtttaatgaagtgttcaaccttgaatttttatca

SEQ ID NO: 3649 - DNA, 703 bp, Orobanche aegyptiaca
tctctctctcactacccgcctccatctcacttctgccgctgcaaaccctcacattcttcaaacgatgtcgtatctgctaccgcaccttcactccggctgggccgtcgatcaggcgatcctcgccgaggaggagcgcctcgtcatcatccgtttcggtcacgactgggatgaaacatgtatgcagatggacgaggtgctgtcttcagttgccgaaacgatcaagaactttgctgtgatatacctcgtcgacatcacggaggtgcccgatttcaacacgatgtacgaactttacgacccttcgactgtcatgttcttcttcaggaacaagcacatcatgatcgacctcggtaccggtaacaataacaagattaactgggccatgaaggataagcaggagtttatcgacatcgtcgagaccgtctatcatggggcccgaaagggacgtggtctggtcatcgctccgaaagattactcaacgaaatatcgttattgattattattcatatgctattctgtgttgaataattgactgtgaaatttgactctctctatggggatttagactgaatggtgtagcattacactgttgagatgatatgattcaaacatgaacgatgcatgtaataaaattcttaatatgtatgtaccttctaagagtttcacacatcatcactatatgtgacatgtgaatctccttcatacc

SEQ ID NO: 3650 - DNA, 695 bp, Petunia hybrida
agaaaagaagcaaaataagaagaagagctttgggggaaacatgagttgtcggctgtagaactccatcagatccgacaccatctactagtgagcatcgtgattgaccgaggtggagcattccttttgtagcttctctttctccaaccaaacaacccttccttcaaaaagatgtcgtacttgttgcctcaccttcactcaggatgggccgttgatcaagccattcttgctgaagaggaacgccttgttattatccgcttcggacatgactgggacgaaacttgcatgcagatggatgaggtgctagcttcagttgcagatacattaaagaattttgctgtcatatacttggtggacattacagaggtccctgattttaacacgatgtatgagttgtatgatccatccactatcatgttcttcttcaggaacaagcacatcatgattgatcttggcacaggaaacaataacaagatcaactgggcactcaaagataaacaagagttcattgatatcgttgagacagtgtaccgtggagcaagaaagggccgtggtctagttattgcaccaaaggattactctaccaagtatcgttactgagtgtgtgtggatattgtactctgggtggggagtatgctgtatgaataccggactgtattgcagttgctaaaacgatatgcattcaattggagcagttg

SEQ ID NO: 3651 - DNA, 831 bp, Papaver somniferum
cagctcagagagagatagtttgcgtaggtgaagtgaattattacaagtagatatcgtcaatactggcgaattattaagggtttctcgtaggaaggaaaaagaaagaaaggatgtcttaccttctacctcacttgcactctggttgggccgtcgaccaagctatcctcgctgaggaggaacgtctcgttgtcattagattcggtcacgactgggatgaaacttgcatgcagatggatgaggtattatcttcagttgctgagacgataaagaattttgcagtgatctatctggttgacatcactgaggtacctgactttaacaccatgtacgaactgtacgacccttcaacagtcatgttctttttccgcaacaaacacatcatgattgatctgggaactggaaacaacaataagatcaattgggcgctcaaggacaagcaggagttcattgacatcattgagaccgtctatcgtggtgccaggaaaggtcgaggtcttgtgatagcgcccaaagactactctaccaagtaccgctactagatgctgctgctcgagcttgttataacaaactctttatcttactgaaaataccctctctataagtctttcagtaatttctttgttactgttcttgggcatgatttagggtattctgtgtttgggtcagagtttttaatgaagacagtataataataaactcttcctgatttgtacttttgtttgtaatggaatggtaaagtattcataaacaatcctgatttatactctttatctgacagactcttctaatgaactaggatcagtgttctcgttctacttaaaaaaaaaaaaa

SEQ ID NO: 3652 - DNA, 669 bp, Papaver somniferum
tagacatcgtcaacactggtgaattattaagggtttctcgtaggaaggaaaaagaaagaaaggatgtcttaccttctacctcacttgcactctggttgggctgtcgaccaagctatcctcgctgaggaggaacgtctcgttgtcattagattcggtcatgactgggatgaaacttgcatgcagatggatgaggtattatcttcagttgctgagacgataaagaactttgcagtgatctatctggttgacatcactgaggtacctgactttaacaccatgtacgaactgtacgacccgtcaacagtcatgttctttttccgcaacaaacacatcatgattgatttgggaactggaaacaacaataagatcaattgggcgctcaaggacaagcaggagttcattgacatcattgagactgtctatcgtggtgccaggaaaggtcgaggtcttgtgatagcgcccaaagactactctaccaagtaccgctactagatgctgctgctcgagcttgttataacaaactctttatcttactgaaaataccctctctataagtctttcagtaatttctttgttactgttcttgggcatgatttagggtattctgtatttgggtccgagtttttaatgaagacgtataacagtaaactcttcctgatttgtactttt

SEQ ID NO: 3653 - DNA, 1142 bp, Papaver somniferum
gggatattttctccgttgttttctcggtgtctctagcatcaccgtttttcaaatatctcgttttctcttcttctgttcctgctgaactaacccaaaaccgtgagcagtttttgaagatgatcaacacagtgacgatgcacgaaacaaaagcttgaaaaatccatagatccgaagatcgaaggaaggtcgtttgtgcttaagtattggtgctttttattgggcagatcgagcctccacttggaccaggtgataacaggtaaacatttctcttaggaaggaaaaagaaagaaaggatgtcttaccttcttcctcatttgcactctggttgggctgtcgaccaagccatcctcgctgaggaggaacgtctcgttgtcattagattcggtcacgactgggatgaaacttgcatgcagatggatgaggtattatcttcagttgctgagacgattaagaactttgcagtgatctatctggttgacatcactgaggtacctgactttaacaccatgtacgaactgtacgacccttcaacagtcatgttttttttccgcaacaaacacataatgattgatttggggacgggaaacaacaataagatcaattgggcgctgaaggacaagcaggagttcatcgacatcattgagactgtctatcgcggggccaggaaaggtcgaggtcttgtgatagcacccaaagattactctaccaagtaccgttactagatgcggttgcttgagcttgttataacaaactctttatctgcataaaatcaacagcatgtttgtttttagaagtatttgggtagtgagtatatatacaccacttgcagcatataaatgccactacctaaaacctctaattgttatgtttgttttatgactactttcaaaaccagcagaaaatgatacaagataaaccagtgtgcacaagggtattttatgtccaaaaaaaagatcagtcagttgagtcagttctgactaaaaatatgaacatattttttgagtcagacctttgcgagtcagatccagatgagtcaggtgatctgagtcagttctagccgagtcgaatccggaaaaaagacgaacatcctgtataacctaccctggaaaacttcgtcagctgattatgatcctcggatccat

SEQ ID NO: 3654 - DNA, 750 bp, Papaver somniferum
agtttgcgtaggtcaagtgaattatcagaagaagacgtcgtgattcgtcaatactggtggaatatttagggtttctcgcaggaaggaaaaagaaagaaaggatgtcttaccttctacctcacttgcactctggttgggccgtcgaccaagctatcctcgctgaggaggaacgtctcgtcgtcattagattcggtcacgactgggatgaaacttgcatgcagatggatgaggtattatcttcagttgccgagacgataaagaactttgcagtgatctatctggttgacatcactgaggtacctgactttaacaccatgtacgagctgtacgacccttcaacggtcatgttctttttccgcaacaaacacatcatgattgatttgggaaccggaaacaacaataagatcaattgggcgctcaaggacaagcaggagtttattgacatcattgagaccgtctatcgtggggccaggaaaggtcgaggtcttgtgatagcacctaaagattactccaccaagtaccgttactagatgtggctgctcgagcttgttggaacatactctttatcttactgatgcggctgctcgagcttgttggaacaaactctttatcttactgagtcgttcagtattttcgttaactcttcctgtttttgttttgtaatggaatgataaagtattcctaaacaatcctgccaccctgctaatgaactagcattggtgtacagtgtacttgatccaatttatatta

SEQ ID NO: 3655 - DNA, 737 bp, Solanum tuberosum
gggatggtttgggggaggatgaagaatgaattaggtttttcaaattaataagtgagaaaacccttggtttggtggactcagaaagatgtcgtacttgttgcctcaccttcactcaggatgggccgtcgatcaagccattctcgctgaagaggaacgccttgtcattatccgcttcggccatgactgggacgaaacttgtatgcagatggacgaggtgctggcttcagttgcagatacattaaagaattttgctgtgatatacctggtggacataacagaggtccctgattttaacacgatgtatgagttgtacgatccatcaactatcatgttcttcttcaggaacaagcacatcatgattgatcttggcacaggaaacaataacaagatcaactgggcactcaaagataaacaggagttcattgatattgttgagacagtgtatcgcggtgcacgaaagggtcgtggtctagttattgcaccaaaagattactctaccaagtatcgttactgagtgtctgttgatattgtattttgtttgtggaatatgctgcactttatgactgaactgtaacatacggttgctaagtggtttccattagaccgattctgttgctttcaagatccaagtgtacaataactttccattgttgcaagtggaaagactaaactctttgtgaaaccatgttatgatctatctattatattgacctttctgtaaaaaacaaaaaaaaaaa

SEQ ID NO: 3656 - DNA, 755 bp, Rosa hybrid cultivar
gctttaaccatagcagccttgggctccaaaacccatacccagagtttatatttgatcattcaccatttacagagactttcggtctcgatagaaagagaagttgggaatttggagaagtgagaaggtcatcgaaacgatgtcgtatctgcttccacatcttcactccggctgggccgtcgaccaggctattctcgccgaggaggagcgtctcgtcgtcatccggttcggccacgattgggatgagacttgtatgcagatggatgaagtgctagcaaatgttgcagagactcttaagaactttgctgtgatttaccttgtggacatcactgaggttcctgatttcaacaccatgtatgagttgtatgacccttcgacagtcatgttcttcttcagaaacaagcacattatgattgatctcggcactgggaacaacaacaagatcaactgggctctcaaggacaagcaggagttcattgacgttgtggagactgtgtaccgaggcgcgaggaagggacgtggtctggtgattgctcccaaggattactcaaccaagtaccgctactaaattgaagtcctgtacttcatttcagactttgtaagacaaatattgaaaagccctatgcaatgggattaatttctctagattctggatgtgttgtattgaactgggggagaacaatgtgtgaatgttttacagcctaaaccagttgtgcaccaatcaattgttttaagtgtggcactattttaacaaaaaa

SEQ ID NO: 3657 - DNA, 872 bp, Secale cereale
gtgggggccggcggcatataccaactacgcagttttccggtaagtttccgtatggtgtcttagcagttcgatcgaaactctccccaaaagttcctgtgttgcgttccacgaacattccacctctgctatctgctcgctacgcgtttctgagggtcgaaatccccaaatcttgtcgcgtgtcagcgggggccgtcggcgacgagcgcgaggcggacatgtcctacctgctgccgcacctgcactccggatgggcggtggaccaggccatcctcgccgaggaggagaggctggtcatcatccgcttcgggcacgattgggacgagacctgcatgcagatggacgaggtgctatcaggtgtggctgagaccataaagaacttcgcagtgatctaccttgttgacatcaccgaggttcctgatttcaacaccatgtacgagttgtatgacccgtcgacggtgatgttcttcttccggaacaagcacatcatgattgatcttgggacaggaaacaataacaagatcaactgggccatgaaagacaagcaagagttcgtcgacattgtggagactgtgtacaggggagctcggaagggccgtggtctggtaattgctccaaaggattactccaccaagtaccgctactaggccacttgtgtctggctgttcatgtgctatttctagcgtattctgtcaggtaaaatgtctgtggtcactggtcaaccaggtgacccttaagccttaatgcaaacttttaagtattccagcttatccagtgttgtatcttggcatctcatatgcatccgtaaaatccttgatgattgtttgaatgctcgacacagaattggcatgaccaataaaagtggtatatgagtt

SEQ ID NO: 3658 - DNA, 700 bp, Scabiosa columbaria
cattatataccttcttcgtaaaagtcatagacacaggctgagcttgaagagaaaaagaagtagaagaaggagaggagatgtcttacttgttaccacacttgcactcgggatgggcagtcgatcaatccattctcgccgaagaagagcgtctcgtcgtcatccgttttggccacgactgggatgaaacttgtatgcagatggatgaggtgttatcatctgttgctgagactataaagaactttgcagttatatacctagttgacataaccgaggtgccagatttcaacacaatgtacgagctctacgacccttctactgtaatgttctttttcagaaacaaacacatcatgatcgatcttgggactggaaacaacaataagatcaattgggcactcaaggacaagcaggagtttatcgacattgttgaaactgtctatcgtggggcccgtaaaggacgtggtttggttattgctcccaaggactactccaccaagtaccgttactgagactccctatctaatcccgaagggtacacaactacagatgctctgtctactcttttgagtcagttaaggttttaatattggggacatcatgattgccatactttgttgaaatattatgtttttatggcgctgttacatttgtcttggggatattttcattgtcattgaactatgtttgctttgtttttgcctgc

SEQ ID NO: 3659 - DNA, 725 bp, Solanum phureja
gggtggtttgggagagggtgaagaatgaagtaggtttttcaaattaattaataataagtgagaaaacccttggtttggtggactcagaaagatgtcgtacttgttgcctcaccttcactcaggatgggccgtcgatcaagccattctcgctgaagaggaacgccttgtcattatccgcttcggccatgactgggacgaaacttgtatgcagatggacgaggtgctggcttcagttgcagatacattaaagaattttgctgtgatatacctggtggacataacagaggtccctgattttaacacgatgtatgagttgtacgatccatcaactatcatgttcttcttcaggaacaagcacatcatgattgatcttggcacaggaaacaataacaagatcaactgggcactcaaagataaacaggagttcattgatattgttgagacagtgtatcgcggtgcacgaaagggtcgtggtctagttattgcaccaaaagattactctaccaagtatcgttactgagtgtatgttgatattgtattttgtttgtggaatatgctgcactttatgactgaactgtaacatacggttgctaagtggtttccattagaccgattctgttgctttcaagatccaagtgtacaataactttccattgttgcaagtggaaagactaaactctttgtgaaaccatgttatgatctatctattatattgacctttctgt

SEQ ID NO: 3660 - DNA, 809 bp, Fragaria vesca
agccgacttgcggagctcttgctttataagctgatcattcacacaaacttgtcgttctcgatagaaagagaaagttgggaatttggtgaagtgagaaggtgaccaaacgatgtcgtatttgcttccgcatcttcactccggctgggccgtcgatcaggctattctcgccgaggaggagcgtctcgtcgtcatccgattcggccacgattgggatgagacctgtatgcagatggatgaagtgctcgcaaatgttgcagagactctgaagaactttgctgtcatttaccttgtggacatcactgaagttcctgatttcaacaccatgtacgagttgtatgacccttccacagtcatgttcttcttcagaaacaagcacattatgattgatcttggcactgggaacaacaacaagatcaactgggctctcaaggacaagcaggagttcattgacgttgtggagactgtgtaccgtggtgcaaggaagggacgtggtctggtgattgctcctaaggattactctaccaagtaccgctactaaattgaagtcctgtacgtcatttcagactttgtaagacaaatattggaacatcctgtgtaatgggctaattttctctagattctggatttgttgtattggattagggataacaatgtgtgaatgtgttatggcctaaaccagttgtgcaccaatcaattgtttaagtgtggtactattttaacactgaatatgttcgtatttgtcatgctagtactattatctgctgggatctgatgttcattaatttgtacaatgattgatcatttgacga

SEQ ID NO: 3661 - DNA, 683 bp, Helianthus annuus
aaacttgacgcacgcgtgattggcaacaatcatcacacaaagaaggagagagagagagatgtcgtacttgctaccgcacttgcactccggctgggccgtcgatcaagcaatcctcgccgaggaggagcgcctcgtcgtcatccgattcggtcatgattgggacgaaacttgtatgcagatggatgaagtacttgcttcagttgcagagaccataaaaaactttgctgttatatacttggtgggcatcacagaagtaccagacttcaacacaatgtatgaactctatgacccgtcaactgtaatgttctttttcaggaacaaacatatcatgattgatctcggtactggtaacaacaacaagatcaactgggccatgaaggacaaacaagagttcatagacattgttgaaactgtctaccgtggggcccggaagggacgtgggttggtaattgcacccaaagattactccaccaagtaccgctactaaactcattcgggtgagagtttctgtggatttgaactgtgtattggaagatttaaaactggctgtgacttttgaattgttataacatgtgtgtaattgtcgtcttgtgaaactatgttctgagatttaacaactttgcttaaatcataatgtgtgacgataagaagttggataatgactaaagggcaaatgaaactct

SEQ ID NO: 3662 - DNA, 608 bp, Helianthus annuus
gagagagagagatgtcgtacttgctaccgcacttgcactccggctgggccgtcgatcaagcaatcctcgccgaggaggagcgtctcgtcgtcatccgattcggtcatgattgggacgaaacttgtatgcagatggatgaagtacttgcttcagttgcagagaccataaaaaattttgctgttgtatacttggtggatatcacagaagtaccagacttcaacacaatgtatgaactctatgacccgtcaactgtaatgttctttttcaggaacaaacatatcatgattgatctcggtactggtaacaacaacaagatcaactgggccatgaaggacaaacaagagttcatagacattgttgaaactgtctaccgtggggcccggaagggacggggtttggtcattgcacccaaagattactccaccaagtaccgctactaaactcattcgggtcagagtttctgtggacttgaactgtgtattggaagatttaaaactggctgtgacttttgaattgctataacatgtgtgtaattgtcgtcttctgaaactatgttctgcgattcaataactttgcttaaatcataatgtgtgacgataagaagttgg

SEQ ID NO: 3663 - DNA, 802 bp, Panicum virgatum
ccgccgccgtctgcctccagatccgctggtgggtttcaggcgctccttcttcacgagccgattcttctcccgagtcatcagctcggcgcccgcagaatagaagagtcgagaggtggagcggccggcgggggaagaagatgtcgtacctgctgccgcatctgcactcggggtgggcggtggaccaggccatcctcgccgaggaggagcgactcgtcatcatccgcttcggccacgactgggacgagacctgcatgcagatggatgaagtgctggcaacagtcgctgagaccataaagaactttgcggtcatctaccttgtcgacatcactgaggtccctgacttcaacaccatgtacgagctatacgacccatcaacagtgatgttcttcctccggaacaagcacattatgatcgatctcgggacgggaaacaacaacaagatcaactgggccctcaaggacaagcaagagttcatcgacattgtggagacggtctacaggggtgcccggaagggccgtggtctggtgatcgctcccaaggactactccaagtactgttactaagaagactgccattcgctctggctgctgctactgctgtccaacagttcaagttgctagcctagtgtctcccccttgtgttagggggacgtttactcagacagtcagacaatgggtgtctgcttcgagtgttgcctaactgtatcttggcatgcccactaccagaaaacggaaatttcatgatggtgaggtattttcgtgggaggtattaaggaaccgtcatgaaaattcttattttcgtg

SEQ ID NO: 3664 - DNA, 898 bp, Camellia sinensis
aagagaaatttgagagagagagagagattgattcagagagagaggatgtcgtacttgctgccgcacttgcactcgggatgggcggtggatcaggcgatcctggccgaagaagaacgcctcgtcatcatccgattcggccgtgattgggacgaaacctgcatgcagatggatgaggtactggcttcggttgctgagacaataaagaactttgcggttttatacctggtggacatcacagaggtgcccgatttcaatacaatgtatgagttgtatgatccgtcaaccgtgatgttctttttcaggaacaaacacataatgattgatcttggcacgggaaacaacaataagatcaactgggctttgaaggacaagcaggagttcatagacgttgttgaaacagtgtatcgtggagctagaaagggacgtggtctggtcattgcacccaaagactactccactaagtaccgctattaagccctcgagctacttcttgttctattggaaactgttttataaatcaagaacatgtttgtattaagcttcgaattctaatttggttgaatatgtggagtatgtcatatgtacaagtactaggcttttgccttttcattggatttctaggcatggacccatgcattgctatccaaaaaaataaagaaaatacatgtcttgcccctctccaacaatgtgcagacgaaacctgctcgtgcagcctccagcttatgtgccgctcgacagcagggttgaatgctgccgccttgttgtactctttgggtcgtaggctgaattcgctgcgctgagattgataacacgctcacagctgcatacagctgtaggagtcgttatgcgctacactagttacagccctggcgtgccaactggatgcagttaactgtca

SEQ ID NO: 3665 - DNA, 670 bp, Nicotiana tabacum
  misc_feature (632)..(632): n is a, c, g, or t
ttctctctcccgttttccaatctaggagaaccaaaacccttccttgagctacttttcccttgctatcctagcgatcagagaaagatgtcgtacttgttgcctcaccttcactcgggatgggcggtggatcaggccattcttgctgaagaggaacgcctcgtcattatccgcttcggccatgactgggacgaaacttgcatgcagatggacgaggtgctggcttcagttgcagatacattaaagaattttgctgtcatatacctggtggacatcacagaggtccctgattttaacacaatgtatgagttgtacgatccatccactatcatgttcttcttcaggaacaagcacatcatgattgatcttggcacaggaaacaataacaagatcaactgggctctcaaagataaacaagagttcattgatattgttgagacagtgtaccgtggcgcgagaaagggtcgtggtctagttattgcacctaaagattactctaccaagtatcgttactgagtgtctgtgatattgtactgaactataagatactttatgattaaactgaatcagctgtcaagacccagaagtgtacaataactttccattagttgcaagtggaaagacctctagtcttnttcaaaccatgttatgataaattatattgactgttttc

SEQ ID NO: 3666 - DNA, 647 bp, Nicotiana tabacum
  misc_feature (13)..(13): n is a, c, g, or t
  misc_feature (187)..(187): n is a, c, g, or t
agagagacccganagagagatgtcgtacttgttgccacatcttcactcagggtgggcagtggatcaagctattcttgctgaagaggaacgccttgtcatcattcgttttggccatgattgggatgataattgcatgcagatggatgaggtgctggcttcagttgcagagacaataaagaactttgcngtgatttacctggtagacatcactgaagtacctgattttaacacgatgtatgaattgtatgatccgtccaccattatgttcttcttcaggaacaagcacattatgattgatcttggcaccggaaacaataacaagatcaactgggcgcttaaggataaacaggaattcatcgacattgttgagacagtgtatcgtggtgcaagaaagggtcgaggtctagttattgcgcctaaagattactctaccaagtaccgttactaagaacttgtagatgttgtacttggttgcaggaacatatactgtactttaatgctagagctgtaagagttgataaaacaatatgcattgaactagaacaatttgatccagttgttgaggctttgatgcatgagttgcacttgccattgatttgcctgtctggacttccagtcttctaataatcatgatattagactttgag

SEQ ID NO: 3667 - DNA, 731 bp, Solanum lycopersicum
aatatgaatatattttggtgaataagtgggtggtttggggaagggcgaaaaatgaattaggtttttgaaattaataagtgagaaaacccttggtttggtgagcttaactcagaaagatgtcgtacttgttacctcaccttcactcaggatgggccgtcgatcaagccattctcgctgaagaggaacgccttgtcatcatccgcttcggccatgactgggatgaaacttgtatgcagatggatgaggtgctagcttcagttgcagatacattaaagaattttgctgtgatatacctggtggacataacagaggtccctgattttaacacgatgtatgaattgtacgatccatcaactatcatgttcttcttcaggaacaagcacatcatgattgatcttggcacaggaaacaacaacaagatcaactgggcactcaaagataaacaggagttcattgatattgttgagacagtgtaccgtggtgcacgaaagggtcgtggtctagttattgcaccaaaagattactctaccaagtatcgttactgagtgtgttgatattgtattttgtttgtggaatatgctgcacttttatgactgaactgtaacatacagttgctgagtggtttccattagactgattcagttgctgtcaggaaccaagtgtacaataactttccattgttgcaagtggaaagactaaactcttgttgaaaccatgttatgatctttcta

SEQ ID NO: 3668 - DNA, 656 bp, Citrullus lanatus
ctacattctcaaagagaaaagaaaagaaaagaaaagaaaagaaaagaagaaggagagagaatcggagaaattagggattggagatgtcgtaccttctaccgcatttgcactcaggatgggcagtggatcaagcgattctcgctgaagaagaacgcgtcgtcatcatccgcttcggccatgattgggacgacacttgtatgcagatggatgaagtgttggcctcagttgcagagacgataaagaactttgcagtaatctaccttgtggatatcacagaggttcctgatttcaacacaatgtatgaattgtatgatccttccactgtcatgttcttctttaggaacaagcacataatgattgatcttggtactggaaacaacaataagataaattgggcactcaaggataaacaagagttcattgatattattgaaacggtttatcgtggagcaaggaaaggacgcggtctggtcattgcacctaaggattattcaaccaaatatcgctactaagacattttgctgcttgtgcaagctcttatcgattttaaatttaagaaattgcatctcgaaaatctgtactatatgacgttttctttatttgaatggcatatacctcttcatgacacacgttctcctattcttggactatgtatt

SEQ ID NO: 3669 - DNA, 938 bp, Triticum aestivum
attgggccatgggaccgcgggcgcggcatacccaaatcgcagtttccggaagtttccatggtgttctaggctgttaggtcgaaactctccccctctttccgtctcccagaaagttcgatcgaatctcaccgtgttgcgttccacgcacattccccctctgctgtctgctcgctacccgttctgaggttcgaaatccccaaatcttctcgcggatcagcgggggccgtcggcgacgagcgcgaggcggacatgtcctacctgctgccacatctgcactcgggatgggcggtggaccaagccatcctcgccgaggaggagcggctggtcatcatccgcttcggccacgattgggacgagacatgcatgcagatggatgaggtgctatcaggtgtggctgagaccataaagaactttgcagtgatctaccttgttgacatcaccgaggttcctgatttcaacaccatgtacgagttgtatgacccgtcgacggtgatgttcttcttccggaacaagcacatcatgattgatcttgggacaggaaacaacaacaagatcaactgggccatgaaagacaagcaagagttcgtcgacattgtggagactgtgtacaggggagcccggaagggccgtggtctggtgattgctccaaaggattactccaccaagtaccgttactaagccatttgtgtctggctgctcatgtgctatttctagcgtattctgtctggtaaaatgtctgatcaccggttaggcaggtgacccttaatgcaaactgtgaagtatgccagcttatccagtcttgtatcttggcatctcataagcatctgtaaaatccttgatgattgttcgaaatgctcgacacagaatatgttggcatgggtatgaccaataaaactagtactcctttattttgtgttgctgaatcctattttgtgttt

SEQ ID NO: 3670 - DNA, 1218 bp, Amorphophallus konjac
ccgccgccgttctcaccctcccaagcccactgcaacgccgcaatagggagaccccgccgccaccgcgtcgctcgccaccccagccgcgccgccgccgccgccgttgctcgccgaccgcacgccacaacgcgactgtccatcgacgacgccgtcgcccgtctccgtctcctcctcgcttcgcgtgcgaagccccaccttcttcttcctcttcacacccccatcgaacccccattcctccttcctcattcacagaccgcatctggttcttttttccgtctacaaaattattctagaattggttcttttttccgtcgcaagcatctggttcggggctttcggcctctgtttatcgaccccgtcgcgcatctccaacccgaactccacaagcgcccgtagagagagggggagtggggaggaggtagagcaaaagggagcggaagcagcagggagcggcgagcgaccatgtcgtacctgttaccgcacctgcactcggggtgggcggtggaccaggcgatcctcgccgaggaggagcgcctcgtcgtcatccgcttcgggcacgactgggacgagacctgtatgcagatggatgaagttttagcctctgtcgcagaaacgataaagaacttcgctgtgatataccttgttgacatcactgaagtccctgacttcaatacgatgtatgagctgtatgatccgtccactgtgatgttttctttcgcaacaagcatatcatgattgatcttggcacggggaacaacaataagatcaactgggctctgaaagataaacaggagttcactgacatagttgagactgtctacagaggtgccaggaaaggccgtggtctggtcattgctcccaaggattattccaccaagtaccgctactgagaatattggtgctcagatgttcctgaagatcagtggcagcaggaaatatgtattctccattgaaccttttttgattgagaaacattctgaagcatgatcttgtttgtcataagcaatacattgtctcttaactctgatgaagttggcgtctcttttatcgtcgtgtgaccgctcacatcttaacagtgagcagtggagggtattattattgtagattgtattctaggatgtgagcgcgccattcctggaagtgtttggtatgtcacatgttgtgtccggacaaaaagaaaatattctagcgaaaagataaggagaatattttgaaggg

SEQ ID NO: 3671 - DNA, 627 bp, Flaveria ramosissima
agtcgcagattctcgaaggagcgagagagatgtcgtacctgctaccgcatttgcactccggtggggccgtggatcaggcggattctggcggaagaggagcgtctggtggtcatccgattcggtcatgatttgggacgaaacttgcatgcagatggatgaagtgcttgcttcagttgcagagacaataaaaaactttgctgtaatatacttggtggacatcacagaagtgcccgactttaatacaatgtatgaactgtacgacccgtcaactgtaatgttctttttcaggaacaaacatatcatgattgatcttggtactggtaataacaataagatcaactgggccatgaaggataaacaagagttcatagacatcgttgaaaccgtctaccgtggggcccggaagggccgtggtttggtcattgctcccaaagattactccaccaagtaccgttactaaactcatttgtgtcagagtttggtggatctgaactgtgttttgaaagatttaaaccggttgtggcttttaaattgttattgattgtggtctattgaaacctgtgtttttaaggttcaacaactttgcttaatcatcttgtgtatccagttacttgatttgatgcaata

SEQ ID NO: 3672 - DNA, 545 bp, Flaveria ramosissima
ggtagagagagatgtcgtacctgctaccgcacttgcactccggttgggcggtggatcaggcgattctggcggaagaggagcgtctcgtcgtcatccgattcggtcatgattgggacgaaacttgtatgcagatggatgaagtgcttgcttcagttgcagagacaataaaaaactttgctgtaatatacctggtggacatcacagaagtgcccgactttaatacaatgtatgaactgtacgacccgtcaactgtaatgttctttttaggaacaaacatatcatgattgatcttggtactggtaataacaataagatcaactgggccatgaaggacaaacaagagttcatagacattgttgaaaccgtttaccgtggggcccggaagggccgtggtttggttattgctcccaaagattactccaccaagtatcgttactaaactcattcgtgtcggagtttgttggatctgaactgtatttcgaaagatttgaaccggttgtggtttttaaattgttataaaactagtgtaattgtggtctattgaa

SEQ ID NO: 3673 - DNA, 554 bp, Abies balsamea
ggagatagagcgaggcaaaaatgtcatatttactacctcatttgcactcagggtgggcagtagatcaggccattctagccgaagaggagcgcctcgttgtcattcgctttggccatgactgggacgaaacatgtatgcagatggatgaagtgctgtcgtccgttgccgaaaccatcaagaatttcgcagtaatatacctggtggacataaccgaggtgcctgatttcaacaccatgtacgagttatatgacccatctactgtcatgtttttcttccgaaataagcatataatgatagacctggggactgggaacaacaataagatcaactgggctatgaaggacaagcaggagttcattgacattatagagactgtgtacagaggggccagaaagggcaggggtttggtcattgcccccaaggattattccaccaagtaccgatactaggtagataacagtaattgtattctatttcatatattgaaccggcttttctttcatattatggatgaaaggatgcattaaactttgccttagacaaagcgggtaggg

SEQ ID NO: 3674 - DNA, 775 bp, Ambrosia trifida
cccaaacaacatctattctatattcgagttttgaccataaagttgcttgttaacgacgcaacgcctgattgattgattgttgaataatataatataatattaataatcacacacagtttctggagaggagagagatcatcatcatcatcagaagaagaagagatgtcgtacttgctaccgcacttgcactccggctgggccgtggatcaggccatcctggccgaagaggagcgtctcgtcgtcatccgtttcggccatgattgggacgaaacttgtatgcagatggatgaagtacttgcttcagttgcagataccttaaaaaactttgctgtaatctacttggtggacatcacagaagtaccagacttcaatacaatgtatgaactttatgacccgtcaactgtaatgttctttttcaggaacaaacatatcatgattgatcttggtactggtaacaacaacaagatcaactgggccatgaaggacaaacaagagttcatagacattgttgaaactgtctaccgtggtgcccggaagggccgtggtttggtcattgctcccaaagattattccaccaagtaccgctactaaactcattcgggtcagagtttctgtgtatttgaactgtgtatcggaagacttaaacttgttctgacttttgatttgttataacattggtgtaattgtggtcttttgaaactgaaagtatgttatgtgattcaacgacttttgatttaaaaaagaaaaatagagcacaaaacctgtttcagctttg

SEQ ID NO: 3675 - DNA, 688 bp, Antirrhinum majus
gcgaaacgatgtcgtatttgttgccgcaccttcactccggatgggccgtcgatcaggcgattcttgccgaggaggagcgcctcgtcatcatccgcttcggtcacgattgggacgagacttgcatgcagatggatgaggtgctggcttcagttgctgatacactaaagaactttgctgtcatatacctagtggacatcacagaggtgcctgatttcaacacaatgtacgagttgtacgacccttccaccatcatgttcttcttcaggaacaagcacatcatgatcgatcttggaactggaaacaacaacaagatcaactgggccatgaaggataagcaagagtttatcgacattgtcgagactgtgtatcgtggtgctaggaagggccgtggtctagttattgctccaaaagattactccaccaagtatcgttactgagtcttttatatggtctgggtgtgtgggatttgcacttcttgcacgtgtagctttatatggccataatttgtaagcaatcccatctagatctaaacttggcaactcaactgtctactccaagtgctttcaagtatgatgctaaataactgtgtgaacagagccctatctttataagtcaagaacttattctctttgtaatatgtgacgttggacctttgccctatgtttcctctttcttcgaatgtttcgtg

SEQ ID NO: 3676 - DNA, 726 bp, Brassica juncea
aggagatcgaaatcctcgagaaagcgctagagagagagagaagaaacgatgtcgtatcttctaccgcatcttcactccggctgggctgtcgatcaggcgattctagccgaggaagagcgtctcgtcgtcatacgtttcggccatgattgggatgagacttgtatgcagatggatgaggtgctagcatctgttgcggagacgataaagaactttgcggtgatatatctggtggacatcaccgaggttccagacttcaacaccatgtacgagctttacgacccttcgacggtcatgttcttctttaggaacaagcacatcatgatcgatcttgggactggtaacaacaacaagatcaattgggctatgaaggacaagcaggagttcattgatatcattgagaccgtcttccgtggtgcgaggaaaggtcgtgggctggtcattgctcctaaagattactccaccaaataccgctactaagtggacttgccagagaacattggatcaaaactcttacctatgtcgagtgattctggtcatttgaaataatatcctgtgaagttgtagcttatatgctttgatgatttgtgattccggattgcttgctttatatctcggctgtttgccatttgtgtaagtgcttcagacttaatctagtgaaatgaaaacttagaagccaatattgagtttatgtatggttcttgatctttttgtcttatgctgcagggg

SEQ ID NO: 3677 - DNA, 667 bp, Brassica juncea
agatcggaattttcgagaaagcgcgagagggagagagagagacgaaacgatgtcgtatcttctaccgcatctgcactccggctgggctgtagatcaggcgattctagccgaggaagagcgtctcgtcgtcatacgtttcggccatgattgggatgagacttgtatgcagatggatgaggtgcttgcgtctgttgctgagacgataaagaactttgcggtgatatatctggtggacatcaccgaggttccagacttcaacaccatgtacgagctttacgatccttccacggtcatgttcttctttaggaacaagcacattatgatcgatcttggaactggaaacaacaacaagatcaattgggctatgaaggacaaacaggagttcattgatatcattgaaaccgtcttccgcggtgcaaggaaaggtcgtgggctggtcattgctcctaaagattactccaccaaataccgctactaaccggacaaaaagtcttttatgtcgagtgattctggtgaattgaaatatcctatgaacttgttgcgtatatgctttgatgatttgtgattccggatttgcttgcttgcttgctctctatccgctgtttgccatttatgtgtgtgtgtaagtgcttcaaacttattctagtgaaatgaatacttagaagac

SEQ ID NO: 3678 - DNA, 682 bp, Brassica oleracea
ttgggggatcggaattttcgagaaagcgcgagagggagagagagatacgaagcgatgtcgtatcttctaccgcatcttcactccggctgggctgttgatcaggcgattctagcagaggaagagcgtctcgtcgtcatacgtttcggccatgattgggatgagacttgtatgcagatggatgaggtgcttgcatctgttgctgagacgataaagaactttgcggtgatatatctggtggacatcactgaggttccagacttcaacaccatgtacgagctctacgatccttcgacggtgatgttcttctttaggaacaagcacattatgatcgatcttgggactggaaacaacaacaagatcaattgggctatgaaggacaagcaggagttcatcgatatcattgaaaccgtcttccgtggtgcgaggaaaggtcgtgggctggtgattgctcctaaagattactccaccaaataccgctactaaccggacttggcaaaaacattaagatcaaaaaaactatgtctactgattctagtcagttgaaaaatatcctgtgaacttgtggcttatatgctttggtgatttgtgattctggtttgtttgctctttatcggctttttttgccatttatgtgtaagtgcttcaaactttaattcagtgaaatgaatacttagaagctaag

SEQ ID NO: 3679 - DNA, 850 bp, Brassica rapa
cgggtcgggttttgatggtcggtcatcgtcgatagtggggaatcgaatataagaagagagctaaagagagaaactgaaacagatcggaattttcgagaaagcgcgagagggagagagacgaaacgatgtcgtatcttctaccgcatcttcactccggctgggctgtagatcaggcgattctagccgaggaagagcgtctcgtcgtcatacgtttcggccacgattgggatgagacttgtatgcagatggatgaggtgcttgcgtctgttgctgagacgataaagaactttgcggtgatatatctggtggacatcaccgaggttccagacttcaacaccatgtacgagctctacgatccttccacggtgatgttcttctttaggaacaagcacattatgatcgatcttgggactggtaacaacaacaagatcaattgggctatgaaggacaagcaggagtttatcgatatcattgaaaccgtcttccgtggtgcaaggaaaggtcgtgggctggtgattgctcctaaagattactctactaaataccgctactaaccggacttgccaaaaaaacatttgatcgaaaactctttatgttgagttggaagatgttctatgaacttgttgttggcttatattgctttgggtgatttgtgattctgctgtttattggctttttgccatttatgtgtaagtgcttcaaactttaattcagtgaaatgaatacttagaagctaatattgggtttatgtagaactataactacaagattcttgatcttcttgtcttaagcaggggtttgaatatttctattcatattgttcagtcagaccaaaggtgaatcttcaagt

SEQ ID NO: 3680 - DNA, 801 bp, Hordeum vulgare
gcgcaccggtcgtccgcggtccgctcacacatatctcctcttcctcgcgatccagcaggactcgggcggcgccggcggcgacggatctcggcgagatcggagatgtcttacctgctcccgcaccttcactcgggctgggcggtggaccaggccatcctcgccgaggaggagcggctggtcatgatccgcttcggccacgactgggacgagacgtgcatgcagatggacgaggtgctgtcaggggtggctgagacaataaagaactttgcggtgatctaccttgtcgacatcaccgaggtccccgacttcaacaccatgtacgagctgtacgacccgtcgacggtcatgttcttcttccgcaacaagcacatcatgattgatctcgggacaggaaacaacaacaagatcaactgggcaatgaaagacaagcaagagtttgttgacatcgtggagactgtctacaggggagctcgtaagggccgtggtctggtgattgctcccaaggattactccaccaaataccgttactgaggtatctgtgcctggctatatggcctactgtgaaatgcctgttctcataaacctataactcaggctgtgaccctttatgtaatgtttctcaactttgaaagtgccgtgcaacttgtatttgtatcttgaatatcgacgtgtcataaacctgtaaccctttgaaacatgacctactgtctattggtatgactgggaaaacagacctttggtttgaactatgtgtgtgaattgctgaacttgaattgtcatgttggtggaatgttactgcta

SEQ ID NO: 3681 - DNA, 811 bp, Fagus grandifolia
tggaccttggctgtcactcagttgaaagctatccaaacaaattgcgcacttcttcttcttcaccgtcacagcctggtttgagctccaagtccgatccgccataatcgagacgggatgtcgtacctattaccacatctgcactcaggatgggccgttgaccaagccatccttgccgaggaagaacgactcgtcgtcatccgcttcggccacgactgggatgagacctgcatgcagatggatgaagtgctggcatctgttgctgagacaattaagaactttgctgtgctatatcttgtggacatcacggaggtgcctgatttcaacactatgtatgaactctatgacccatccacagtcatgttctttttcagaaataagcacattatgattgaccttggcactggaaataacaacaagataaactgggctctcaaggacaagcaggagttcatagacgttgtggagacagtcttccgtggggccaggaagggtcgtggtctggtgattgctcctaaggactattcaaccaagtaccgatactaagtccttgtgcaagctttagttgatttgaagcttgtaagattgtatcttgaaaacctggtgcattatattacattctctagaagttgtagttgatttgaaacatttaatattagatcttgaaatccttttgcttgaaacttgaattctctagaaatcaatgtttgggagatgtcctatccttgattatgaggagtttcacatcaggtgctttctgtacttgatatgactcttgtacatgtacaaggtattgctctttgcattaaataat

SEQ ID NO: 3682 - DNA, 635 bp, Bupleurum chinense
tcgtatttgcttcctcaccttcactcaggatgggcggtggatcaggctattctcgccgaagaagaacgtctcgtcgtcattcgatttggtcatgattgggacgaaacttgtatgcagatggatgaagtactagcttccgttgctgagactataaagaactttgctgtgatatatctggtggatattactgaagtgcccgacttcaatacaatgtatgaactgtatgatccttccaccgtcatgttctttttcagaaacaagcacatcatgatcgatcttggcactgggaacaacaacaagattaactgggcaatgaaggacaaacaggaatttattgacatcattgaaacagtctatcgtggggcaaggaaaggtcgtgggttggtcattgcacccaaagattactccaccaaataccgttattaagtcaagctgttctggcgagttggtattgatcatgaacttgatgaatacgttaaataattgttgcatcagacttggcttctaagttgtcttttagactctctgtgtgtgttctggacatggattagatccaaatgtaaatgtgaagacgctctgattgttgaattgcgctgtctgtacaaggcaccaagtgacattgtgtatcagtaaaa

SEQ ID NO: 3683 - DNA, 1423 bp, Brassica napus
gatcggaattttcgagaaagcgcgagagagagagagacgaaacgatgtcgtatcttctaccgcatcttcactccggctgggctgtcgatcaggcgattctagccgaggaagagcgtctcgtcgtcatacgtttcggccatgattgggatgagacttgtatgcagatggatgaggtgcttgcatctgttgctgagacgataaagaactttgcggtgatatatctggtggacatcaccgaggttccagacttcaacaccatgtacgagctctacgatccttcgacggtgatgttcttctttaggaacaagcacattatgatcgatcttgggactggtaacaacaacaagatcaattgggctatgaaggacaagcaggagtttatcgatatcattgagaccgtcttccgtggtgcaaggaaaggtcgtgggctggtgattgctcctaaagattactctaccaaataccgctactaaccggacttggcaaaaaaacatttgatcagaaactctttatgtttgagttggaagatgtcctatgaacttgttgttggcttatattgctttgggtgatttgtgattctgctgtttattggctttttgccatttatgtgtaagtgcttcaaactttaattcagtgaaatgaatacttagaagctaaaaaaaaaaaaaaaaaaaactcgagactagttctctctctctgaagtctttggtttgtctctcgctcatcctcctccctctcatcgccgtcgtggaaggcaatctcggcgggtggaagaagatcgacaacttatcggatccgaacgtggtttcgctcgcgaagtatgcggttgatgagcataacaagcaatcgaaagcgaatctggtgttcgtgaagatagtcgaggggaaggagcaagtgatcagcgggaaaaagtacgatctgaagattgcggcgaaggatggtggtggtgtgacgaagaactacgaggccgtggtggtggaaagggtgtgggctcattacagaagccttgagtctttcaaggcagtgtagatctgatttggaatcttgatctgatatctatctaggtttctatgattttgagattttgacattatatgttgttgtttttgtaataaaaagtcttcttgagattcaataaaaagatgtatgttacgaaaactgtaaatttacaaaaaaaaaaagatgtgttaccacttggagctctgattcttggtttgggggtgattcatcgacgaggatgtgctggtgttgcagacggcacgtgcgttgctcgtggcttttgagcttatcttctttatatcgctacatacaagagaccggcacgtgcgtgtttatgaggaatgggagggtaactttcacgttctaaaacaattaagtgacagctttcctgagaatggaagtcgtttagtatttttatacgcac

SEQ ID NO: 3684 - DNA, 794 bp, Centaurea maculosa
ggatgtcgtatttgctaccgcatttgcactcagggtgggccgtcgatcaagccatcctcgccgaggaggaacgtctcgttgtcatccgctttggccacgattgggatgaaacttgtatgcagatggacgaagtacttgcttcagttgccgagacattaaagaactttgcagtgatatacctggtcgatatcaccgaagtgccggacttcaacacgatgtacgagctttacgacccgtcgactataatgttcttctttaggaacaaacacatcatgatcgatcttggtacgggtaacaacaacaagatcaactgggcgatgaaggataaacaggagttcatagacatcgttgagaccgtttaccgtggggcccgcaagggtcgtggtttggtcattgcgcctaaagactattcgaccaagtaccgttactaaatcccgaaaccatttcgtattattgaaagcgacaaaaaaccgcttaaaaatctatgttgtgttcattgaatagggttcacttttgtttgtaccttatgaatatgtttgtggtttatgttgaatgctaccattgtgtgatgttattatgtattcagtactaatgttgtgttgttaaggggtcgtttaccaacttttaaaaaagaaaactcctataataactatttaaacaacaaaaataaaaattgaacatgattcggcctagtcggaacccatgcccaatattcacggacgagagtccgaaaccagacttgagttatggatcgggtttttatgcaccttaatcccgctttcgattaggctaca

SEQ ID NO: 3685 - DNA, 599 bp, Cirsium arvense
acgcgggggttgcgcgaaagggggaaagaaagaaacgatgtcgtatttgctaccgcacttgcactccggctgggccgtggatcaagccatcctcgccgaggaggaacgtctcgtcgtcatccgattcggccacgattgggatgaaacttgtatgcagatggatgaagtacttgcctcagttgccgagacgttaaagaactttgcggtgatatacttggtcgatatcacggaagtgccggacttcaacacgatgtacgagctttacgacccatcgaccataatgttcttctttaggaacaaacacatcatgatcgatcttggtacgggtaacaacaataagatcaactgggcaatgaaggataagcaggagttcatagacatcgttgagaccgtgtaccgtggggcccgcaagggtcgtggtttggtcattgcgcctaaagactattcgaccaagtatcgttactaaatcccaaaaccatgtcgtattattgaagccgataaaaaaacgcttaaaatctatgttgtgttcattgaatagggttcacttttgtaccttatgaatatgtttgtggtttatgttgaatgctaccattgtgtga

SEQ ID NO: 3686 - DNA, 691 bp, Cirsium arvense
gtaacgcggggaaaattaaataggtcacgactgctttcttataaaccaaaaagcgatttgttgagcgaaaagggggaagaagaacgatgtcgtacttgctaccgcacttgcactcaggttgggccgtcgatcaagccatccttgcagaggaggaacgtctcgttgtcatccgattcggccatgattgggatgaaacttgtatgcagatggatgaagtacttgcttccgttgctgagacgttaaagaactttgcggtcatatatttggtcgatatcaccgaagtgccggacttcaacacgatgtacgagctttacgacccatcaacaataatgtttttcttcaggaacaaacacatcatgattgatcttggtacgggtaacaacaataagatcaattgggcaatgaaggataaacaggaattcatagatatcgttgagaccgtttaccgtggggcccgcaagggtcgtggtttggtcattgcacctaaagattattccaccaagtaccgttactaaaaccctgaaatatgtcgtaaaattgaaaccgataaaactggttttgtggattcattgaatagggttcacttgtgtatcttttgaatatgttgcttgtggttttattttatgttgaaggctactgctactgctactgtgtgtattgggctgctgttaatgttatgttttaaatagtt

SEQ ID NO: 3687 - DNA, 592 bp, Cirsium arvense
gggggaagaaaggaaacgatgtcgtatttgctaccgcacttgcactccggctgggccgtcgatcaagccatcctcgccgaggaggagcgtctcgttgtcatccgattcggccacgattgggatgaaacttgtatgcagatggacgaagtacttgcctctgttgccgagacgttaaagaactttgcggtgatatacttggtcgatatcaccgaagtgccggacttcaacacgatgtatgagctttacgacccgtcgactataatgttcttctttaggaacaaacacatcatgatcgatcttggtacgggtaacaacaacaagatcaactgggcgatgaaggataaacaggaattcatagacatcgttgagaccgtttaccgtggggcccgcaagggtcgtggtttggtcattgcgcctaaagactattcgaccaagtaccgttactagaaccctgaaccgtgtcgaattattgaaaccgataaaaaaccttttggaatcaatggtcttgttatgtgttcattggatagggttcacttttgtaccttatgaatatgcttgtgttttatgttgaatgctaccattgtgtgaaaaa

SEQ ID NO: 3688 - DNA, 767 bp, Coffea canephora
cggccgggggactcttcacgtgtgacagccaccatatcccaattccaacgccccgccagctgaagctccaggtttaaggccgccgccgccaccgccgcagcagagaagaaaagagatgtcataccttctgcctcaccttcattccggctgggctgttgaccaggctatccttgctgaagaggaacgacttgttctcatcaggttcggacatgattgggatgagacctgtatgcagatggatgaagtgttagcatcagttgctgagacaataaagaactttgctgtgttatacttggttgatataactgaggtgcctgattttaatacaatgtatgagttgtatgatccatccacaattatgttcttctttaggaacaagcacatcatgattgatcttggtactggaaacaacaacaagatcaactgggcaatgaaggacaaacaggaattcattgacattgtcgaaactgtgtatcgtggtgcaagaaaaggtcgtggtctagtcattgcacccaaagattactctaccaagtatcgatattgattacttgtttgtcatgcatttggacaaatactgatagcacacctaatattacgcatgtataactaatatcttgttgccgacttcatatttttctgattgcacacagttacacctgattgtagactgtaaaactaatatcaggtggctgaagatttctttctgagactgtattttagtccttggattcaataatcaggtgtgttcttagcatgtatcttttagc

SEQ ID NO: 3689 - DNA, 724 bp, Cucurbita pepo
agagcgagagagaagagagagagcgaaagagagagagatgtcgtacttgctgccgcatcttcactctggatgggccgtcgatcaggcaatcctcaccgaagaagaacgccttgtggtcattcgtttcggtcatgactgggacgagacctgtatgcagatggatgaggtgttggcctcagttgctgagacgatcaagaacttcgcagtaatataccttgtggatatcactgaggttcctgatttcaacacaatgtacgagctgtatgatccttccactgtcatgttcttctttaggaacaagcacataatgattgatcttggtactggtaacaacaataagataaactgggcactcaaggataagcaagagttcatcaatatcattgaaacagtctatcgtggagcaaggaaaggacgtggtttagtcattgcacctaaggactattcaaccaaatatcgctactaagacgttctgctgcttctgcaagttcttattgatcttaaattttagagatcgcgtctcgaaaatgtgtactctatgacattattcgctcgtgaaaaggatatggtttattttggatgtcattgtgtgccatgacttctcaaaacatttgatcactgttggacctctgatgagggaatataactgtttatggtaacaagtctttaatcaggtatgttttggttgaataagttgttttccgatctattgatgatgtttgat

SEQ ID NO: 3690 - DNA, 562 bp, Distylium racemosum
catctggacatcttgctctactcctccgtctctgatcgaggcattctgagatctcatattgagaaggagagagaatgtcgtatttattaccgcatctgcattcagggtgggcagtggatcaggccatcttagctgaggaagagcgcctcgtcgtcattcgtttcggccatgactgggacgatacttgtatgcagatggacgaagtgctttcgtccgtggcggaaactattaagaactttgcggtgatttatctggtggacataacggaggttcccgacttcaacaccatgtacgaattgtatgacccatcaacggtgatgtttttcttccggaacaagcatataatgattgacctgggcaccggtaacaacaataagatcaattgggcactcaaagacaagcaggagttcatcgatatcatcgagaccgtctacagaggtgctaggaagggtaggggtctcgtaattgcacccaaggactattccaccaagtaccgatactgattctcatacagataccgaccatgcatagcattttctctggacaaaaaccccatgtgtgg

SEQ ID NO: 3691 - DNA, 714 bp, Festuca arundinacea
ggcacaggcacccaccgccactcgactccacaaatttcctcacgaatcaggcgcagagggaggggagaagcagcgggcagccggcggcgaggcgaggcggagaagatgtcgtacctgctgccgcacctgcactccggctgggcggtcgaccaggccatcctcgccgaggaggagcgcctcgtcatgatccgcttcggccacgactgggacgagacctgcatgcagatggatgaggtgctgtctggggttgctgagaccataaagaactttgcggtaatctacctcgttgacatcacagaggttcctgacttcaacaccatgtacgagctgtatgatccatcaacggtgatgttcttcttccgcaacaagcacataatgattgatctcgggacgggaaacaacaacaagatcaactgggcaatgaaagacaagcaggagtttgtcgacattgtggagactgtctacagaggagctcgtaagggccgtggtctggtgattgcgcccaaggactactccaccaaatatcgttactaaggtgttttgcgcctggcagcccatgtgtaatttctggcctagtagattcagtataatgccaggctgccagtactcaggcatgtgccccttgatgtgatgtctgtcaatctcaaaaagtgttgcgtaactacatgtctgtatcttgaatattgatatgtcataaacctgtaatccttgtaa

SEQ ID NO: 3692 - DNA, 724 bp, Linum usitatissimum
agtattcgaaggataggagctgagctgactggggattagagaaattaggggttgaatccagagatcgaaatcgaagcagcaaacaagagaggggcgagatgtcgtacttgctgccgcacttacactcgggatgggctgtcgatcagtccatccttgccgaagaagagcgtcttgtggtcatccgattcggccacgattgggatgaaacctgtatgcagatggatgaagtgctggcaggagttgctgatacactaaagaactttgcagtgatctacttggtggatatcacagaggtgcctgatttcaacacaatgtacgagctgtacgatccatcgactgtcatgttcttcttcaggaacaagcatatcatgattgatctaggaactggaaacaacaacaagatcaactgggctctcaaggacaaacaggagtttatcgacattgtcgagacagtttaccgcggtgctaggaagggacgtggtctggttatcgctcctaaagactactcaaccaagtaccggtactaggtgcgctgtggtttgttattctggaccaggactcttaaatatgtaaactaaatgaaagaatgttgccctggaacaactcttcctctatgctgttataatacagccatatgttccggctgctgatgtattgcgacatctaaacatttgaacagagatggaactttgtaatgactaatgatgttgtgcctttatgcttc

SEQ ID NO: 3693 - DNA, 923 bp, Linum usitatissimum
agtattcgaaggataggagctgagctgactagggattagagaaattaggggttgaatccagagatcgaaatcgaagcagcaaacaagagagcggcgggatgtcgtacttgctgccgcacttacactcgggatgggccgtcgatcagtccatccttgccgaggaagagcgtctcgtggtcatccgattcggccacgattgggatgaaacctgtatgcagatggatgaagtgttggcgggagttgctgatacactgaagaactttgcggtgatctacttggtggatatcacagaggtgcctgatttcaacacaatgtacgagctgtacgatccatcgactgtcatgttcttcttcaggaacaagcatatcatgatcgatctgggaactggaaacaacaacaagatcaactgggctctcaaggacaagcaggagttcatcgacattgtcgagacagtttaccgcggggctaggaaggggcgtggtctggttatcgctcctaaagactactcgaccaagtaccggtactaggcgcgctgtggattgttattccagaagtccaggacacttaaatatcttaactaaatgaaagaatgcatcctggaaatcctctatgctgttttaatacagccatatgttccggctgctgatgtattgatggaactttgtaatgactaatgatgttgtgcctttatgcctttgttggtgttcaactgagttattatatacaagcgttatgcatctgaagttgaatatctgctcgagaaattcggaccttttccgtagcagatccagtaaatgccagaggccgcggctagtttcagcttggaaaagagtgtgatgtctttttcgtatgcaaattttgtaatccctttgtaaaatgtatcactttgaatttgatgttcaaattggagcatttcggagatc

SEQ ID NO: 3694 - DNA, 626 bp, Fraxinus spp
aacgatgtcgtatatgctaccacacctccattcgggatgggcagtggatcaagctatccttgctgaggaggaacgcctcgtcatcatccgattcggccacgactgggacgaaacctgcatgcagatggacgaggtgctggcatcagttgctgaaacattaaagaacttttctgtgatttacctggtcgatatcaccgaggtacctgattttaacacaatgtatgagttatatgacccttccaccatcatgttcttcttcagaaacaagcacattatgattgatctgggcactggaaacaacaacaagatcaactgggcactgaaggataaacaggagtttatcgacattgtcgagactgtctaccgtggtgcaaggaaaggccgtggtctagttattgctccgaaagattactccaccaaatatcgttactgagtactcgtcttacatttatgtggtatactttatcgcaactctgtctgtgttattaattcggtgaaaactttcacaatttaagttcttatatggagctgaactcttaagctcctatgctagttatatgtttgagagaatcaggctgcaactaaggtccggtttgtggtataatcggatggtacttttgtaattt

SEQ ID NO: 3695 - DNA, 791 bp, Zingiber officinale
  misc_feature (93)..(94): n is a, c, g, or t
  misc_feature (96)..(96): n is a, c, g, or t
  misc_feature (759)..(759): n is a, c, g, or t
tcctgactattttttgctgagctgaaggaacttcttccagtggaatttgagcacccatgcctcgtgccgaattcggcacgaggatctcacganncnaaactcggcgttcgagtgaggaggaaggagaaagagatcatccttgcggcgtgaggatgtcgtaccttctgccgcatctccactccggttgggcggtggatcaggcgatcctggcggaggaggagcgcctcgtcgtcatccgcttcggacacgactgggacgagacttgtatgcagatggatgaagttttgagttctgttgcagagactattaaaaactttgcggtgatctacttggtcgatatcacggaggtgcctgacttcaacaccatgtatgagctttatgatccttcaaccgtgatgttcttcttcaggaacaaacatatcatgattgatcttggtactggtaacaacaacaagatcaattgggcaatgaaggataagcaagaattcatcgatatcattgagactgtgtatcgaggagcgaggaagggccgcgggctggtgattgctccaaaagactactccaccaagtatcgttactaatggatttgctatgaatcgtagcttttaactattactatacgtttctaagttgtgatgaaaataaaagaacatcgatcctgtatgattcagaagattaggagacttattgtactaaaactgaaattatgattcaagtatttccttttaaacaaagaaattgtgtggatatgttcatctnaaggaagtatgagctcaatctgtaggaactaa

SEQ ID NO: 3696 - DNA, 1058 bp, Gossypium raimondii
ttaaacaacagaataccatctaaagaaacatcatcaattaacactaaaaccaagccttaacaaaatttcatattttcctttgtaaaaaatcggaataaataggtatcaaatattatattaaccctttgtaaaattaaaaaaaaaaaaagtcaacggacaagacgaatctacttaagacaggtgatcgacaaactaaacacgtggcatgattttagcgggcgggagatcgcaaaccaattttacacgcagagtgtagaaggctgaggacctttccagagccttccttcgtcgccatgcccatagcaccattttctatataaataaaaaaaattcagatttccatggttttcagaggacaagccaaagggaagggggaagattaaagcaaaaaagactgataagaaagggagaaaaacgatgtcgtacctgttgccgcacttgcattcggggtgggccgtcgatcaggccatcctcgccgaagaagaacgcgtcgtcatcatccgtttcggccatgattgggacgaaacttgcatgcagatggatgaagtccttgcttcagttgctgaaaaaataaagaactttgccgtaatttacgtcgttgacataaccgaagtgcccgagttcaacacgatgtacgagctttacgatccgtccacggtcatgttcttctttcgaaacaagcacatcatgattgatctcggcaccggaaacaacaacaaaatcaattgggcactcaaggacaagcaagagttcatcgacatcgtcgaaactgtataccgcggagcaagaaagggtcgcggtctcgtgattgctccgaaagattactcgactaagtaccggtactgattatatctcaattttgaaacactttaaatgtgaataatgctacgttgctatgcttgtatgaatgtgaaactacgtagcttttacgagtatttcaaaaaaaatgaagagttaaaataactagttgatcggtattagacattgaaaaggttaaattttactattagtccctacacttgtaaatgttatgcatttaatttttatacttttattta

SEQ ID NO: 3697 - DNA, 704 bp, Lotus japonicus
ctctctgactcgtcggaatcaactgaacaaggttagggtgaagatagatatgtcgtacctgttgcctcacttgcattcaggatgggctgtggatcaggcaattcttgctgaagaggagcgtctcgttgtcatccgcttcggccacgattgggatgagacttgcatgcagatggatgaggtgctggcatcggttgcggagacgataaagaactttgctgtgatataccttgtggacatcacggaggttcctgatttcaacaccatgtatgagctttacgatccctccactgttatgttcttcttcaggaacaagcacatcatgatagaccttggaactggaaacaacaacaagatcaactgggctatgaaggacaagcaggagttcattgacatcattgagaccatctacaggggtgcaaggaagggacgtggtctcgtcattgcccccaaagattactccaccaagtacagatactaagatatctcttccaaaatccttatgtaaaagaaaaattatcctctgaatttttattctgtaacaaaatctactttaatactttatcatcccttatgtctcttgtgcttgagtgtaactgtcactcaaatgtgaacttatctgtcaccttaaactatgactgctatgctctgttctactcatgtgtcatcttggctaggtggactgagagagatagaatgaagggaaa

SEQ ID NO: 3698 - DNA, 761 bp, Medicago truncatula
tcttttcaatctctacgactacaatctgcgtttttcgtttcagcaccatcaatcattaaagtagaggggagataacgaagagcaagaaagatgtcgtacctgttgcctcacttgcattcagggtgggctgtggatcaggctatcctagctgaggaagagcgtcttgttgtcatccgttttggtcatgattgggatgagacctgcatgcagatggatgaggtgctgtcatcggttgcagagacaataaagaactttgctgtgatataccttgtggacatcacagaggtgcctgatttcaacactatgtatgagctgtacgacccttcgacagtcatgttcttctttaggaacaagcacatcatgatagatcttggaactggaaacaacaacaaaatcaattgggctatgaaggacaaacaggagttcattgacatcattgaaactgtctacagaggtgcaaggaagggacgtggtctcgtcattgctcccaaagattactcaaccaagtatcgttactagaatatatatcgatctctattaggatgtgtaatttgaactctgtattttcattctcatccaaaacctacctcatttggttcactcttgatcaagtgtgaaactgtcactcaaatattatcaaccaacgttgtctgtcatcttaatatagacttggcttctctgaaagagaatttacattttatgctatcagaatccattatctggatcgtttaaaatgaataaaaaatggccattccatctaa

SEQ ID NO: 3699 - DNA, 673 bp, Avena sativa
tcgactccacaaatttcctcacgaaccaggcgcggagagaggagaagtagcgggcggccggcgacgaggcgacgcggagaagatgtcgtacctgctgccgcacctgcactccggctgggcggtggaccaggccatcctcgctgaggaggagcgcctcgtcatgatccgcttcggccacgactgggacgagacctgcatgcagatggatgaagtactgtcaggggtggctgagaccataaagaactttgcggtaatctacctcgttgatatcactgaggttcctgacttcaatacgatgtacgagctgtacgacccgtcaacagtgatgttctttttccgcaacaagcacatcatgattgatctcggaacaggaaacaataacaagatcaactgggcgatgaaagacaaacaggagtttgtcgacattgtggagactgtatacagaggagcccgtaagggtcgcggtctggtgattgctcccaaggactactccacgaaatatcgttactgagctacgtgtgtctggctgtcccatgtgtgtaacttctggcctactaggttctgtatgatgacagactgccagcatgtgacccttgatgtgatgtccatcaactttcagagtgttgtgtaactaaatgtctgtatcttgaatattgatatgtcataataaacc

SEQ ID NO: 3700 - DNA, 741 bp, Avena sativa
ggactccacgaatctcctcacgaatcaggcgcagagggaggagaggcagcagcgggcagccggcgacgaggcgaggcggagaagatgtcgtacctgctgccgcacctgcactccggctgggcggtggaccaggccatcctcgccgaggaggagcgcctcgtcatgatccgcttcggccacgactgggacgagacctgtatgcagatggatgaggtgctgtcaggggtggctgagaccataaagaactttgcggtaatctacctggttgacatcaccgaggttcccgacttcaatacaatgtacgagctgtacgacccatcaacggtgatgttcttcttccgcaacaagcacatcatgattgatctcggaacaggaaacaataacaagatcaactgggcgatgaaggacaagcaggagtttgtcgacattgtggagaccgtctacagaggagctcgcaagggtcgcggtctggtgattgctcccaaggattactccaccaaatatcgttactaaggtgttttgtgtctgtctgtacatgtgcagtttctggcctactctgtaagtgaaatgccagtactcaggcatgtaacccttgatgcgatgtatgtcaactttaaaggtggtgcgtaactgaatatctgtatcttggatattgatatgtcataaacctgtattccttgtaaacaggacctgttgtctattggtatggctgatgaatcagattggttatctaaattccat

SEQ ID NO: 3701 - DNA, 783 bp, Allium cepa
taggtttaaatccataaagtatcgtttcccaaatcgttgattcgcagactattgcttccgataaccgcctcgctcatcctcctacacgctatagttccgactttctgtaacgcacaaagggtttaaagtagacagcggtgaaagatgtcgtatctgttgccacacttacattcaggatgggcagttgatcaggcaatcttagcagaagaggaacgtcttgtggtaattagatttggccatgattgggatgaaacttgcatgcagatggatgaagtgctggcttcggttgcagaaacaataaagaactttgcggtgatatacctggtagatatcacagaggtacctgattttaacacaatgtatgaactgtacgatccatcgaccatcatgttctttttccggaacaagcacatcatgattgatttgggcaccggtaataacaataagatcaactgggcaatgaaggacaaacaggagttcattgatattgtcgagactgtttttagaggtgcaaggaaagggcgtggtcttgtcattgctcctaaagattactctactaagtaccgttattaataataatgtaataataataatgtgtgtcatcgtagtccagtatctgtcctaatctgggaataaattcttactttgaattgtgttagaaatgatgaatggtagagcctatgaggaccctttgtgtctgctagattctatcttatcttttatgttaatgctatgtgcttacgtgagttgatgggttatattataaaagtttatatattcgtc

SEQ ID NO: 3702 - DNA, 740 bp, Allium cepa
gtgatcaatcagcacactctagaagaaaccaaacaacttgaaacaggatattaacctaactgaattaaacataaaattatagcttctctgtcattcacccacttccccaagcaacagcaagttttaagctctcacgatctctcaatttctttcagggccttaaagtagagcgagatgtcgtatttgctgccacatttgcactcaggatgggcggttgatcaggcaattttagcagaagaggagcgtctcgttgtcataagatttggccatgattgggatgaaacttgcatgcagatggatgaagtgctggcttcggttgcagaaacaataaagaactttgcagtgatatacctggtagatatcacagaggtaccagattttaacacaatgtatgaactgtacgatccatcaacgatcatgttctttttccgtaacaagcatatcatgatcgatttgggcactgggaacaacaataaaataaactgggccatgaaggacaagcaggagttcattgatattgttgagactgtctttagaggtgcaaggaagggccgtggtcttgttattgctcccaaggattactccaccaagtaccgttattaatctgataatactccgtgctaccatattattttcttgtacctttatcaactatttgctttgtttgggagtaaattcttacactgaattttatcaacaatgttgtttgaatggaactaataaatatcaaacatttacga

SEQ ID NO: 3703 - DNA, 965 bp, Phalaenopsis aphrodite
attggagtgagtttgaggggttattgcggtgattcagtgaagtttattggagttaatgagtagttatttgggcttattgcgttattgcagggcacattaaggactcctgtggacagaaaatttttccgcgaatcggcctgccgggatcgctgcttcccatttttctcgtccgtcgctcctctcctacctgaaacgaagaattgaggaaggctaagaagagaggagggagacttgagaccgagtaatcctcgtcgtcttcttcgccggagtgatgtcttacttgctgccacatctccactcaggttgggcagtcgaccaggcaatcctcgctgaggaggaacgcctcgtcgtcatccgatttggccatgattgggatgaaacttgcatgcagatggatgaagtgctggcctcagttgccgaaactataaaaaactttgcagtgctatacctcgttgatattacagaggttcctgatttcaatacaatgtatgaattgtatgatccatccaccgtcatgttttttttccgcaacaaacacattatgatcgatctcggcaccggtaacaacaacaagatcaactgggcgatgaaggacaagcaagagttcatagatatcgttgaaactgtttttcgaggtgcccgaaaagggcgcggtctcgtcattgctcccaaagattactccacaaagtatcgctattgagttcgccagttctactgtctcgtaactggcatgtagttacctattaagctatcttgacatatgtgatagtatttttctttgtcaactgttgttcaaactcttcggcgatgccgccttgaatcagcatttatatgcttttatcgttattcatgaacgttgtggttttagtggtcttgttatcctcttcatatttgatatttgatgaggaaaaactgaagtacttcctctcactcaatgaagtaagatgtaaaatttacattttttt

SEQ ID NO: 3704 - DNA, 720 bp, Lippia dulcis
tctactcaacactcaacgactctgagagaaaaccgatagcgctaaacgatgtcgtatttgctgcctcaccttcactccggctgggccgtcgatcaggcgatcctggcggaggaggaacgtctcgtcctcatccgcttcggtcacgattgggatgagacctgcatgcagatggatgaggtgctggcttcagttgccgagacactaaagaactttgctgtcatatacctggtggatatcacagaggtccctgatttcaacaccatgtacgagctgtacgacccctccaccatcatgttcttcttcaggaacaagcacatcatgattgatcttgggactggaaacaacaacaagatcaactgggccatgaaagataagcaagagttcattgacattgtcgagactgtctaccgtggcgccaggaaggggcgtggtctagttatcgccccaaaagattactccactaaatatcgttattgagcagtatctatcttctggtatggtttgctaatgaacctgtcgatcaattttatgggaaggggtttgccggctcacgtccatctagttgttgtaagagactgtactatgttactttgcagttgatgtgattagccatgacaaacaaatattgttcctgttattgtttgctgatcgaacttaaattggaattgtctaaatttgctactgatgcattatatatactgtactactatatgtttgtaa

SEQ ID NO: 3705 - DNA, 871 bp, Pinus taeda
acgtgcgaccttggctgtcactcaaaagagggacgcagggcagaggatcgagcgaggcaaaaatgtcgtacttgctaccccatttgcactccgggtgggcagtggatcaggccattctagccgaggaggagcgtctcgtcgtcattcgcttcggccatgactgggacgaaacatgtatgcagatggacgaagtgctttcatctgttgcagaaactatcaagaatttcgcagtgatatacctagtggacataacggaggtgcctgatttcaacaccatgtacgaactgtatgacccgtctactgtcatgtttttctttcgcaataaacatataatgatagatttggggacggggaacaacaataaaatcaactgggctatgaaggacaagcaggaattcattgatatcattgagaccgtgtacagaggggccaggaagggcaggggtctggtcattgcccccaaggattattctaccaagtaccgatactaggtagataacagaaattgtattctatttcatatgctgaactgggttttctttaactttatggatggatggaacaaagcgggtagggtttctttgggaccgaaccccgctgagtcaaaattaacacgtaaacctaagtagatatgttgttatagacacataaattgttgaaatagtttggttatttgtgtttggcctatgaaatgattcattactagaattttatttgatgtatagcatactattgtctattgtaatggtttattatgcttataatccaattatgcattgggtcacggaattctgataaattatagtaagttccataccatgatggatatgtagagggataggccatggtttcttggcagcagaaaatggcg

SEQ ID NO: 3706 - DNA, 851 bp, Pinus taeda
ggccgggcagaagatcgagcgaggcaaaaatgtcgtacttgctaccccatttgcactccggttgggcagtggatcaggccattctagccgaggaggagcgtctcgtcgtcattcgcttcggccatgattgggacgaaacatgtatgcagatggacgaagtgctgtcatctgttgcagaaacaatcaagaatttcgcagtgatatacctggtggacataacggaggtgcctgatttcaacaccatgtacgaactgtatgacccgtctactgtcatgtttttcttccgcaataagcatataatgatagatttggggacggggaacaacaataaaatcaactgggccatgaaagacaagcaggagttcattgatattattgagaccgtgtacagaggggccaggaagggcaggggtctggtcattgcccccaaggattattctaccaagtaccgatactaggtagataacagcaattgtattctatttcatatgctgaactggattttctttaattttatggatggatggaacaaagcgggtcgggtttctttgggactgaaccccgctgagtcaaaatgaacacgtaaagctaagtggatatcctgttatagacacataaattgttgaaatagtcgggttatttgtctttggcctatgaaatgattcattgccagaattttatttaatgtatagcatactattgtttgatgtaatggtttattatgcttataatccaattatgcattgggtcacggaattctgataaattatagtaagttccataccatgatggatatgtagaggaataggccatggtttcttggcagcagaaaatgacttttttgttcttga

SEQ ID NO: 3707 - DNA, 765 bp, Pseudoroegneria spicata
gcacgctgctgattcacctcggcagttccgtgtctcaaaaaagaaaaagaaaaaaacctcggcagttcctcgcgaaaagccggcggcggcgactcgactctcggcgaggggcggggatgtcgtacctgctcccgcacctgcactccggctgggcggtggaccaggccatcctcgccgaggaggagcggctggtcatgatccgcttcggccacgactgggacgagacgtgcatgcagatggacgaggtgctgtcaggggtggctgagaccataaagaactttgcggtgatctacctcgtcgacatcacggaggttcctgacttcaacaccatgtacgagctgtacgacccatcaacggtgatgttcttcttccgcaacaagcacatcatgattgatctcgggacaggaaacaacaacaagatcaactgggcaatgaaggacaagcaagagtttgttgatattgtggagactgtctacagaggagctcgtaagggccgtggtctggtgattgctcccaaggattactccaccaaataccgttactgaggtatctgtgcctggctattcatgtgcagtgtgtggcctgctctgttctgtgaaatgtgctgtgtgacccttgatgtaatgtctgccaactttgaaagtgtcgcgtaactatgtatttgtatcttgaatatcaacatgtcataaacctgtaaccctttgaaacaggacctgctgtctattggtattactgataaaagtgatatttggttaaaaaaaaaaa

SEQ ID NO: 3708 - DNA, 674 bp, Pseudoroegneria spicata
agaaccagccggcggcgacaaatctcggcgagagcgaatatgtcctatctgctcccgcacctgcactccggctgggccgtggatcaggccatcctcgccgaggaggagcgtcttgtgctaatccgcttcggccacgactgggacgaaacttgtatgcagatggatgaggtgctgtcaggggtggctgagaccatcaagaactttgccgtgatctaccttgttgacatcactgaggttcctgacttcaacaccatgtacgagctgtacgacccgtcaacggtgatgttcttcttccgtaacaagcacatcatgattgatcttgggacaggaaacaacaacaagatcaactgggcaatgaaagacaagcaagagtttgttgacatcgtggagactgtctacagaggagctcgtaagggccgtggtctggtgattgctcccaaggattactccaccaaataccggtactgaggtatctgtgcctgtctcttcatgcgcagtattccagtgtgtggccttctctgttctgtgaaatgccagtacttgcgctgtgacccttgatgtaatgtctgtcaacttcaaagtctcgcctaactgagtatctgtattttgaatatcgacacgtcataaacctgctgtctattggtatggctgataaaacagattgtttggtttga

SEQ ID NO: 3709 - DNA, 837 bp, Pseudotsuga menziesii
gaccagctagtgcgcttcaacctgacatataagcaccagcggccagcggtagtaacactagcatcataataataataacagtagcgacaaaaagcaacaagaaagttctgtcatttttcttgtgtgtataatttagatctggcgtgccctaacatctgaaagaaggacatcttaaagaaggagaccgagcgtgctgcgggtagagacggctgggctagtgcccctgcgaggcaaaaatgtcctatttactgccacatttgcactcaggctgggcagtggatcaggccattctagccgaagaggagcgcctcgtcgtcattcgcttcggccatgactgggacgaaacatgtatgcagatggatgaagtgctgtcatccgttgcagaaacaattaagaatttcgcagtaatatacctggtggacataaccgaggtgccagatttcaacaccatgtatgagctatatgacccatctactgtcatgtttttcttccgtaataagcatataatgatagacctggggactgggaacaacaataagatcaactgggctatgaaggacaagcaggagttcattgacattattgagaccgtgtacagaggggccaggaagggcaggggtttggtcattgcccccaaggattattccaccaagtatcgatactaggtagatagcagtaattgtattctatttcatatattgaactgtttttctttaatattatggatggaaggatgcacttaactttggacttagacaaagtgggtaggctttgttcgggcctgaactcctctgaatcaaaattagaacctaaatctgaatggatatgttgttttag

SEQ ID NO: 3710 - DNA, 698 bp, Raphanus sativus
  misc_feature (3)..(3): n is a, c, g, or t
ggngtgagaaatcgaaacgaatcgaaatcgtttctagagagaggaaacgatgtcgtatcttctaccgcacttgcattccggatgggctgttgatcaggcgattctagctgaggaagagcgtctcgtggtcatacgtttcggccatgattgggatgaaacctgtatgcagatggatgaggtgctggcatcagttgctgagacgataaagaactttgcggtgatatatctggtggacataactgaggttccagacttcaacaccatgtacgagctctacgatccttccacggtcatgttcttctttaggaacaaacacattatgatcgatcttggaaccggtaacaacaacaagatcaactgggctatgaaggacaagcaggagtttatcgacatcatcgagaccgtcttccgtggtgcaaggaaaggtcgtgggctcgtgattgctccgaaagattactccaccaaataccgctactaaaccgggtctttccaacacgttggagtatgttaaaaaaaaaaacattggatcaaaactctttccatgtggagtagttcttgaatatcctatgaacttgttgcatatatgctttgatatgatttgtgattcctgcttgcttactcttttcggctgtttggccatttataatgtatgcagttgcttcgaacatgaatcgccgaaatgaatgtgtttatgttta

SEQ ID NO: 3711 - DNA, 702 bp, Raphanus sativus
gggaaacagatcagagttttcgagaaagcgcgagaggggatgtcgtatcttctaccgcatctacactccggttgggccgtcgatcaggcgattctagctgaggaagagcgtctcgtcgtcatacgtttcggccacgattgggatgagacttgtatgcagatggatgaggtgcttgcatcagttgcagagacgataaagaactttgcagtgatatatctggtggacatcactgaggttccggacttcaacaccatgtacgagctctatgatccatccacggtcatgttcttctttaggaacaagcacattatgatcgatcttggaactggtaacaacaacaagatcaattgggctatgaaggacaagcaggagttcatcgatatcattgaaaccgtcttccgcggtgcaaggaaaggtcgtgggctggtgattgctcctaaagattactctacaaaataccgctactaaccaaccggtcttgccaaaaacattggatcgaagactcttatatcgagtgattctgatcatttgaaatatatatcctatgaacttgtgatttgttattccggatttgcttgctctctctatcggctctttgccatttatgtgtgtgtataagtgcttcaaacttcagtgaaatgatattatttagaagccaaatattgtgtttatttagtattaagtacaagggtttttgatcca

SEQ ID NO: 3712 - DNA, 680 bp, Raphanus sativus
gggaaacagatcagagttttcgagaaagcgcgagaggggatgtcgtatcttctaccgcatctacactccggttgggccgtcgatcaggcgattctagctgaggaagagcgtctcgtcgtcatacgtttcggccacgattgggatgagacttgtatgcagatggatgaggtgcttgcatcagttgcagagacgataaagaactttgcagtgatatatctggtggacatcactgaggttccggacttcaacaccatgtacgagctctacgatccatccacggtcatgttcttctttaggaacaagcacattatgatcgatcttggaactggtaacaacaacaagatcaattgggctatgaaggacaagcaggagttcatcgatatcattgaaaccgtcttccgcggtgcaaggaaaggtcgtgggctggtgattgctcctaaagattactctacaaaataccgctactaaccaaccggtcttgccaaaaacattggatcgaaactccttatgtcgagtgattctctgatcatttgaaatatatcctatgaacttgtgatttgttattccggattttgcttgctactctctctatcggctgtttgccattatgtgtgtgtgtaagtgcttcaaacttacttcagtgaaatgattacttagaagccaaatattgtgtttattta

SEQ ID NO: 3713 - DNA, 744 bp, Raphanus sativus
ggatagtgtaaaattgaaacgaatcaaaaatcgtttctagagagagagagacgaaacgatgtcgtatcttctaccgcacttgcattccggctgggctgttgatcaagcgattctagctgaggaagagcgtctcgtggtcatacgtttcggccatgattgggatgaaacctgtatgcagatggatgaggtgctggcgtcagttgctgagacgataaagaactttgcggttatatatctggtggacataactgaggttccagacttcaacaccatgtacgagctctacgatccttcgacggttatgttcttctttaggaacaaacacattatgatcgatcttggaactggtaacaacaacaagatcaactgggctatgaaggacaagcaagagtttatcgatatcatcgagaccgtcttccgtggtgcaaggaaaggtcgtgggctcgtgattgctccaaaagattactccaccaaataccgctactaatcggtctttccaacacgttgcccgttggagtatgttaaaaaaaacattggatcaaaactctttccatgttagagttgttctggtcaaggtgaaatatcctatgaacttgttgcaggtatgctttgatatgatttgtgatgcttactcttttcggctgtttggccatttataatgtatgcagttgcttcaaacatgaatagccgaaatgaatgtgtttatgtttaacgtgtatagtataaggttcttgatcttcctac

SEQ ID NO: 3714 - DNA, 697 bp, Raphanus sativus
  misc_feature (661)..(661): n is a, c, g, or t
ggagtgaaaatcgaaacgaatcgaaatcgtttctagagggagaggaaactatgtcgtatcttctaccgcacttgcattccggctgggctgttgatcaggcgattctagccgaggaagagcgtctcgtggtcatacgtttcggccatgattgggatgaaacctgtatgcagatggatgaggtgctggcgtcagttgctgagacgataaagaactttgcggtgatatatctggtggacataactgaggttccagacttcaacaccatgtacgagctctacgatccttccacggtcatgttcttctttaggaacaaacacattatgatcgatcttggaactggtaacaacaacaagatcaactgggctatgaaggacaagcaggagtttatcgatatcatcgagaccgtcttccgtggtgcaaggaaaggtcgtgggctcgtgattgctccaaaagattactccaccaaataccgctactaaaccgggcctttccaacacacgttggagtatgttaagaaaaaaacattggatactctttccatgttgagtggttctgaatatcctatgaacttgttgcatatatgctttgatgatttgtgattcctgcttgcttactcttttcggctgtttggccatttataatgtatgcagttgcttcgaanatgaatcgccgaaatgaatgtgtttatgtttaacgt

SEQ ID NO: 3715 - DNA, 707 bp, Raphanus sativus
ggggaaacagatcagagttttcgagaaagcgggagacgagacgagacgatgtcgtatcttctaccgcatctgcactccggttgggctgtagatcaggcgattctggcggaggaagagcgtctcgtcgtcatacgtttcggccatgattgggatgagacttgtatgcagatggatgaggtgcttgcatctgtcgcagagacgataaagaactttgcggtgatatacctggtggacatcactgaggttccggacttcaacaccatgtacgagctctacgatccttcgacggtcatgttcttctttaggaacaagcacattatgatcgatcttgggactggtaacaacaacaagatcaactgggctatgaaggacaagcaggagttcattgatatcattgaaaccgtcttccgtggtgcaaggaaaggtcgtggtctggtgattgctcctaaagattactccaccaaataccgctactaaccaaccgggtcttgccacaacatttgatcgaaactctttatgtcatgagtgattctgatcatttgaaatatatatcctatgaacttgttgatttgttattccggattttgcttgctctctctatcggctgtttgccatttatgtgtgtgtgtgtaagtgcttcaaacttacttcagtgaaatgatgattacttagaagccaaatattgtgtctatttagtattaagtaca

SEQ ID NO: 3716 - DNA, 641 bp, Raphanus sativus
  misc_feature (254)..(254): n is a, c, g, or t
  misc_feature (278)..(278): n is a, c, g, or t
ggatcgtttctagagagagagaggaaactatgtcgtatcttctaccgcacttgcattccggctgggctgttgatcaagcgattctagctgaggaagagcgtctcgtggtcatacgtttcggccatgattgggatgaaacctgtatgcagatggatgaggtgctggcatcagttgctgagacgataaagaactttgcggtgatatatctggtggacataactgaggttccagacttcaacaccatgtacgagctntacgatccttccacggtcatgttnttctttaggaacaaacacattatgatcgatcttggaactggtaacaacaacaagatcaattgggctatgaaggacaagcaggagtttatcgatatcatcgagaccgtcttccgtggtgcaaggaaaggtcgtgggctcgtgattgctcctaaagattactccaccaaataccgctactaatctgtctttccaacacgttggagtatgtcaaaaaaaaaaacattggatcaaaactctttccatgttgagtgggttctgaatatcctatgaacttgttgcatatatgctttgatgatttgtgattcctgcttgcttactcttttcggctgtttgccatttatatgcagttgcttcgaacatgaa

SEQ ID NO: 3717 - DNA, 670 bp, Raphanus sativus
  misc_feature (559)..(559): n is a, c, g, or t
ggtgagtgaagattgaaacgaatcgaaatcgtttctagagagagaggaaacgatgtcgtatcttctaccgcacttgcattccggctgggctgttgatcaggcgattctagctgaggaagagcgtctagtggtcatacgtttcggccatgattgggatgaaacctgtatgcagatggatgaggtgctggcgtcagttgctgagacgataaagaactttgcggtgatatatctggtggacataactgaggttccagacttcaacaccatgtacgagctctacgatccttccacggtcatgttcttcttcaggaacaaacacattatgatcgatcttggaactggtaacaacaacaagatcaactgggctatgaaggacaagcaggagtttatcgatatcatcgagaccgtctttcgtggtgcaaggaaaggtcgtgggctcgtgattgctccaaaagattactccaccaaataccgctactaatcgatcggtctttccaacacatttggagtttgttaaacaaaaacattggatcaaaactctttccatgttgagtggttntgaatatcctatgaacttgttgcatatatgctttgatgatttgtgattcctgcttgcttactcttttcggctgtttgccatttacaacgtatgcagttgcttccaacatga

SEQ ID NO: 3718 - DNA, 962 bp, Secale cereale
ctccgccaggccgccctattttaaccaggcccaggcgcccagcaccagcactcgcacgctgctgattcacctcggctgttcgtctccacatcattctctccggcggcggcgactcgactctcggcgaggggcggagatgtcgtacctgctcccccacctgcactccggatgggcggtggaccaggccatcctcgccgaggaggagcggctggtcatgattcgcttcggccatgattgggacgagacgtgcatgcagatggatgaggtgctgtcaggggtggctgagaccataaagaactttgcggtgatctacctcgtcgacatcacggaggttcccgacttcaacaccatgtacgagctgtacgacccgtcgacggtgatgttcttcttccgcaacaagcacatcatgattgatctcgggacaggaaacaacaacaagatcaactgggcaatgaaggacaagcaagagtttgttgacattgtggagactgtctacagaggagctcgtaagggccgtggtctggtgattgctcccaaggattactccaccaaataccgctactgaggtatctgtgcctggctattcatgcgcagcatgtggcctgctctgttctgtgaaatgcgctgtgtgaccctttgatgtaatgtctgtcaactttggaagtgtcgcgtaactatgtatttgtatcttgaatatcaacatgtcataaacctgtaaccctttgaaacaggacctgctgtctattggtattactgattaaagtgatatctggtttgaactatgtgtgtgtgaattgctgaacagaggtctttgggaatctcggtgcagcactgctactcggatgattgattatatgtaaacaaatgctcttagtgcttcgtaattgtgtatagtttgaatatgtagcataagtggaggaaggccctgtgtctccgattttcttgaaataaagcttctaatt

SEQ ID NO: 3719 - DNA, 1037 bp, Secale cereale
agcatacactaaacaggaccgcctcaaggccgactcggtaggcaggccggctcggattagttggcacctccgccacggcgcccattttaaccaggcccacggcgcccagcaccagcactcgcacgctgctgattcacctcggcagttcgtctccacattactctctccagcggcggcgactcgagtctcggcgagggaggggcggagatgtcgtacctgctcccccacctgcactccggatgggcggtggaccaggccatcctcgccgaggaggagcggctggtcatgattcgcttcggccatgattgggacgagacgtgcatgcagatggatgaggtgctgtcaggggtggctgagaccataaagaactttgcggtgatctacctcgtcgacatcacggaggttcccgacttcaacaccatgtacgagctgtacgacccgtcgacggtgatgttcttcttccgcaacaagcacatcatgattgatctcgggacaggaaacaacaacaagatcaactgggcaatgaaggacaagcaagagtttgttgacattgtggagactgtctacagaggagctcgtaagggccgtggtctggtgattgctcccaaggattactccaccaaataccgttactgaggtatctgtgcctggctatgcatgtgaagtgtgtggcctgctctgttccgtgaaatgcgctgtgtgacccttgatgtgatgtttgtcaactttgaaagtgtcgcgtaactatgtatttgtatcttgaatatcaacatgtcataaacctgtaaccctttgaagcaggacctgctgtctattggtattactgataaaagtgatatttggtttgaactatgtgtgtgaattgctgagcagaggtcttcaggaatcttggtgcagcactgctactcggatgattgattatatgtaaacaaatgctgttagtgcttcgcaattgtgtatagtttgaatatgtagcacaagtggagaaaggccctgtgtctccgattttcttgaaataaagcttctaattcccctga

SEQ ID NO: 3720 - DNA, 834 bp, Secale cereale
tgctgattcacctcggcagttcgtctccacattactctctccagcggcggcgactcgagtctcggcgagggaggggcggagatgtcgtacctgctcccccacctgcactccggctgggcggtggaccaggccatcctcgccgaggaggagcggctcgtcatgatccgcttcggccatgactgggacgagacgtgcatgcagatggatgaggtgctgtcaggggtggctgagaccataaagaactttgcggtgatctacctcgtcgacatcacggaggttcccgacttcaacaccatgtacgagctgtacgacccgtcgacggtgatgttcttcttccgcaacaagcacatcatgattgatctcgggacaggaaacaacaacaagatcaactgggcaatgaaggacaagcaagagtttgttgacattgtggagactgtctacagaggagctcgtaagggccgtggtctggtgattgctcccaaggattactccaccaaataccgctactgaggtatctgtgcctggctattcatgcgcagcgtgtggcctgctctgttctgtgaaatgcgctgtgtgacccttgatgtaatgtctgtcaactttggaagtgtcgcgtaactatgtatttgtatcttgaatatcaacatgtcataaacctgtaaccctttgaaacaggacctgctgtctattggtattactgataaaagtgatatttggtttgaactgtgtgtgtgaattgctgagcagaggtcttcaggaatcttggtgcagcactgctactcggatgattgattatatgtaaacaaatgctgttagtgcttcgcaaaaaaaaaa

SEQ ID NO: 3721 - DNA, 919 bp, Secale cereale
tcgcacgctgctgattcacctcggcagttcgtctccacattactctctccagcggcggcgactcgagtctcggcgagggaggggcggagatgtcgtacctgctcccccacctgcactccggctgggcggtggaccaggccatcctcgccgaggaggagcggctcgtcatgatccgcttcggccatgactgggacgagacgtgcatgcagatggacgaggtgctgtccggggtggctgagaccataaagaactttgcggtgatctaccttgtcgacatcacggaggttcccgacttcaacaccatgtacgagctgtacgacccgtcgacggtgatgttcttcttccgcaacaagcacatcatgattgatctcgggacaggaaacaacaacaagatcaactgggcaatgaaggacaagcaagagtttgttgacattgtggagactgtctacagaggagctcgtaagggccgtggtctggtgattgctcccaaggattactccaccaaataccgctactgaggtatctgtgcctggctattcatgcgcagcatgtggcctgctctgttctgtgaaatgcgctgtgtgaccctttgatgtaatgtctgtcaactttggaagtgtcgcgtaactatgtatttgtatcttgaatatcaacatgtcataaacctgtaaccctttgaaacaggacctgctgtctattggtattactgataaaagtgatatttggtttgaactatgtgtgtgaattgcttagcagaggtctttaggaatcttggtgcagcactgctaatcggatgattgattatatgtaaacaaatgctcttaattgtgctgctccccaggtaccatccacacatcctgcaggcacctttccattgcctgagagaataggtggttagtttggatatgtagcaaaagtc

SEQ ID NO: 3722 - DNA, 690 bp, Salvia sclarea
ctactagaccttggctgtcactcaaaaagcttcagctcaagccttcagtctcagcgactctgagagaaaatcgttaacacgaaacgatgtcgtatttgctgcctcatcttcactccggctgggccgtcgatcaggcgatcctggcggaggaggagcgcctcgtcctcatccgcttcggccacgattgggatgagacctgcatgcagatggatgaggtgctggcttcagttgctgaaacgctaaagaactttgctgtcatatacctggtggacatcacagaggtccccgacttcaacacaatgtacgagctgtacgacccctccaccatcatgttcttcttcaggaacaagcacattatgattgatctcggcactggaaacaacaacaagatcaactgggccatgaaggataagcaagagttcattgacatcgtcgagactgtctaccgtggcgctaggaaggggcgtggtctcgttattgccccaaaggattactccaccaaatatcgctactaagcattgcgccatcttctggtacggtggcttgcaaatgaacccgtcgttcgattttaaggtaaattatgcagactcacatctgtgtagtttgttgtgagagattctactctgctgtttggcgattgatgtgattagccatgaataaaacaaatgttgtttctgttactgttctttg

SEQ ID NO: 3723 - DNA, 686 bp, Sciadopitys verticillata
tgggagaaaggaaaaggagaaaggagaaagatgtcgtacttgttgccgcacctgcactctggttgggcggtggaccaggcgatattggcggaggaggagcgtctggtggtgattcgtttcgggcacgactgggacgatacctgtatgcagatggacgaagttctgtcttccgtggcggagaccattaagaactttgcagtcatatacttggtggacatcacggaggtccctgacttcaacaccatgtacgagctgtacgacccttccactgttatgttcttctttaggaacaagcatataatgatagatctggggacaggtaacaacaacaagattaactgggctctcaaggacaagcaggagttcatcgacatcatcgaaaccgtctaccgcggtgcccgcaagggcaggggcctcgtcatcgcccccaaggactactccaccaaatacagatactgattttactttattactatttggggtatgtactttattactaattagggtatcaatttatgcacgccctattggactttatactgattttactttattactatttagggtatgtactttattattaattagggtatcaatttatgcatgccctcttcgattttgtgctgcctaggctcctcaatgtttcttcgaatttcatgcttattaattacgttttcatcttttaa

SEQ ID NO: 3724 - DNA, 636 bp, Solanum phureja
ataaaaatgtcgtatttgttgccacatcttcactctggatgggcagtggatcaagctattcttgctgaagaagaacgccttgtaatcattcgatttggccatgattgggatgatacttgtatgcagatggacgaggtgctgtcttcagttgcagagacaatcaagaactttgctgtgatttacctggttgacatcaccgaggtccctgattttaacacgatgtacgagctgtatgatccatccaccatcatgttcttcttcaggaacaagcacattatgattgatcttggcactgggaacaataacaagatcaattgggcccttaaggataaacaagaatttgtcgacattgttgagactgtgtatcgcggtgccagaaaaggccggggtctagtcattgcaccaaaagattactctaccaagtacagatactaagttacttggttgctggaatatgttgtatacttaatgacaaaactggaagaactgatagaacaatgttcaattgaactgtaaaaaattgatcaagcatgattatgatgagcttcttggatagagagaaaataaaaatataaagctgattcatgatggcctacctttttcttaggttaaaatcatggtttgaaattaggttga

SEQ ID NO: 3725 - DNA, 2211 bp, Picea glauca
catcgcaacatactgaagattcagcaacctatggaaacctacaatctaatcggcacttctaataactagaacctgcgactcacaaaatgaacatctctgtcattaatagaagcagtgattttaacccatgttcctgtgaacaacgaactgcatgatttgtgcaggccacaaccgagtcaattggaatgtgaaagtaaactatacatacctcaaacccattgtaccaatcaccattcatatatcaatctaatttactattcagtcatatcacatgtgcctagaggcccccatcttataattaggtgtctaggagataaaccgccttttaatttagtaagagagccaaatttgcagaagtttatgtaatataataatgaaatataactgactaattcgtttgaaggttcccaattgattacaatagtgcactccaagaagcatggaaatgacattgtgagacaaccatattgatctatttaagagcttcccataagatttacaaagacaaaagcatcacaaataagtagattgcaataagttaccaagaatagagtaacaaatcatagagcagtgggtctgctaaggcacacataccttgatatatcagatcattacaaagcaattcttctattcacacacaggacgagatggtctaagccatcatgaaaacatgacataccagagccatgtcttcacattcacaactttcataagcataatttgattacaaagtctaacaccatctctctgaaattctattattccatacaaaaaaagaatgtaactcccctgactgtaacagacaatacactcaactagacttaagactgtccatcctgacactacaatgcaggaaggaatgcagaagagcagttgccaagcaacatagacactgcattctcaatgaccagccaaactgtttcctcctgcacagaagaactgatctcttactctggaaaaacacatggaatagttgctatattcaaaccagctaaaagaaagaatgtaagaaatagaacaagacttctcagcagaaaccaatgggcattttcagttctggcagtaacaaaaacccaaaaactaaataggtaataacactctgctgatcctctgctcttactcccacagtttcagatggacaacaagacttgcatctgcagaaaagtgttcacattttataaacgtcaatatggtgtggtctgcagcatctagttgatctgacctctataagtctccttatctgcatcacctaaataccatgttcacatgcagggagacggccaataataacagtgctttacctgtatttgctctggcataccctaacgtctcaaagagggacaccggactgaagatcgaccgaggcgaaaatgtcatacttgctaccccatttgcactcagggtgggcagtggatcaggccattctagccgaggaggaacgtctcgtcgtcattcgcttcggccatgactgggacgaaacatgtatgcagatggacgaagtgctatcatccgttgcagaaaccatcaagaatttcgcagtgatatacctggtggacataacagaggtgcctgatttcaacaccatgtacgagctgtatgacccgtctactgtcatgtttttcttccgcaataagcatataatgatagacttggggacggggaacaacaataagatcaactgggctatgaaggacaagcaggagttcattgatattattgagactgtgtacagaggggccaggaagggcaggggtctggtcattgcccccaaggattattccaccaagtaccgatattaggtagataacagcaattgtattctatttcatatgtcgaactgggttttctttcattttatggatggatggatacattaaactttgggcttagacaaagcgggtagggtttctctggcccgaacctcgctgaatcaaaattaaaacctaaacctaaatggatatgctgttttaggcacataaaaattgttcaaacagtctggttatttgtgtttgtcctatgaagtgcttttttactggaatattattcgatgtaaagcatactattgtctgtttgaatggtttattatgcttatttatcgaattctgataaattattgtaaaatccctatggcatattgctactatcgtgtttcttatcacacacattgatagtttgagagaaagtccatggcttgtgggcaatagaaatggc

SEQ ID NO: 3726 - DNA, 733 bp, Fragaria vesca
tggaggcgaggagagcgagctgcattgcacttggtatagaaataggaataggaatagatcatcgacaatgtcgtatttgctgccgcacctgcactcgggatgggccgtcgaccaggccattttggccgaggaagaacgtgttgtcatcatacggttcggccatgattgggacgacacttgcatgcagatggatgaagtgctagcagcagtggctgacaaaattaaaaactttgctgttatttaccttgtggacatttcggaggtgcctgatttcaacacaatgtatgagctgtatgatccatccacagtcatgttctttttcagaaacaagcacattatgattgaccttggcactgggaacaacaacaagatcaattgggctctcaaggacaagcaagagttcattgacattgtggagactgtgtaccgtggtgcaaggaagggtcgtggtttggtgattgctcctaaggattactccaccaaataccgctactaactgctgtaattcattccagtctttgtaagatgatcctaatttctgcaattcctatatattaagctcctacattcaaacagccaaaagcatcctaatgtactgaacatctactgctttgaatggaattgcactttacctcatctgttcactcctaaccttgagagtttgattatgtctttagcttttcgcattgttaatgctaatagattgataaactagaaacctaggactgtgaag

SEQ ID NO: 3727 - DNA, 471 bp, Thalictrum flavum
atgtcgtacttacttcctcacttgcactcgggatgggcagttgatcagtcaatccttgcggaagaggaacgactcgttgtcattcgattcggtcacgattgggatgaaacttgtatgcagatggatgaggtgttgtcttctgttgccgagactataaagaactttgctgttatctaccttgtagatatcaccgaggttcctgacttcaacaccatgtatgagctttatgacccttccacagtgatgttcttttttcgcaacaaacacatcatgatcgaccttggaactggaaacaacaacaagatcaactgggcaatgaaggataagcaggagtttattgacatcgttgagactgtttaccgtggagccaggaagggccgtggtttagtgattgctcccaaggactactccactaagtatcgttactagggctttcttattctatgttagtaatggctgtaactcatttac

SEQ ID NO: 3728 - DNA, 728 bp, Eutrema parvulum
ggcaagaaaaagattgaaacagatcgaaatcgtcgttctagaaagagagacgagaggatgtcgtatcttctaccgcacttgcactccggttgggctgtcgatcaggcgattctggccgaggaagagcgtctcgtcgtcatacgattcggccatgattgggatgaaacttgtatgcagatggatgaagtgctcgcatctgttgctgagacgatcaagaactttgctgtgatatatctggtggacataagtgaggttccagacttcaacaccatgtacgagctctatgatccttcaacggtcatgttcttctttaggaacaaacacattatgatcgatcttggaactggtaacaacaacaagatcaattgggctctcaaggacaagcaggagttcatcgatatcattgaaaccgtcttccgcggtgcaaggaagggtcgtggactggtgattgctccgaaagattactccaccaaataccgctactaaccgggcttcccaacacatttggagtttgttaagaaaacattactcaaaactctttatgtcagggtgattctggtcagttgaaatatcctatgaacttgttgcatatatgcgtctgatgatttctgattctggtttgctgactctttcggctgttcgccatttatgtatgcaaatgcttcgaacatgattcatcggtatgaaacttagaagccgatattgtgtttatgtttttaagttataca

SEQ ID NO: 3729 - DNA, 854 bp, Solanum lycopersicum
ttagattctacgagtagccctaacattattcatatcgacctcagcactctgtttctgtaagcttcttctctgtttcttttttcttcattttttctgcataaaaagatcgaaatcagctactatttgagagagagatgtcgtatttgttaccacatcttcactctggatgggctgtggatcaagctatccttgcggaagaagaacgccttgtacttattcgatttggccatgattgggatgatacttgtatgcagatggatgaggtgttgtcttcagttgcggagacgatcaagaactttgctgtgatttacctggttgacatcaccgaggttcctgattttaacacgatgtacgagctgtatgatccatccaccatcatgttcttcttcaggaacaagcacattatgattgatcttggcaccgggaacaataacaagatcaactgggcgcttaaggataaacaggagttcatcgacattgttgagactgtgtatcgcggtgccagaaaaggccggggtctagtcatagcaccaaaagattactctaccaagtacagatactaagttacttggttgctggaacatgttgtactttatgatgaagctggaagaagttatagaacaatttataaattgaaatgtaaaagtttggtcaagtataattatgatgagcttcttggataaatcttgattgagaaaaaataaaaatgtaaagctgattcttaatgttcttagattaaaatcatgatttgaagttaaaattttatttagacatataatttggctttttttaagttgtgtttctcttgtagatattataatcttcacaatttgtgaaaactatagaaatctttt

SEQ ID NO: 3730 - DNA, 792 bp, Trigonella foenum-graecum
ttcagcaccgtcacacggaagctccaccgctgccggaatccacaccaccatcagtcagtaaagtggagtagtgataaacaacaagaaagatgtcgtacctgttgcctcacttgcattcagggtgggctgtcgatcaggcgatcctagctgaggaagagcgtctcgttgtcatccgttttggtcatgattgggatgagacctgcatgcagatggacgaggtgctgtcatcagttgcagagacaataaagaactttgctgtcatataccttgtggacatcacagaggtgcctgatttcaacactatgtatgagctgtatgatccttcgacggttatgttcttctttaggaacaagcacatcatgatagatcttggaactggaaacaacaacaagatcaattgggctatgaaggacaaacaagagttcattgacatcattgagactgtctacagaggtgcaaggaagggacgtggtctcgtcattgctcccaaagattactccaccaagtatcgttactaaatatatatcaatctctattttgatatgtactttgaactctgtatttttcattctcatccaaaatctacctcatttggttcactcttcatcaagtgtgaactctgtcactcaaatatcatcagccaacgttgtctgtcatactaatagtcttgacttctctgaaagagaagttgcattttatgctatcagaatccgttatctggattgtttaaaatgaataaaaatgtccattccatctaaataccattttgaccccctctcatttagggaacct

SEQ ID NO: 3731 - DNA, 706 bp, Tripterygium wilfordii
gtccctacttcgtcgagtcccctccttcgacggagaccacacactccgcggattcttcaacgccacaagtgaggtcatactgcaaatcctctctcgagttccagtttttgacccctcagaaagagagagaagaggatgtcttacctgctaccgcacttgcactcaggatgggctgttgaccaggccatccttgccgaggaagagcgtcttgtggtcatccgtttcggccacgactgggatgaaacctgcatgcagatggatgaggtactctcatcagttgctgaaacaataaagaactttgctgtcatatacctggttgatatcacggaggtgcctgattttaacacaatgtatgagctgtacgacccatccacagtcatgttcttcttcaggaacaagcacatcatgattgaccttgggactggaaacaacaataagataaactgggctatgaaggacaagcaagagtttattgacattattgagactgtgtatcggggtgctaggaaaggccgtggtctggtgatcgctccaaaagactattctaccaagtaccgctactgagtgctcgagtatgctgttgtttggaacttgtttatgcaaacctgtggcgtaagctataatggatcatggatgtattgatgtactagtttgctttatttggggacgtagatgcatgctttccttgcttatacaaggaaataga

SEQ ID NO: 3732 - DNA, 654 bp, Vinca minor
ttcccacttcttctttttaataaacctaacccgacgcagaatcttttgctgagagagagaagaaaaacgatgtcgtatttgctgccgcatcttcactccgggtgggctgtggatcaagcaattctggctgaagaagaacgacttgtgatgatcagattcggccacgattgggatgaaacctgtatgcagatggacgaagtgttagcatcagttgccgagaccttaaagaactttgcagtgatatacttggtagatataactgaagtacctgattttaacacaatgtacgagttgtacgacccatcaacaatcatgttcttctttaggaacaagcacattatgattgatcttggcactggaaacaacaacaagatcaattgggctatgaaggacaaacaagaattcattgacattgttgagactgtctaccgtggtgcaagaaaaggacgcggtcttgtcatagctcccaaagattactctaccaagtaccgttactaaagcgtgcctacttgtccgaatgatcatatatgaggcacatgatttagcttgtgtaataagattactattgactgttggctgagaagccatgttttggttgtattatgcagataatgttcttggatggttaataaagtcgtgtgtgtctcaagggct

SEQ ID NO: 3733 - DNA, 990 bp, Triticum aestivum
aaataggaccgcctcaaggccgactcggggtagcaggccgactcggattagttggcacctccgccaggccgccctattttaaccaggcccaggcgaccagcaccagcgcacgccgctgattcacctcggcagttcgtctccacattattctctccggcggcggcgactcgactctcggcgaggggcggagatgtcctacctactcccgcacctgcactccggctgggcggtggaccaggccatcctcgccgaggaggagcggctggtcatgatccgcttcggccacgactgggacgagacgtgcatgcagatggacgaggtgctgtcaggggtggctgagaccataaagaactttgcggtgatctacctcgtcgacatcacggaggttcctgacttcaacaccatgtacgagctgtacgacccgtcaacggtgatgttcttcttccgcaacaagcacatcatgattgatctcgggacaggaaacaacaacaagatcaactgggcaatgaaagacaagcaagagtttgttgacattgtggagactgtctacagaggagctcgtaagggccgtggtctggtgattgctcccaaggattactccaccaaataccgttactgaggtatctgtgcctggctattcatgtgcagtgtgtggcctgctctgttctgtgaaatgcgctgtgtgacccttgatgtaatgtctgtcaactttgaaagtgtcgcgtaactatgtatttgtatcttgaatatcaacatgtcataaacctgtaaccctttgaaacaggacctgctgtctattggtattactgattaaagtgatatttggcgtgaactatttgtatgaattgctgaacagaggtctttaggaatctcggtgcagcacttgtattcggatgattgattatatgtaaacagatgctcttagtgctttgcaattgtgctgctccccaggtaccatctacacatcctgcaggcgcctgagagaatagg

SEQ ID NO: 3734 - DNA, 793 bp, Zostera marina
gggaaaatcgaatctcacttcttcccccgaactttcaaaccctagcacgcaaaccttgttttcctgttttccaccaaatctctcctagtgactgccgagtgccgaccagactccaccggagtagattccagacgtctcttcatcttatcatctccaatctgcaggcttcaggtagcatttgccatgtcgtatctcttaccacatctgcattcgggatgggcggtcgatcaggccatccttgctgaggaggagcgcctcgtcgttatccgcttcggtcacgattgggatgagacgtgtatgcagatggatgaagtcctggcttctgttgcagaaacaattaagaattttgcagttatttatcttgtggacatcacagagattccagacttcaacactatgtatgagttgtatgacccatctactatcatgttcttcttccgcaataaacacattatgattgatcttggtactgggaacaacaacaagatcaactgggcaatgaaggacaaacaggaattcattgatatcgtggagactgtgtatcgtggcgcccgaaagggtcgtggtttagtcattgctcctaaggattattccaccaaataccgttactgaattctctaagctatgctatttccagagttctttaagcacatctgcaactgttatccaaagtttgcaagttgaaatatattattatttattctaagtggtctgtgccgcacgttcgaattcagatcgaatatgcatgtatctgaatccgaataattatccggatatccgagtaaatttggat

SEQ ID NO: 3735 - DNA, 705 bp, Bupleurum chinense
cttgagtgagacagaggagagagcatctgtgtagaagaggagtcgagaaggtgtcgtatttacttcctcaccttcactcaggatgggcggtggatcaggctattctcgccgaagaagaacgtctcgtcgtcattcgatttggtcatgattgggacgaaacttgtatgcagatggatgaagtactagcttctgttgctgagactataaagaactttgctgtgatatatctggtggatattactgaagtgcctgacttcaatacaatgtatgaactgtatgatccttcaactgtcatgttctttttcagaaacaagcacatcatgatcgatcttggcactgggaacaacaacaagattaactgggcaatgaaggacaagcaggaatttattgacatcatcgaaacagtctatcgtggggctaggaaaggtcgtgggttggtcattgcacccaaagattactccaccaaataccgttattaagtcaagctgttctggcgagttggtattgatcatgaacttgatgaatacgttaaataattgttgcatcagacttggcttctaagttgtcttttagactctgtttgtgttctggacatggattagatccaaatgtaaatgggaagacgctctgattgttgaattgctccgtctgtacaaggcaccaagtgacattgtgttatcagtaaaaacatggatgattggatgt

SEQ ID NO: 3736 - DNA, 624 bp, Cedrus atlantica
gaggtagagcgaggcaaaaatgtcatatttacttccgcatttgcactcagggtgggcagtggatcaggccattttagccgaggaggagcgcctcgttgtgattcgcttcggccatgactgggacgaaacatgtatgcagatggatgaagtgctgtcgtccgttgccgaaaccatcaagaatttcgcagtaatatacctggtggacataactgaggtgcctgatttcaacaccatgtacgagctgtatgacccatctactgtcatgtttttttttccgcaataaacatataatgatagacctggggacggggaacaacaataagattaactgggctatgaaggacaagcaggagttcattgatattattgagactgtgtacagaggggccaggaagggcaggggtctggtcattgcccccaaggattattccaccaagtaccgatactaggtagataacagcaattgtattctttttcatatactgaactggcttttctttaatattatagatggaaggatgctttaaactttggccctagacaaagcggctagggtggttttgggcctgaacttcgctgaatcaaaagtataacctatatctaaattgatatgctgtgttggcc

SEQ ID NO: 3737 - DNA, 647 bp, Gossypium hirsutum
gattaaagcaaaaagactgataagaaagggagaaaaacgatgtcgtacctgttgccgcacttgcattcggggtgggccgtcgatcaggccatcctcgccgaagaagaacgcgtcgtcatcatccgtttcggccatgattgggacgaaacttgcatgcagatggatgaagtccttgcttcagttgctgaaaaataaagaactttgccgtaatttacgtcgttgacataaccgaagtgcccgagttcaacacgatgtacgagctttacgatccgtccacggtcatgttcttctttcgaaacaagcacatcatgattgatctcggcaccggaaacaacaacaaaatcaattgggcactcaaggacaagcaagagttcatcgacatcgtcgaaactgtataccgcggagcaagaaagggtcgcggtctcgtgattgctccgaaagattactcgactaagtaccggtactgattatatctcaatttttgaaacactttaaatgtgaataatgctacgttgctatgcttgtatgaatgtgaaactacgtagcttttacgagtattttaaaaaaatgaagagttaaaataactagttgatcggtattagacattgaaaaggttaaattttactattagtccctatacttgtaaa

SEQ ID NO: 3738 - DNA, 674 bp, Fraxinus spp
aacgatgtcgtatatgctgccacacctccactcgggatgggccgtggatcaagctatcctcgccgaggaggaacgcctcgtaatcatccgattcggccacgactgggacgaaacctgcatgcagatggatgaggtgctggcttcagttgctgaaacattaaagaactttgctgttatctacctggtggatatcacagaggtgccagattttaacacgatgtatgagttatatgacccgtccaccatcatgttcttcttcagaaacaagcacattatgatcgatcttggcactgaaacaacaacaagatcaactgggcactgaaggataaacaggagttcatcgacattgtcgagacggtctaccgtggtgcaaggaagggccgtggtctagttattgctccaaaagattactccaccaaatatcgttactgagtactcatcttacattcatgtggtatactttcttgcaactctgtctgtgtaattaattcggtgaaaactttcacaatttaagttgttatatggaactgagaactctcaagctcctatgctagttatgggtttgagagaatcaggctccaactaaggtctggtttgtggtataatctgatggtacttttgtaatttgtccatgtattcggatttgaggatttattatcaagtggcttgcatct

SEQ ID NO: 3739 - DNA, 623 bp, Papaver somniferum
aggaaggaaaagggaaaaaagatgtcttacttactccctcacttgcactctggttgggctgtggatcaagccatccttgctgaggaggaacgacttgttgttattagattcggtcatgactgggatgagacttgcatgcagatggatgaggtattgtcttcagttgctgagacaataaagaattttgctgtgatctatctagtcgacatcactgaagtgcctgatttcaacaccatgtatgagctttacgacccttcgacagtcatgttcttttccgtaacaaacacattatgattgatttgggaaccggaaacaacaacaagatcaactgggcactcaaggacaagcaggagttcattgacatcattgagactgtttatcgtggggccaggaaaggtcgaggtctggtgattgcacctaaagactactccacaaagtaccgttactagaagtctagaacctgctatttcaactgcacaaggctaagtctttgactttgcaagacttctataaactgaacctcagaggttacaattgagacatctataattctgtaatttaattcgaaaactctcaagaattcgaagagatagatgtgtactttcatgcatgtcatgaagaat

SEQ ID NO: 3740 - DNA, 763 bp, Brassica juncea
ataagaagagagataggaaacgaggtcgaaagcgcgagagctagagagacgagaggatgtcgtatcttctaccgcacctgcactccggctgggccgtcgatcaatcgattctagccgaggaagagcgtctcgtcgtcatacgtttcggccatgattgggatgagacttgtatgcagatggatgaggtgcttgcgtctgttgctgagacgataaagaactttgcggtgatatatctggtggacatcaccgaggttccagacttcaacaccatgtacgagctctacgatccttccacggtgatgttcttctttaggaacaagcacattatgatcgatcttgggactggaaacaacaacaagatcaattgggctatgaaggacaagcaggagtttatcgatatcattgaaaccgtcttccgtggtgcaaggaaaggtcgtgggctggtgattgctcctaaagattactctaccaaataccgttactaaccggacttggcaaaaaaacatttgatcagaaactctttatgtttgagttggaagatgtcctatgaacttgttgttggcttatattgctttgggtgatttgtgattctgctgtttattggctttttgccatttatgtgtaagtgcttcaaactttaattcagtgaaatgaatacttagaagctaatattgggtttatgtagaactataactacaagattcttgatcttgttgtcttaagcaggggtttgaatatttctattcatattgttcagtcagac

SEQ ID NO: 3741 - DNA, 747 bp, Cenchrus ciliaris
aggagagaagtcgagagggaggaggaggagcaggccggccggcggcggaagaagatgtcgtacctgcttccgcatctgcactcggggtgggcggtggaccaggccatcctcgccgaggaggagcgcctcgtcatcatccgcttcggccacgattgggacgagacctgcatgcagatggatgaagtgctggctggagtagccgagaccataaagaactttgctgtcatctacctcgtcgacatcactgaggtcccagacttcaacaccatgtacgagctgtacgacccgtcgacggtgatgttcttcttccgcaacaagcgcgtcatgataaaaatcgggacgggaaacaacaacaagatcaactgggccctcaaggacaagcaggaattcaccgacatcgtggagaccgtctacaggggtgccaggaagggccgtggtctggtgattgctcccaaggactactccaccaagtaccgttactaagaaggctggcaatgccatctgctgctgctgtattagcctgatatgttcccactcatgtaaacgggggatgttttatccagacaggcagacaaggtatgcttgcttgctgggtgttgcataactgtatctggacttgccgtaaacctcttgacttgccgtaaacctgtaaagctgtaatatgagctgattgttcgagtgtcaaatttatgtttgtcacgatacagaacagagcttgtgttaataagtgatcgctggtttgacaca

SEQ ID NO: 3742 - DNA, 815 bp, Cephalotaxus harringtonia
cagcccctcgataggaccgtcggcgtaagggagtggaatagaacgggcggcgcaaagctctttgctttacaaaacaggcgtttgacgctgattaattgtgcctggacagggaagagtgcaaggacaggagaggagcgtaagaggcaagggcaaggtacaggggcaggggcaagggcaagggcaagcaaaggtctaaggaaatgtcgtacttactgccgcacctgcactcggggtgggctgtggaccaggcaatattggcggaggaagagcggctggtggtgattcgattcgggcacgactgggacgacacatgcatgcagatggacgaagtgctttcgaatgtggcggagtccataaagaactttgcggtgatatacctggtcgacatcacggaggtgccggacttcaacaccatgtatgagctttacgacccctccacggtaatgttcttcttccgcaacaagcacataatgatagacctgggcactggcaacaacaacaagatcaactgggctttgaaggacaagcaggagttcattgacatcatagagaccgtctaccgcggtgcccgcaagggccgcggccttgtcatcgcccccaaggactattccaccaagtaccgctattaggatttcttttatgttttcatttctctctttccattcaaacaaaccctgggaattgaagatctgaaactgaactgacttctgaaatctgatttgctattttcaacactgaatactcaattttattctgcaatatcttacaattttctgtctatgcatgtattttataccaagttgcatatatgatag

SEQ ID NO: 3743 - DNA, 622 bp, Cryptomeria japonica
caaaaaggagaagagcaagggcagaaatgtcttacttgttgccgcacctgcactcgggatgggcggtggaccaggcgatactggcggaggaggagcggctagtggtaattaggttcggccatgactgggatgacacctgcatgcagatggacgaggtgctttcgagcgtggcagagtccatcaagaattttgcggtgatatacctggtggacatcacggaggtgcccgacttcaatactatgtatgagctttacgacccttccactgtgatgtttttcttccgcaacaagcacataatgattgatcttgggaccggcaacaacaacaagatcaactgggctctcaaggacaagcaggagttcatcgacattatcgaaaccgtgtatcgcggtgcccggaagggccgcggtctcgtcattgcccccaaggactattccaccaagtatcgctactagttttgcatttctctttctattcgcatattacctcacacatttcacactaactgtgaattgctatccataatggattactcttcctgattgtttaagatttcaatccatttaggaggacagtgcagttttgtgtttatattcttaatttaagaattttatgctttact

SEQ ID NO: 3744 - DNA, 744 bp, Euonymus alatus
gacactccggattcttaaaaccgccctaggtgagcgcttcactgcaaatcctctcgagttccgggaacctattcttttcatttcttgtcaattgcttgccgttttttgactcctcagaaacgcgcgcaagagagagaagaggatgtcttatctgctaccgcacctgcactctggatgggctgttgaccaggccatccttagcgaggaagagcgtcttgtggtcatccgtttcggccacgactgggatgaaacttgcatgcagatggatgaggtactggcatcagttgctgaaacaataaagaactttgctgtcatatacctggttgatatcactgaggtgcctgattttaacacaatgtatgagctgtacgacccatccacagtcatgttctttttcaggaacaagcacattatgattgaccttgggactggaaacaacaataagataaactgggctatgaaggacaagcaggagtttattgacattattgagactctgtatcggggtgctaggaaaggccgtggcctggtaatcgctccaaaagactattctaccaagtaccgctactgagtgcttgagtctgttgttgtttggaacttgtttatgcaaacctgtagcctaagctaatggaacagggatgtattgatgtactagtatggtttatttgtggacgtatctgcatgctttgtgttccttgctcatacaaggaaatagacatatttcttgttaatttgaatacttct

SEQ ID NO: 3745 - DNA, 737 bp, Euonymus alatus
cggattcttaaaacagccccagtttttttactcctcagaaacgcgtgcgagagagagaagaggatgtcttatctgctaccgcacctgcactcaggatgggctgttgaccaggccatccttagcgaggaagagcgtcttgtggtcatccgtttcggccacgactgggatgaaacctgcatgcagatggatgaggtactggcatcagttgctgaaacaataaagaactttgctgtcatatacctggttgatatcactgaggtgcctgattttaacacaatgtatgagctgtacgacccatccacagtcatgttctttttcaggaacaagcacattatgattgaccttgggactggaaacaacaataagataaactgggctatgaaggacaagcaggagtttattgacattattgagactctgtatcggggtgctaggaaaggccgtggcctggtaatcgctccaaaagactattctaccaagtaccgctactgagtgcttgagtctgttgttgtttggaacttgtttatgcaaacctgtagcctaagctaatggaacagggatgtattgatgtaccagtttggtttatttgtggacgtctatgcatgctttgtggttccttgctcatacaaggaaatagacatatttcttgttaagttgaatacttctgtttttcttctgcatggcatgactttttatttttattcttcttccatgtgctgagtggctgtcagctatga

SEQ ID NO: 3746 - DNA, 829 bp, Euonymus alatus
actccggattctttaaaccgccccagttttttgactcctcagaaacgcgcgcaagagagagaagaggatgtcttatctgctaccgcacctgcactctggatgggctgttgaccaggccatccttagcgaggaagagcgtcttgtggtcatccgtttcggccacgactgggatgaaacctgcatgcagatggatgaggtactggcatcagttgctgaaacaataaagaactttgctgtcatatacctggttgatatcactgaggtgcctgattttaacacaatgtatgagctgtacgacccatccacagtcatgttctttttcaggaacaagcacattatgattgaccttgggactggaaacaacaataagataaactgggctatgaaggacaagcaggagtttattgacattattgagactctgtaccggggtgctaggaaaggccgtggcctggtaatcgctccaaaagactattctaccaagtaccgctactgagtgctcgagtctgttgttgtttggaacttgttatgcaaacctgtagcctaagctaatggaacagggatttattgatgtactagtttggtttatttgtggacgtctatgcatgatttgtggttccttgctcatacaaggaaatagacatatttcttgttaagttgaatacttctgtttttcttctgcatggcatgactttttatttttttcttcttccatgtgctgaggggctgtcagctatgatcagaaaggcagagagtcgaggaggtattcatggttgtcgaatttgtagaatttgtagaggaataaaaatgatgcccaatggaatttgtg

SEQ ID NO: 3747 - DNA, 681 bp, Euonymus alatus
cggccggggcatttgacactccggattcttaaaaccgccccagttttttgactcctcagaaacgcgagagggagagagaggaggatgtcttatctgctaccgcacctgcactcaggatgggctgttgaccaggccatccttagcgaggaagagcgtcttgtggtcatccgtttcggccatgactgggatgaaacctgcatgcagatggatgaggtactggcatcagttgctgaaacaataaagaactttgctgtcatatacctggttgatatcactgaggtgcctgattttaacacaatgtatgagctgtacgacccatccacagtcatgttctttttcaggaacaagcacattatgattgaccttgggactggaaacaacaataagataaactgggctatgaaggacaagcaggagtttattgacattattgagactctgtaccggggtgctaggaaaggccgtggcctggtaatcgctccaaaagactattctaccaagtaccgctactgagtgctcgagtctgttgttgtttggaacttgtttatgcaaacctgtagcctaagctaatggaacagggatgtattgatgtactagtttggtttatttgtggacgtctatgcatgatttgtggttccttgctcatacaaggaaatagacatatttcttgttaagttgaat

SEQ ID NO: 3748 - DNA, 632 bp, Guizotia abyssinica
ctacagccggggagtttttgaacaatcatatagtttctcgacagaacgagagagagatgtcgtacttgctagcgcaccggcaatccggctgggccgtcgatcaggcgatcctcgccgaggaggagcgtctcgtcgttatccgattcggccatgattgggacgaaacttgtatgcagatggatgaagtgcttgcttcagttgcagagacgataaaaaactttgctgtaatatacctggtggacatcacagaagtaccagacttcaatacaatgtatgaactttacgacccgtcaactgtaatgttctttttcaggaacaaacacatcatgattgatcttggtactggtaacaacaataaaatcaactgggccatgaaggacaaacaagagttcatagacattgttgaaactgtgtaccgtggggcccggaagggccgtggtttggtcattgctcccaaagattactctaccaagtatcgttactaaacaaacgcatttcggtcgtcagtgtttctgtggatttgaaccgtgttttgtaagaattaaaccggttgtgacttttgaattgttgcaacattagtgtgattgtggtctgttgaaacctatgttttgtggtttaacaactttgcttaa

SEQ ID NO: 3749 - DNA, 864 bp, Medicago truncatula
ttacatcacctctatctatctatctcaccacacccgctctattgttgttgaattgaaggtggaaaccctaattaagaaaagaaaaggggaagaagaagaagaaagatgtcgtacatgctgcctcacttgcattcgggatgggctgttgatcaggcaatccttgctgaggaggaacgtctcgttgtcatccgttttggtcacgattgggatgagacttgtatgcagatggatgaggtgctgtcatcggttgcagagacaataaagaactttgctgtgatataccttgtggacatcacagaggtgcctgactttaacactatgtatgagctgtatgacccttccacagttatgttcttctttaggaacaagcacatcatgatagaccttggaactggaaacaacaacaagatcaattgggctatgaaggacaaacaggagttcattgacatcattgagactgtctacagaggtgcaaggaaggggcgtggtcttgtcattgctccgaaagattactccaccaagtaccgttactagaatgtatcaatctctacagggaggatatgtgtgatttgaactctatttgagtattttcattcttgtccaaaatctacctcatttggtacaccctttattaagtgtgtaactgtcactaaactatcagtttacacacccacttgtatgtcatcttaaactgtaattgttatgctttgtgtatgccccacatgtacttggattatgtgaccaacaaagatttatattttatgataaaagtgattgatttaaaatggtaggaattgtttgtcaggacaagtttattcaactaatgataatcaatcaaacacaaatcattcagtctgatcaagc

SEQ ID NO: 3750 - DNA, 661 bp, Capsicum annuum
cgtacttgttgcctcaccttcactcaggatgggcggtcgatcaagctattcttgctgaagaagaacgccttgtcattatccgcttcggccatgactgggacgaaacttgtatgcagatggacgaggtgctggcttctgtcgctgatacattaaagaattttgctgtcatatacctggtggacatcacagaggtccctgattttaacacgatgtatgagttgtacgatccatctactatcatgttcttcttcaggaacaagcacatcatgattgatcttggtactggaaacaataacaagatcaactgggcactcaaagataaacaagagttcattgatattgttgagactgtgtaccgtggtgcacgaaaaggtcgtggtctagttattgcaccaaaagattactctaccaagtatcgttactgagtgtctgttgatattgtattttggttgtggaatatgcttgcactttatggctgaattgtgaaatatggttgctaaactggttttcattactgactcagttgctgtgaagatcctactgtacaataattttccattagttgcaagtgaaagacttcaactcttcttaaaactatgttacgatcaattatatcgccctttctgtaattgtggttttactgtttcggcttcagcatgtg

SEQ ID NO: 3751 - DNA, 675 bp, Sequoia sempervirens
agcacgcggagcaattagcaaaaggggtgttcgagagaaaaaggcaaaggcggaaatgtcttacttgctgccgcacctgcactcgggatgggcggtggaccaggcgatactggcagaggaggagcggctagtggtaattaggttcgggcacgactgggatgacacttgcatgcagatggacgaggtgctttcgagcgtggcagagtccataaagaattttgcggtgatatacctggtggacatcacggaggtaccggacttcaacaccatgtacgagctgtacgacccttccaccgtgatgttcttcttccgcaacaagcacataatgattgatttggggactggcaacaacaacaagatcaattgggctctcaaggacaagcaggagttcatcgacatcatcgagaccgtctatcgcggtgcccgtaagggccgcggtctggtcattgcccctaaggactattccaccaagtatcgctactagttttgcatttctctttcaattcgcatatttccttacatatttcaacctaactgtgacctgcgatttattatggattactctcctcgattatttaagatttcaatgcacatatggcgacagcacagttttgtgtttatattcttaatttaagaattttatgctttactaacagtgtgattttgcgatgatac

SEQ ID NO: 3752 - DNA, 822 bp, Trigonella foenum-graecum
cctcttgtgacttgtgtcttctcctctacacggtacacattcatttgcaatttcttattctctctctcatccagaaaccggcttcgccttcaacacacttcatcactgttcttctccttattcattaaattcgatagcgataaagaagaagaaagatgtcgtacatgcttcctcacttgcattcgggatgggctgttgatcaggcaatcctcgctgaagaggaacgtctcgttgtcatccgttttggtcacgattgggatgagacttgtatgcagatggatgaggtgctgtcatcggttgcggagacaataaagaactttgctgtgatataccttgtggacatcacagaggtgcctgattttaacactatgtacgagttgtatgacccttccacagttatgttcttctttaggaacaagcacatcatgatagaccttggcactggaaacaacaacaagatcaattgggctatgaaggacaaacaggagttcattgacattattgaaactgtctacagaggtgcaaggaagggacgtggtcttgtcattgctcccaaagattactccaccaagtaccgttactagaatgtatcaatctctacagggatatcatgtgttatttgaactctatatgagtgtttttattcttgtccaaaatccatctcatttggttcactctttattaagtgtgtaactgtcactaaattatcagtttacacacctatgtcatcttaaactgtaactgttatgttctgtgtatgcccagcatgtacttggattatctgacgaacaaagatttatattttatgataaaagtgattga

SEQ ID NO: 3753 - DNA, 747 bp, Triphysaria pusilla
ggaacttcttctagacgcggagtcgaatttgccagacgatgtcgtatctgttgccgcatcttcactcaggatgggccgtcgatcaggcgatcctcgcggaggaggaacgcctcgtcatcatccgtttcggccacgactgggacgaaacctgtatgcagatggacgaggtactatcttcggttgccgacactctgaagaactttgctgtcatatacctcgtcgacatcacggaggtgcccgatttcaacacgatgtatgagctatacgacccttcgaccgtaatgttcttcttcaggaacaagcacatcatgatcgatctgggcactggaaacaacaacaagatcaactgggccatgaaggataagcaggagtttatcgacattgtcgagacaatctatcgtggtgctaggaagggacgtggtcttgttatcgccccaaaagattactccacgaaatatcgttattgattattattatatgctattatgcgtgtgaacaattgattctgctattcaagcatttaagtcagtgtgtttcttatgtgtacttgctcctactctaaaagaaccgctattattgcgattcgtcactatgtataacacaagataactgcatacaatatgctgttattgtgattcaatctttaagcataacatagttgcttggataatcttatgtagcatttgagttgtagtcaaccatagagactggtatctcatggagactactttcaagtttctactttcg

SEQ ID NO: 3754 - DNA, 607 bp, Triphysaria pusilla
tcacagagtcgacatttctttctccaaatcaagctttgccagaaaatgtcgtatctgctgccgcatctccactcaggctgggccgtcgatcaggcaatcctcgccgaggaggaacgcctcgtaatcatccgtttcggccacgactgggacgaaacatgtatgcagatggatgaggtgctatcttcggttgccgacacgctaaagaactttgctgtcatatacctcgttgatataacggaggtgcctgatttcaacacgatgtatgagttgtacgatccttcgaccgtcatgttcttcttcaggaacaagcacatcatgatcgatctgggcactggaaacaacaacaagatcaactgggccatgaaggataagcaggagtttattgacattgtcgagacgatctatcgtggtgctaggaagggacgcggtctcgtcatcgccccgaaagattactccacgaaatatcgttattgattattgttatatgctgtgatgtgtacgaacaattaattctgctatttgagtgttttatgctactgtatttgtttggactctaaagggtccgctgtaattgtaattctgacatatgcataataacataagttct

SEQ ID NO: 3755 - DNA, 641 bp, Ambrosia trifida
gatgtcgtatttgctaccacacttgcactccgggtgggccgtggatcaggccattctggctgaggaagagcgcctcgtcgtcatccgcttcggccatgattgggcgaagcttgtatgcaggtggatgaagtgcttgctgcagttgcagagacattaaagaactttgctgtaatctacttggtggacataacagaagtacctgactttaatacaatgtatgaactttacgacccgtcaactgtaatgttctttttcaggaacaaacatatcatgattgatcttggtaccggtaacaacaataagatcaactgggccatgaaggacaaacaggagttcattgacatcgttgaaactgtctatcgtggggcccggaagggacgtggtttggtaattgcacccaaagattactccacgaagtaccgttactaaactcattcaggcctatggttctgtggatttgaactgttattagaatggcataaaacggttgtgacttttgaattgctataacattggtgtgattgtagtcttgtgaaaacatggatcaagatgcaataactttgcagtgataaatgttgtatttcctattacttaaatttgaggcttgtggtattataaaatacataagcaaatatatgttt

SEQ ID NO: 3756 - DNA, 738 bp, Fraxinus spp
gaaccagaactaaaattttttctataactcgaactctcgaataacggaacgatgtcgtatatgctgccacacctccactcgggatgggccgtggatcaagctatcctcgccgaggaggaacgcctcgtcatcatccgattcggccacgactgggacgaaacctgcatgcagatggacgaggtgctggcttcagttgctgaaacattaaagactttgctgttatctacctggtggatatcacagaggtgccagattttaacacgatgtatgagttatatgacccgtcaccatcatgttcttcttcagaaacaagcacattatgatcgatcttggcactggaaacaacaacaagatcaactgggcactgaaggataaacaggagttcatcgacattgtcgagacggtctaccgtggtgcaaggaagggccgtggtctagttattgctccgaaagattactccactaaatatcgttactgagtactcttcttaccctttatgcaagtatattatcttacaatcttcttgtatgttgatttggtgagaaccttcacaatttcagttcctatgtggaactggattatcaagctcctatgctaattaaaggtctgaaagataaacgcagcaattaatgtctggtttgtggtgtcatcaaaaggtcctttgtactttatccatgtattcagatttgatgatttatttatcaaatggcttgcatctttagatgcgactcgtgagct

SEQ ID NO: 3757 - DNA, 866 bp, Phaseolus vulgaris
aatccagttcaagcccaatgcacccaatgcaatgtaaaactcttgcgttgcttccgaacgctgaaagcgaatttcagttagggtttgaagaaagagaaggagaagaagatgtcgtatctgttgcctcacttgcactcaggctgggctgttgatcaagcaatcctcgccgaagaagagcgtcttgtgattatccgattcggccatgattgggacgaaacttgtatgcagatggacgaagtgttggcgtcagtagcagagactctgaagaacttcgcagtggtatcaacgcagagtggccattacggaggtgccggatttcaacacgatgtacgagctctacgatccttcaactgttatgttctttttcaggaacaaacacatcatgatcgatctcggcactggcaacaacaacaagatcaattgggctctcaaggacaagcaggagttcatcgacattgtcgagactgtttaccgcggcgcgaggaagggtcgtggtcttgtcattgctcccaaagattactccaccaaataccgctactaagctcatcttattatgctttatgcaaggacgagcatgtgcaatttatccccaaaaacatgttaactttactcaccacattgagtacatatttatcagagctgatagcacatgtgtgctattctgaaaatttgttttacttatcatttgatgaatttgttgttcctctgtaagaccagctaaatcaccacaagcgcctaaaacggtcacaaaagttccagtgttgggttttaacccatcagaagccagcgttttgttaaataccttcactgcatgacattcttcacttagtccaagtaatgacattcttcacacgcatttcataaaa

SEQ ID NO: 3758 - DNA, 704 bp, Brassica oleracea
  misc_feature (224)..(224): n is a, c, g, or t
  misc_feature (327)..(327): n is a, c, g, or t
  misc_feature (525)..(525): n is a, c, g, or t
gagatcaggaaggcaggaaacggattgaaatcgtcgtttctagagagagagagagagagagagagagagagagagagaagagacgatgtcgtaccttctacctcacttgcattccgggtgggctgtcgatcaggcgattctagccgaggaagagcgtctcgtggtcatacgtttcggccatgattgggatgaaacctgtatgcagatggatgaggtgttggcancagttgctgagacgatcaagaactttgcggtgatatatctggtggacataagtgaggttccagacttcaacaccatgtacgagctctacgatccatcgacggncatgttcttcttcaggaacaaacacattatgatcgatctcggaactggtaacaacaacaagatcaattgggctatgaaggacaagcaggagtttattgatatcattgagaccgtcttccgtggtgcaaggaaaggtcgtgggctcgtgattgctcctaaagattactccaccaaataccgctactaaccccaacacantggagtttgtttcagaaaaacattggatcaaaaaaactcttttcatgttgagtggttatggtcagttgaaatatcctatgaacttgttgcatacatatgctttgatgaattgtgattcctcttgcttactcttttcggctgtttgccatttatgtattgcagtatcttcgaacatggat

SEQ ID NO: 3759 - DNA, 640 bp, Guizotia abyssinica
agacggggggcttttgagccatctcgaaagaaggagacagatgtcgtacttgctaccgcacttgcactccggctgggccgtcgatcaggccattctcgccgaggaggagcgtctcgtcgtcatccgcttcggccatgattgggacgaaacttgtatgcagatggatgaagtgcttgcttcagttgcagagacaataaagaactttgctgttatatacttggtagacataacagaagtacctgacttcaatacaatgtatgagcggtacgatccgtcaactgtaatgggctgtttcaggaacaagcatatcatgattgatcttggtactggtaacaacaataagatcaactgggccatgaaggacaaacaggagttcatagacatcattgaaactgtctatcgtggggcccggaagggccgtggtctggtcattgcacccaaagattactccaccaagtaccgttactaaactcattcggccttatggttctgtgggtttgaaccgtatttaggatgggataagggatataacaattgtgtgattgcgggaatttgaaatcttgtggttcggatttcttaaaatcggagactttaggaacgattactagcatctattggtcttggaatcctaaagacctcc

SEQ ID NO: 3760 - DNA, 917 bp, Tropaeolum majus
gggaattaaaatataattgcgtttttattctacgaaccatcaagaaatcccaacagacaataattccaagatgcactcaggaaaggattaggttttccactctattttaattccataatccatttcgaaaaggaataggttcaaaccagtagcattatatattctccttggggactctgctcgaagaaacatcaaattcccgatttgatttcccttttgcccaaagagtgagccgtgaaaccactgtttggaaaaaagaatgtcctacttactaccgcatctgcactctggctgggctgtagatcaggccatcttagctgaagaagagcgccttgtagtcataaggtttggacatgattgggatgaaacatgcatgcagatggacgaagtgttggcctcagttgcggagacactaaagaactttgcagtcttatatctggtggatataactgaagtacctgatttcaacacaatgtatgagctgtacgatccatccacaattatgttcttctttaggaacaagcatattatgattgatcttggaaccggaaacaacaataagatcaattgggctatgaaggacaaacaagagttcatcgacattgttgaaacaatctatcgaggggcaagaaaagggcgtggtttggtgattgctccaaaggactactcgaccaagtaccgctactaattactcccacaagctgtctacatattgctccaaaggccatgtacttttatttttctggattgaaattatcaagtgtgattgtagtcgtggatatggctttagttcgacttctggcatctagaaccatgtctgatattcgtggaagttacacatttggacatttttcattactttatgattcgctggttcacattgtatttgtgtttttctctttatcgaatcaccattg

SEQ ID NO: 3761 - DNA, 786 bp, Tropaeolum majus
cttgtctcgctcccacaaatcgctcgcgcttctcataccctcggacttgatagacaaagcagatagagttattgatcgcgctaatttcaaccgtaacctgaaagaatgtcatacctgctacctcatctgcactctggatgggctgtagaccaggccatcttagctgaggaagagcgccttgtagttattcgatttggccatgattgggatgaaacatgcatgcagatggatgaggtgttggcatcagttgcggagaccctaaagaactttgccgttttatatcttgttgatataactgaagtgccggattttaacacgatgtatgagctgtatgatccatcaacaataatgttcttctttaggaacaaacatatcatgattgatctcggaactggaaacaacaacaaaatcaattgggctatgaaggacaagcaagagttcattgatattgttgaaactatctatcgcggagcaagaaaaggtcgtggtttggtgattgctcctaaggactactccacgaagtaccgatactaattactttgtttatattcagaaatatttaaagcacctatcaagtatgcaagcttaatcatttaaaatctaaatggactgagaaactcgcaggtctagtcgtggtacttgtatctattgtctacctgtttaacttgaaattatactctgacgttggaaagtgtagttgggagttgtaattgtattataaactttttatgttgtactttgaatgtatatccatggcttaaaaatcttcggttgtataactgtttt

SEQ ID NO: 3762 - DNA, 883 bp, Cajanus cajan
gaatgtaagagtgaaagtacggggtgtttctagacacttccgttgccttcttcatatatatgcatatatttgaatccttggaggagaaaatagaatagacagagatcaggaaataggaatgtcatacttgttaccacatttgcattctgggtgggcagtggatcaggctattctctccgaagaagaacgagtagttgtcatacgcttcggtcacgattgggatgacacatgcatgcagatggatgaagtgctggcatccgttgcggagaccataaaaaatttcgcagtcatttatctggtggacatcacggaggtaccggacttcaacaccatgtacgagttgtatgacccgtgcaccgtaatgttctttttcaggaacaaacacatcatgatagaccttggaaccggaaacaacaataagatcaactgggctctcaaagacaagcaagagttcattgatattgtcgaaactgtctatcgcggtgctaggaagggacgtggtcttgtcatttctcccaaagattactctaccaagtaccgctactgagattcagatgcttaccctccaatttattctacattaccattactacttcctcaacttttcactataatcccaaatacctggagcaatgatacttcatttgagtggactatgatgtttaatttagtcacgcctatgctccatgttagtttaatgttaatgaacattacattgtacaccacaatatgtttcaccctatgctcgtttattcttttcacttggcactatcctattttattgtgtgcttccagacttgtctgaaacttcactgctattcacggtagagccagtgatctattaaacaatcatctaaaaataaataaataaaatcttgattta

SEQ ID NO: 3763 - DNA, 624 bp, Podocarpus macrophillus
ggagcgttacgagttcgaatccagccagacctgcgagcgaggagaaagagaagtcaagaattaagaatgtcgtatttactaccacatctccactcagggtgggcagtggatcaagctatattatctgaggaggagcgtctcgttgtcattcgtttcgggcatgattgggacgatacttgtatgcagatggacgaagttctttcgtcagttgcggagaccataaagaattttgcagtgatatatctggtggacatcacagaagtgcccgactttaacaccatgtacgaattgtatgatccctccacggttatgttctttttcaggaacaaacatataatgatagatcttggcactggtaacaacaataagattaactgggctctcaaagacaagcaggagtttattgacatcattgagactctatacagaggtgctaggaagggtaggggtttggtcattgcccccaaagactactccacaaagtacagatactaattcgttttaggatgcaaggctacttattttcatgggattttttaaaactttagactccataatatttttagggtttttttcaagtattagatctgcaatgaatctgtattgtcttttctgaaatgaaaa

SEQ ID NO: 3764 - DNA, 863 bp, Taxus baccata
ggagaaagaaaccctataatccgtgtttgagggtgatagcaggggttcttacaaagcggagagggggcgaggaaggcgaaaatcagttagaagatcagggttagggcaaggaaaacgaaagtcgaagaaaatgtcgtatttgctgccacatctgcactcgggatgggcggtggaccaggcgatactagcggaggaggagcggctggtggtgattcgtttcgggcatgactgggatgacacctgcatgcagatggatgaggtcctttcgagcgtggcggagtccattaaaaactttgcggtgatatacttggtagacatcaccgaggttccagatttcaacaccatgtacgagctctacgatccgtctacggtaatgtttttctttcgcaacaagcacataatgatagacctgggcaccggcaacaacaacaaaattaactgggctatgaaggacaagcaggagttcatcgacatcatagagaccgtctaccgcggtgcccgcaagggccgtggcctcgttattgctcccaaggactactccacgaaataccgctattaatgggaagatcctttggccccgagaaaggtttttccagtgatcctttatattcattagggttatctgaaatatcactgatagtttgtggggtaagggtaatgtaatttgaaatcatatgcatgaagccttcaggcgaatttatgtgatttctatatttttaaatgcatttatctagttattcatgaaaataatcttgaagatcatgttatgtgatttttttatatttttaatgcagctatgtacttataaccaaaaaaaaaaaaaaaaagtaaaactaactagacgttagaataccaactgactt

SEQ ID NO: 3765 - DNA, 604 bp, Vinca minor
gagagagagagaagaaacgatgtcgtacttgctgccgcaccttcactcagggtgggcggtggatcaggcaattctggccgaagaagaaagacttgtgataatccgcttcggccatgactgggacgaaacctgtatgcagatggacgaagtgttagcatcagttgccgacaccttaaagaactttgcagtgatatacttggtggatataactgaagtacctgattttaacacaatgtacgagttgtacgatccattaacaatcatgttcttctttaggaacaagcacattatgattgatcttggcactggaaacaacaataagatcaattgggctatgaaggacaaacaagaattcgttgacattgttgagactgtctaccgtggtgcaagaaaaggacgtggtctagttatagcccccaaagattactctaccaaataccgttactaaagcgtgctatttgtccaattgtcatttatcgggtacttgattttactcgtgtgataacactgctattgactgttggcattatactctatactgtaacatattccgatattctggataatattttaccattgtggtagccttttaagtatttctgtt

SEQ ID NO: 3766 - DNA, 868 bp, Gnetum gnemon
ccgacacgcgctaaccgtctcaaactcaacatcctaggcgcgctgtctttgcggaattcccctgttccacagctagggtttcagttccattagcagaagccgaaattcgggatcaagggtttcagtttcttcggaggcgcgaaaattcgattgcagtagaaacaagatgtcgtacttgctgccgcatcttcactcagggtgggctgtggaccaggcaattctgggcgaggaggagcgactggtgataatccgcttcggccatgactgggacgatacctgcatgcagatggacgaagttctctcttctgttgctgaaaccgtcaagaacttcgctgttatctacctcgtagacattacagaggttcccgatttcaacacgatgtacgagctctacgatccttccactgtcatgtttttttccgcaacaagcatattatgatcgatctcggaaccggtaacaataacaagatcaattgggctcttaaggacaagcaggagtttattgatattgtcgagactgtctaccgtggcgccaagaagggaagaggtctcgtcatcgcacctaaggattactccaccaagtaccgctactaggctttcgctgctagggtgtggtatgcctttttcgaatttcggattcgatgcgttgttaatgtatgcagtaaatgtgcgctgtgctctgccgtttggcggctttacttggtttaaggagtaatatgtttcagttgaaatatgatcttttgaaaagttacaaggcgtaatcagcggcctaagcttgtttgaagtttaacagattttgaaattctgaaaccgtgatttcgatttagattctcgcagatttgattttacgcgttttagctgttttcaa

SEQ ID NO: 3767 - DNA, 672 bp, Allium cepa
taaaattatagcttctctgtcattcacccacttccccaagcaacagcaagttttaagctctcacgatctctcaatttctttcagggccttaaagtagagcgagatgtcgtatttgctgccacatttgcactcaggatgggcggttgatcaggcaattttagcagaagaggagcgtctcgttgtcataagatttggccatgattgggatgaaacttgcatgcagatggatgaagtgctggcttcggttgcagaaacaataaagaactttgcagtgatatacctggtagatatcacagaggtaccagattttaacacaatgtatgaactgtacgatccatcaacgatcatgttcttttccgtaacaagcatatcatgatcgatttgggcactgggaacaacaataaataaactgggccatgaaggacaagcaggagttcattgatattgttgagactgtctttagaggtgcaaggaagggccgtggtcttgttattgctcccaaggattactccaccaagtaccgttattaatctgataatactccgtgcttccatattattttcttgtacctttatcaactatttgctttgtttgggagtaaattcttccactgaattttatcaacaatgttgtttgaatggaactaataaatatcaaacgtttacgagtgga

SEQ ID NO: 3768 - DNA, 440 bp, Aquilegia formosa
aaatgtcatacttagtaccacacttgcgctctggatgggtagtggaccaagcaattcttgccgaagaagaacgtcttgtcatcatccgttttggccatgattgggatgaaacttgtatgcagatggatgaggtgttggcttctgttgcggagactgtaaagaactttgctgttatctaccttgtagacatctctgaggttcctgacttcaacaccatgtatgagctctatgacccttctactgtcatgttctttttccggaacaagcacatgatgattgacctgggcactggaaacaacaacaaaatcaactgggctctcaaagataagcaagaattcattgacattgttgagactgtttatcgtggggccaagaagggccgtggtttggtgattgctccaaaagactactctacaaagtatcgctactaggcctttcct

SEQ ID NO: 3769 - DNA, 616 bp, Arnica chamissonis
tacttgctaccgcacttgcactccggctgggccgtcgatcaggcgattctcgccgaggaggagcgtctcgtcgttatccggttcggtcatgattgggacgaaacttgtatgcagatggatgaagtgctctcttcagttgcagagacattaaaaaactttgctgtaatatacttggtggacatcacagaagtacccgacttcaatacaatgtatgaactttatgacccgtcaactataatgttctttttcaggaacaaacatatcatgattgatcttggtactggtaacaacaataagatcaactgggccatgaaggacaaacaggagttcatagacattgttgaaactgtctaccgcggggcccggaaggggcgtggtttggtcatcgctcccaaagattactccaccaagtaccgttactaaactcacctgggtcagagtttctgtggatttgaaccgtgttttggaagacttaaactgggtttgacttttgcattgttataacattgtgtgattgtggtcttttgaaaccatgtttttagataaaaagtttgtgttaaactgtttcaaaatcggttaaaacatgttttagtgtttcaaacttcacaatttgttt

SEQ ID NO: 3770 - DNA, 977 bp, Ceratodon purpureus
aaaataacacactactttgggtggaggatccgcaattagggtttcacttcgccatctcttgctccgctctgttctcgctcttcatcttctacgccatcgctactgctgctgctcgccttacgccatgtcgtacctgctgccgcatctgcactccggatgggccgtcgaccaggccatcctcgccgaggaggagcgggccgtcgtcatccgcttcggccacgactgggacgagacttgcatgcagatggatgaggtgcttgcgtctgtggcagagacgataaagaattttgcagtcatataccttgttgatatttccgaggttccagatttcaacactatgtacgagctgtacgatccttgtacgataatgttcttcttccggaacaagcatatcatgatcgatcttgggacgggaaataacaacaagatcaactgggccttgaaggacaagcaggagttcattgatattgtggagaccgtatacaggggagcacggaaggggaggggtttggtggtatctccgaaggattattcgaccaagtatcgttattaaggtattggtcccctcttcgaggagttgcaggttatactcccgtggaggtacatatgcaattcttggctaccatggcttgatttgaaagtggcaacaccttctgtcttgataatgggggcaaagtgcatcaacttttgtaattacaacatatcgtttttcttgccagaggaaaaggatagctgcagctgcttagtttaaggagcacatatagaatattgtgaattgcgcctcgaggattcataaagtccgcctgtgattctatcttcgtctgattttatttttgtagtttttgtatacgcaatcagcaacaaaactgtggcatggctatgcttctcaagtagtccagacattttgtttcaaacaaagatctgttcaaggtgcaatacattttccctacatcattaaactccttgtgatatactta

SEQ ID NO: 3771 - DNA, 639 bp, Gossypium hirsutum
cggcgccggagtagcgtggcgttgcacgtggccgaacgcatcgtctataaattataaaccactaacatttcagaccgtttcttgttccaaattagggtttgatatcacaaattttgcgagaggaaaagcatttcatcgtcagccaaaaaaagggaattttagtcttcaggggaacgatcgaacgatgtcgtacctactaccacacctgcactcaggatgggccgtagatcaggccatcttggcagaggaagagcgtctcgtcgtcatccgattcggccacgactgggacgaaacttgcatgcagatggatgaggtgcttgcttctgtcgctgaaacaataaagaactttgctgtgatttatcttgtagacataacggaagtacctgattttaacacgatgtatgagctttacgatccatcaacagtgatgttctttttcagaaacaagcacattatgattgatcttggcactggtaataacaacaagattaactgggctctcaaggacaaacaggagttcatagacatcattgagactgtataccgtggggcaaggaaaggtcgtggtctggtaattgctttgaaagattacttgacaaagtaacgttactgagcattcttgcaacctgtagttgatca

SEQ ID NO: 3772 - DNA, 1134 bp, Physcomitrella patens
gtcgtcgtcgctgtcgactttgctgcttgcttgcttgctaagctcgagttagggtttggttttttccgaagtactactcttttcgccttgtgttttgtttgctccctgctgcccctcccctggttctgctcgaggttctcgacttcagtttcgtatttccagttaccgccgttgctgcagctatgtcgtaccttttgccgcatctgcactcgggatgggcggtcgaccaggccatcctggcggaggaggagcgcgctgtcgtcatccggtttggtcacgattgggatgagacttgcatgcagatggatgaagttcttgcttctgtggctgagacgatcaagaattttgctgttatatatcttgttgatatttcagaggtgccagatttcaacactatgtacgagctgtatgacccttgcacgataatgtttttcttccgcaataaacatattatgatcgatctcggtacgggaaataacaacaagatcaattgggctctgaaagacaagcaggagttcatcgacattgtggaaactgtgtatagaggagcgcgaaaggggaggggtctggtcgtctccccgaaggattactccaccaaatatcgttattagaatttttatttcactctgaggaaagcaatttgttactcggttgcaggtacatccgcatttcttgacctcagcagtctcatccatagcagcaacctgcgcctcagtgggaacgaagtacattattagttaaacttctaagtgtagagtaagttgaaaaatggagacccgcctagggccttgcgtggtcttccatatcttcataatgttgtcaaagaagtaacttgaatattgttcctgttttagttaactttgtggaattgttgtgtagaactttcctccctagagttgtgttctcattgggatgatgcaggtcgaagacgctcaatcctttagcattaccaactgaaatggatcaagggaaacctgcaggtttgggttcaatgtttccatttttatcctagcattcttgacatgtagtggcggaacttattgaacttctaaacaatgtttcaatgtatttcaataccaagaaataatatgtacccactgtgtaaatggtcacttgtggagcgtgtgtctacat

SEQ ID NO: 3773 - DNA, 799 bp, Pteridium aquilinum
gcttgtatatctcagaaaacacttgcccgctttcaacggcaggagctgtgtgtgcgtgcgcgtgtgtctgtgtgttttgtacgagaggatgtcgtaccttctgcctcatctgcactctggttgggcggtggatcaagccattcttggcgaagaggagcgtgctgtagtcatccgatttggccacgactgggatgaaacctgtatgcagatggacgaggttttggcgtcggttgcagagacaataaagaatttcgctgtaatttatctggtggatatcacagaagtacaggatttcaatacaatgtacgagttgtacgacccctgcacgatcatgtttttctttcgcaacaagcatatcatgatcgatttggggacgggaaacaacaacaagattaattgggccttgaaagacaagcaagagttcatcgacattgtggagacagtctacaggggggcaaggaaagggcgtggtctggtcatctcgcctaaggactactccacaaaatacagatactagaaagcttttgacaaaacaggactacaaacttgataaaaaggtttatgtagtgtcgtagacatgcatgggtggctcttgcccaaatgaattggccaatatttggaaagggtaatacccccttatggtatttgtgtgtggttattgtggttgggggggaaggatgcacactctcgggaaaaaaccatgattgaatgtatatgtctatatctgtgatggtgggctctaaatcttaagggaaggttagaggcgacctccttttgattttttgatctgaaaaaagaa

SEQ ID NO: 3774 - DNA, 702 bp, Pteridium aquilinum
acatctgcactccggatgggctgtagatcaggccatcctggcggaggaagagcgtctcgttgtcatccgattcggccacgactgggacgaaacctgcatgcagatggatgaagtgcttgcttcagttgccgaaacgataaagaactttgctgtgatttatcttgtggacataacagaagtgcctgattttaacacaatgtatgagctgtacgatccttccacggtcatgttcttcttcagaaacaagcatattatgattgatcttggcactggaaataacaacaagattaactgggctctcaaggacaagcaggagttcatagacattgttgagactgtataccgtggggcaaggaagggtcgtggtctagtaattgctccaaaagattactctactaagtaccgctactgagtattcttgcaagctgtagtggatcagatagatatatgatctacttttgcaaacttgatgcagagtatttcattagaaattatctggatgtgaatgtcattggcaatgattgcatgtatttggaagatgaaatttgaagcatttcttgtgtttatgatgcatgttaccggtatagcatcttgtgcttgtactacagacattcgagcgctgcactgctaccgaaaggtatggtatgtgaaagcatgaaattaaatatcaattctaatatatattggttcccataaaaagaa

SEQ ID NO: 3775 - DNA, 1263 bp, Artemisia annua
aatggcactcgaatgggtagtcctaggctacgcagcagcagcagaagccgtaatgatcctcctcctaaccctcccaggcctaaccccaatccgaaaaggcctcatctccgtcacatcttcccttctaaaacccttcctctcaatcgtccccttttgtttgttcctcctagctgacatctactggaaatacgaaaccagacctagctgtaacgactctgacaactgctctcctagtgagtttctaaggcaccagaaaagcatcatgaagagccagaggaacgcccttttgattgcgaccgctcttgttttttactggattttgtattctgttacgaagctggttgtgaaggtggatgtgttgagtgctaggattgagaagctcaagaataaggagtgattggtttgggaagagtttgtgagtttgcgggttttgtttcgatctgattaggttttgtgttttatgttttattgttggatgttggtttatttgaatttgaggctgtaatcgttttatgtgatcgtgttgttaaggcgaatgtaaacgtgttattcggatcttattaggttttgttttaattattcgagagagagaaaagaaaagtaggaaacgatgtcgtatttgctacagcacttgcacaacggatgggcggtggatcaagccatcctcgccgaggaagagcgtctcgtcgtcatccgcttcggtcatgattgggacgaaacttgtatgcagatggatgaagtgctttcttcagttgctgatacgttaaagaactttgctgttatatacttggttgacattactgaggtgcccgacttcaatacaatgtatgagctgtacgacccatctactgtcatgttcttcttcaggaacaagcatatcatgattgatcttggtactggtaacaacaacaagatcaactgggcaatgaaggacaagcaggagttcattgacattgttgaaacggtctaccgtggagccaggaagggacgtggtttggtcattgcacccaaagattactccaccaagtaccgttactaagctcattggtactgtggttttgaaccatatcttgaaagatgtaaaacctttgggacatctgtattgaactatgtaaaacttcgactggttgatgtgattgtggtaattgaaactatgtttgaaggtgtaacttcgctgctttaataattttgtatattcgattactttatattagagatgaaaaaaaaaaaaaaaaacatgtcggatctagaattagagacacg

SEQ ID NO: 3776 - DNA, 509 bp, Zostera marina
tttgccacatctgcattcgggatgggcggtcgatcaggccatccttgctgaggaggagcgcctcgtcgttatccgcttcggtcacgattgggatgagacgtgtatgcagatggatgaagtcctggcttctgttgcagaaacaattaagaattttgcagttatttatcttgtggacatcacagagattccagacttcaacactatgtatgagttgtatgacccatctactatcatgttcttcttccgcaataaacacattatgattgatcttggtactgggaacaacaacaagatcaactgggcaatgaaggacaaacaggaattcattgatatcgtggagactgtgtatcgtggcgcccgaaagggtcgtggtttagtcattgctcctaaggattattccaccaaataccgttactgaattctctaagctatgctatttccagagttctttaagcacatctgcaactgttatccaaagtttgcaagttgaaatatattattatttattc

SEQ ID NO: 3777 - DNA, 1337 bp, Marchantia polymorpha
ggcgcgtagagttctagagcggtagacgcttctggactcctcgtgcgcagtgcagcagacatcgtcgatcacgcatttgaccgggccgccgctgctgcgcatgactgcagttggaatcgagtcgtgtcgtcgaagctcttgctcgggggcactcactcggacgaggagcaagcgacgagcgtagcagcgagaagagttcagagaggcggaaggaggcagtattgtcggattgggaacctctgacaacgacataaagtggtgaggagaagtttgttcggtgtaagcgtgatcgcggaaggttgcgaggatgtcgtacttgctgccccatttgcattccggatgggctgtggatcaggccattatggccgaggaggagcgcgccgtggtcattagattcgggcacgattgggatgaaacctgtatgcagatggacgaagtgttggcgtcggttgccgagacaataaagaatcttgctgttatttatctggtggatatcactgaggtgcctgatttcaacacgatgtatgagttgtacgatccctgcacgattatgtttttcttcaggaacaagcacatcatgatcgatttgggcacgggaaacaataacaaaatcaattgggctctcaaggacaagcaggagttcatagacatcgtcgagaccgtgtacagaggtgctagaaagggacgcggtttggtggtttctcccaaagattattctacgaagtatcgctattgatgtggcaattcaagattgctgatcgctgtgtatgtcccggagatctcgcgctttgtaggaggccgtcaagagtttggtacagaagccgcggcgatagtatccgtgggcaatatactacttgaatcctcatatcgtcgccagcttcacggaagtggtataagtcttccagacaacatagccagcaaggctctatagttctatcagcgtaacaactccagtgaaagtcagagagagcacctggtcatatgacgagaaatttccatcatgacatctcatgaacaagttgacgtctatcagtgctggcttgttcgcaagtccatcatagtcaacagctgcagcatataaaccctaaattttcagtctgatgaaagtgattcaatttcattgactctttgccacctttatcgaattcctttccggagtttatttcattctcagtgttgagttttacattagcaccgtagtgagttatttacattgaggggtttttttggcactcgagaacagaatcgaacttggaccgtgagtggacacgttgcgggtgaataaggacaggacgctcagcatgccgactccacggtggccgatcaacatcacctta

SEQ ID NO: 3778 - DNA, 431 bp, Medicago truncatula
gatgtcctacttgcttccacacttgcactccggatgggctgttgatcaagccattctctgcgaagaagaacgactcgtcgttattcgcttcggccatgattgggatgacacttgcatgcagatggatgaagtgctggcatcagttgctgagaccatcaaaaattttgcggttatatacttggtggacattacagaggtgcctgattttaacaccatgtatgagttgtatgatccctgcacggttatgtttttctttaggaacaaacacattatgattgaccttggaacaggtaacaacaataagattaattgggctctcagagacaaacaagagttcattgatatcgttgaaactgtcttccatggtgcaaggaaaggacgtggtcttgtcatctctcccaaagattactctaccaaataccgctactaac

SEQ ID NO: 3779 - DNA, 540 bp, Brachypodium distachyon
gtttcccaactcggtcgtgctagatcgatctgtggatatcacgaatcaggcaggagaagccggcggagaagatgtcgtacctgctgccgcacctgcactccggatgggcggtggaccaggccatcatggccgagaacgagcgcctcgtcatgatccgcttcggccacgattgggacgagacctgcatgcagatggacgaggtgctggcaggggtggctgagaaaataaagaacttcgcggtaacctacctcgttgacatcactgaggttcccgacttcaacaccctgtacgagctctatgacccatcgacggtgatgttcttcttccgcaacaagcacatcatgattgatctcgggacgggaaacaacaacaagatcaactgggcgatgaaagacaagcatgagtttgttgacattgtagagaccgtctaccgaggagctcgtaagggtcgtggtctggcgattgctcccaaggattactccaccaaatatcgttactaagatgtgtttcaattctctctgtctgtttatgtgtaatttc

SEQ ID NO: 3780 - DNA, 735 bp, Epimedium sagittatum
catctgcactcaggttgggcggtggatcaagcgatcctagctgaggaagaacgccttgttgtcattcgtttcggccatgactgggacgaaacctgtatgcagatggatgaggtgttggcttcggttgctgagacaataaaaaactttgcagtgatctaccttgttgacatcacagaagtacctgatttcaacaccatgtatgagctgtatgacccttcaacagtcatgttctttttccgcaacaagcacatgatgattgatctgggtacaggaaacaacaataagatcaactgggccatgaaggacaaacaggaattcattgacatcattgagactgtctatcgtggcgccaggaagggccgtggtctggtgattgcccccaaagactattcgacgaagtatcgttactaggtctatctgcaaggtctgttgatcaaactctttggaactctaccatagaattgtactttttcaaagtatgcactgtctgaaactaaacttgtgaaagagaaataagcaactctcctgtgagcggtttgtttctcttgttatgtgaccaagaaggtattatgctaaggatgctcaaactttgtttaatcaaattatttctgtcttactaagatgagtaaataacgtcatcagcaagcatattgctaccgtctaaagagcataacacactaggtgtacactcctataatttcatccactcatcttagtaagacagaaataatttga

SEQ ID NO: 3781 - DNA, 554 bp, Zostera marina
ctgcattcaggatgggcggtggatcaggccatcctcgctgaggaggaacgcctcgtcgttatccgtttcggtcacgattgggatgagacgtgtatgcagatggatgaagtcctagcttctgttgcagaaacaattaagaattttgctgttatttatcttgtggacatctcagaagttccagacttcaacactatgtatgagttgtatgacccatcaactatcatgttcttcttccgcaataaacacattatgattgatcttggtactgggaacaacaataagatcaactgggcaatgaaggacaaacaggagttcattgatatcgtggagactgtatatcgtggcgccagaaagggtcgtggtttagtcattgctcctaaggattattccaccaaataccgttactgaattctaccgccactgttattcctaactttgctatttgaactcatatttaattcaaaataaactttttatgtaaaactgaaattgtcttttcaaatacaataacattttatttacaggtattacaatcggttatgattatattgtta

SEQ ID NO: 3782 - DNA, 487 bp, Brachypodium distachyon
gatgtcgtacctgctgccgcacctgcactccggatgggcggtggaccaggccatcatggccgagaacgagcgcctcgtcatgatccgcttcggccacgattgggatgagacctgcatgcagatggacgaggtgctggcaggggtggctgagaaaataaagaacttcgcggtaacctacctcgttgacatcactgaggttcccgacttcaacaccctgtacgagctctatgacccatcgacggtgatgttcttcttccgcaacaagcacatcatgattgatctcgggacgggaaacaacaacaagatcaactgggcgatgaaagacaagcatgattttgttgacattgtagagaccgtctaccgaggagctcgtaagggtcgtggtctggcgattgctcccaaggattactccaccaaatatcgttactaaggtgtgtttcaattctctctgtctgtttatgtgtgatttcgattactctgccagata

SEQ ID NO: 3783 - DNA, 696 bp, Senecio madagascariensis
gtgaatcaaacgatttcgtatttgctaccgcacttgcactccgggtgcgttgtgtatcaagccatcctcgccgaggaagagcgtctggtcgtcatccgtttcggccatgattgggacgaaacttgtatgcagatggatgaagtacttgcatctgttgctgagacgctaaagaactttgctgtgatctacctggttgacatcactgaagtgcctgatttcaatacgatgtacgagctttacgatccatcaacaatcatgttcttcttcaggaacaaacacatcatgattgatcttggtactggtaacaacaacaagatcaattgggcaatgaaggacaagcaggagttcatcgacattgttgagacagtgtaccgtggggcaaggaagggccgtggtttggtcattgctcctaaagactactcaactaaatatcgttactaaaaccattggcttctcatttggttttggattttaccattggcttatcatttgtaacaacagataaaactataaaactggcttttgtaaacctttgtttgtgtgctgatgtatggtcttttcgaacatgttaacaataagatctgtgaagtttgaaccattctgttttttttaaacgcttatatctcttctgcatgttttcttctgaaatgtcttggtaaccatattccattaatgaaactttgtaaggtttaatgt

SEQ ID NO: 3784 - DNA, 967 bp, Pinus pinaster
cccgagcgaaagttccgaacactattcactggtcggccgatctgaaaactttacttttatgtctataaaaatagagcgggcataccctaacggctcaaagagggacgccgggcagaggatcgagcgaggcaaaaatgtcgtacttgctaccccatttgcactctgggtgggcagtggatcaggccattctagccgaggaggagcgtctcgtcgtcattcgcttcggccatgactgggacgaaacatgtatgcagatggacgaagtgctgtcatctgttgcagaaaccatcaagaatttcgcagtgatatacctggtggacataacggaggtgcctgatttcaataccatgtacgaactgtatgacccgtctactgtcatgtttttcttccgcaataaacatataatgatagatttggggacggggaacaacaataaaatcaactgggctatgaaggacaagcaggaattcattgatatcattgagaccgtgtacagaggggccaggaagggcaggggtctggtaattgccccaaggattattctaccaagtaccgatactaggtagataacagaaattgtattctgtttcatatgctgaactgggttttctttaactttatggatggatggaacaaagcgggtagggtttctttgggactgaaccccgcggagtcaaaattaacacgtaaacctaagtagatatgctgttatagacacataaattgttgaaatagtctggttatttgtgtttggcctataaaatgattcattactagaattttatttgatgtatagcatactattgtctattgtaatggtttattatgcttataatccaattatgcattgggtcacgaaattctgataaattataataagtactaagatccctatggcatatttctactatcgtggatatgtagagagataggccatggtttcccggcgatacaaaaaaaaaaaaaa

SEQ ID NO: 3785 - DNA, 864 bp, Brachypodium distachyon
atggattttcttccacagataccgtcaacattaagctggtggtttgaattagaatatcaaaagattttgctaaatcaaaaatactttaatctaaacaatgataagatatggattttacctgctactcattgccgaatgattatgcatcagctgcacatgaatcaatcatacttgcaactacacaatctgcgtgtaagaggcgccggggcggcggccccggatctcgtctgcggtgggcgtccgagcaaggcgcagcgggggctgggtgcccggtggctggggcagcggcgcttgcattggctggatctggcgcggggctggcggggagatggtggtgcggctagttgtgacggcgtgcgagtgcccggcggtaggtggttgtacgggcggcggcggcgcttaaccaggagaagcagcgggcagcgggcggagaagatgtcgtacctgctgccgcacctgcactccggatgggcggtggaccaggccatcatggccgagaacgagcgcctcgtcatgatccgcttcggccacgattgggacgagacctccatgcagatggacgaggtgctggcaggggtggctgagaaaataaagaacttcgcggtaacctacctcgttgacatcactgaggttcccgacttcaacaccctgtacgagctctatgacccatcgacggtgatgttcttcttccgcaacaagcacatcatgattgatctcgggacgggaaacaacaacaagatcaactgggcgatgaaagacaagcatgagtttgttgacattgtagagaccgtctatcgaggagctcgtaagggtcgtggtctggcgattgcttccaaggattactccaccaaatatcgttactaa

SEQ ID NO: 3786 - DNA, 655 bp, Brassica rapa
acgagacgatgtcgtaccttctacctcacttgcattccgggcgggctgttgatcaggcgattctagccgcggaagagcgtctcgtggtcatacgtttcggccatgattgggatgaaacctgtatgcagatggatgaggtgttggcatcagttgctgagacgataaagaactttgcggttatatatctggtggacataagtgaggttccagacttcaacaccatgtacgagctctacgatcctttaaccatcatgttcttcttcaggaacaaagacattatgatcgatctcgggacgggtacaacaacaagattaattgggctatgaaggacaaacatgagtttattgatatcattgagaccgtcttccgtggtgcaaggaagggtcgtaggctcgtgattgctcctaaagattactccaccaaataccgctactaaccccaacacattggagtttgtttaagaaacattgggtcaaaaaactctttcatgttgagtggttatggtcagttgaaatatcctatgaacttgttccatatatgccttgatgatttgtgattcatgcttgcttactcttttcggctgtttgtcatttatgtattgcagtatcttcgaacatgaatcactgaaatgaatgagtttatgtttaacgtgtat

SEQ ID NO: 3787 - DNA, 465 bp, Brachypodium distachyon
cgggcgcggcaatgtcgatctggcgagcaggagaagatgtcgtacctgctgccgcacctgcactccggatgggcggtggaccaggccatcatggccgagaacgagcgcctcgtcatgatccgcttcggccacgattgggacgagacctgcatgcagatggacgaagtgctggcaggggtggctgacaaaataaacaacttcgcggtaacctacctcgttgacatcactgaggttcccgacttcaacaccctgtacgagctctatgacccatcgacggtgatgttcttcttccgcaacaagcacatcatgattgatctcgggacgggaaacaacaacaagatcaactgggcgatgaaagacaagcatgagtttcttgacattgtagagaccgtctaccgaggagctcgtaagggtcgtggtctggcgattgctcccaaggatcactccaccaaatatcgttactaa

SEQ ID NO: 3788 - DNA, 596 bp, Carthamus tinctorius
cgggggagaggatgtcgtatttgaaccgcatttgcactcagggtgggccgtcgatcaagccatcctcgccgaggaggaacgtcccgttgtcatccgattcggccacgattgggatgaaacttgtatgcagatggacgaagtacttgcctcagttgccgagacgttaaagaactttgcggtgatatacctggtcgatatcaccgaagtgccggacttcaacacgatgtacaatttatacgacccgtcaaccataatgttcttctttaggaacaagcacatcatgatcgatcttggtacgggtaacaacaacaagatcaactgggcgatgaaggacaaacaggagttcatagacatcgttgagaccgtgtaccgtggggcccggaagggtcgtggtttggtcattgcacctaaagactattcgaccaagtaccgttactaaaaccctgaaccgtgtggaattattaaaaccgattaaaacccttttgaaatcgatggtgttgttatgtgtttcattggatagggttcacttttgcaccttatgaatatgtttgtgttttatgttgaacgccaccggggtgtgatgttattttctattc

SEQ ID NO: 3789 - DNA, 802 bp, Arachis hypogaea
cgctgagaatatgcaaggctgagagagctgtttataacgaacttctgtgaagcgcgcttctagacacttctgttttctgttggcctcttcttatatacgcgagtcccctttatatctatctatatagagatttagagaagaagaagaagaagaagtaggaggattgcgatttgggagggaagtgaagagagaagaaaggatgtcgtacttgctgccgcacttgcactccggttgggcggtggatcaggccattctctccgaggaagaacgcgttgtggtcatccgcttcggccatgactgggacgacacctgcatgcaggttgctgatgggaagcttttaaattaagagatggatgaagtgctggcggcggttgcggagaccataaagagttttgcggtgatatacctggtggacatcacggaggtgccggatttcaacaccatgtacgagctctatgatccatgcacagtcatgttcttcttcaggaacaagcacatcatgatcgatcttggcaccggtaacaacaacaagatcaattgggcactcaaggataagcaggagttcattgacatcgttgagactgtgtacaggggtgccaggaagggacgtggtcttgttatttctcctaaggattactccaccaagtaccgctactgattgctacttgttcttctctttgatttcatgcgcttgaaaatctttattctgttattgtaaacccttaactcattagccttgtatattgattagctgaatacaacaacaaacaacaacaacaaagccttgtcccactaagtgggg

SEQ ID NO: 3790 - DNA, 1431 bp, Volvox carteri
gtgagactgagcatcgtcgccatgcattgactttcaaaggcaagtggcgctgtggcggccaaattgatcccggtgtttgagcaagccggttattaagcttgctgaactgctcacaactgaacattttaaaaaaatcaaggaaaccccatcaaattactccccatcacagttccagccctacgcggctggggcttgaggcagcattccgggctggacgcaaggaaaggagcgcttttgaaactagtttggcagtggaaagatgtcatacctgctgccccacttgcatagtgggtatgcagtggaccaagcaatccttgcagaagaggatcgtgtcgtgattatccgctttggacatgattgggagcccaactgcatgcagatggacgaggtccttgcttcagtctctgaccagatcaagaactttgcggtaatctatttggttgacattactgaggtcccagacttcaacaccatgtacgagctctacgatccgtgcacaattatgttcttcttcaggaacaagcacatcatgattgacttgggcacgggtaataacaacaagattaactgggcgatgactgataagcaggaattcatcgacatagtggaagtggtgtacaggggggcgcgaaaggggcgtggtctggtggtgtcaccaaaggactactctactaagtaccggtattaactgtttacgtttgttgactttgggaggagccaagacgcatatgcgcgcagctgcgaggacggtctggtttcgatggggggacggtggagtgtcgacgggtgggcaggccacgcacatattccgatgatatgtgcaatgcatccatgggaagtgtgcaccttccttccttgggatgccagccgcgagtagggttgctccatacttcaacgataactcgggcgaccgattaatgtggtgtcagttgtctggcgtagctgattagtgtggcctgttacttcagtagcgcttcgtcacattttttaaaatctacaaaagcgataggtcatggatgctctctctttgggttacctacacttgtcatggtggggagggtgtcatatagagtcgcagatggatacgaacgtcagcgtcggtactctgaacgccgccgtatcttatagagcaggagacgaaatcacgggattattgtggaggccatgtgtcgcctctgttacgtaagccagctatcaacacctgccctcattggcatggatggtgtgagtgtcgccttgggagtgtacggtgcacgcctttccagtacagggttgacgcgattcggcagctcccaggttaggctaacggaggattgctgccacgaggttacgctgccgatgtggcctgccataaatttcggtttcccgctacattgccgtttttttgaggactacgacggtagcgacatgaaaatgcaacttgccagtgcc

SEQ ID NO: 3791 - DNA, 437 bp, Cirsium arvense
atctccgatatccataatcgccattggagcaccttcgtttctcgagagagaagatgtcgtacctgctaccgcacttgcactccggctgggccgtcgatcaggcgatcctcgccgaggaggagcgtctcgtcgtcatccgattcggccatgattgggacgaaacttgcatgcagatggacgaagtgcttgcttcagttgccgaaacgataaagaactttgccgtgatatacttggtggacatcacggaggtacccgacttcaatacaatgtacgagctttacgacccatctaccgtgatgttctttttcaggaataagcacatcatgatcgatctgggtaccggtaacaacaataagatcaattgggcaatgaaggacaagcaggagttcatagacatcgttgaaaccgtctaccgtggggcccgcaagggccgtggt

SEQ ID NO: 3792 - DNA, 991 bp, Mesostigma viride
  misc_feature (105)..(105): n is a, c, g, or t
  misc_feature (113)..(113): n is a, c, g, or t
  misc_feature (860)..(860): n is a, c, g, or t
gatcagtgagagacgtgataaacctcgtgtcacacgtatatgcttatttgttcatgttaatcagtaggtccagcttctctacctgttactcgtacgctgtacgcnaccttccnagcaatatctcacgccagtgagctgcaagctgagggcaattgtgcatttgtacgctaatatcacgtacggctcggccagcaaatggcaagctgattaaaggaagtaggaaaaaaaaggaaaacattcgtttgactagcgggaaatgtcctaccttctgcctcatcttcattccggatgggccgttgaccaggcgattttatcagaagaggaccgagtcgtcgttatccggtttgggcatgattgggatgaaacgtgcatgcgcatggacgaggttcttgctggcgtggcggatgtcataaagaattttgctgttatctactgcgtagacaccacagagattcccgatttcaacaccatgtatgagctgtacgacccgtgcacggtcatgttcttcttccggaacaagcacatgatgatcgacctcggcaccggcaacaacaacaagatcaactgggcgttcaccgataaacaggaattcatcgacattgtggagacggtctaccgtggggcgcgcaaagggcggggtctggtcgtctcacccaaggattattcaacgaagtaccgctactagggcaaccggagctgtggcggctggaccatacaccggacgacttctaccatccgcattgtctatttgcggatgttgtacaagtatgttgtcatctgcagatattatgtgcagaaaactgagggagcacggacttcgtactttgagtttttttttccaaatctgagcaagaggatgnagtgatgtgtttctaaaaggtctcgacactgggacagccggacttgacctgccatggacatcaagctgtgcaaatgcaaggcccgctctgactcacatatataaattacaaaagtgctttccgtctgctgt

SEQ ID NO: 3793 - DNA, 1428 bp, Volvox carteri
agactgagcatcgtcgccatgcattgactttcaaaggcaagtggcgctgtggcggccaaattgatcccggtgtttgagcaagccggttattaagcttgctgaactgctcacaactgaacattttaaaaaaatcaaggaaaccccatcaaattactccccatcacagttccagccctacgcggctggggcttgaggcagcattccgggctggacgcaaggaaaggagcgcttttgaaactagtttggcagtggaaagatgtcatacctgctgccccacttgcatagtgggtatgcagtggaccaagcaatccttgcagaagaggatcgtgtcgtgattatccgctttggacatgattgggagcccaactgcatgcagatggacgaggtccttgcttcagtctctgaccagatcaagaactttgcggtaatctatttggttgacattactgaggtcccagacttcaacaccatgtacgagctctacgatccgtgcacaattatgttcttcttcaggaacaagcacatcatgattgacttgggcacgggtaataacaacaagattaactgggcgatgactgataagcaggaattcatcgacatagtggaagtggtgtacaggggggcgcgaaaggggcgtggtctggtggtgtcaccaaaggactactctactaagtaccggtattaactgtttacgtttgttgactttgggaggagccaagacgcatatgcgcgcagctgcgaggacggtctggtttcgatggggggacggtggagtgtcgacgggtgggcaggccacgcacatattccgatgatatgtgcaatgcatccatgggaagtgtgcaccttccttccttgggatgccagccgcgagtagggttgctccatacttcaacgataactcgggcgaccgattaatgtggtgtcagttgtctggcgtagctgattagtgtggcctgttacttcagtagcgcttcgtcacattttttaaaatctacaaaagcgataggtcatggatgctctctctttgggttacctacacttgtcatggtggggagggtgtcatatagagtcgcagatggatacgaacgtcagcgtcggtactctgaacgccgccgtatcttatagagcaggagacgaaatcacgggattattgtggaggccatgtgtcgcctctgttacgtaagccagctatcaacacctgccctcattggcatggatggtgtgagtgtcgccttgggagtgtacggtgcacgcctttccagtacagggttgacgcgattcggcagctcccaggttaggctaacggaggattgctgccacgaggttacgctgccgatgtggcctgccataaatttcggtttcccgctacattgccgtttttttgaggactacgacggtagcgacatgaaaatgcaacttgccagtgcc

SEQ ID NO: 3794 - DNA, 500 bp, Cirsium arvense
tcgtcggagatgtcgtacttgctaccgcacttgcactcggtgggctgtcgatcaggcgatcctcgccgaggaggaacgtctcgtcgttatccggtttggccatgactgggacgaaacttgcatgcagatggacgaagtgcttgcttcagttgcggaaacaataaaaaactttgccgtaatatacttagtggacatcacggaggtacccgacttcaatacaatgtacgagctttacgatccgtctactgtaatgttcttttttaggaacaagcacatcatgatcgatcttggtacgggtaacaacaataagatcaattgggcaatgaaggacaagcaagagtttatagatatcgttgaaacggtttaccgtggggcccgcaagggccgtggtttggtcattgcacccaaagattactcgactaaataccgttactaacggtatatgtggttctgtggactcgaaccatgtattaaaagagacaaaaagggttgcggtttgt

SEQ ID NO: 3795 - DNA, 476 bp, Medicago truncatula
agagaaaaaggatgtcctacttgcttccacacttgcactccggatgggctgttgatcaagccattctctgcgaagaagaacgactcgtcgttattcgcttcggccatgattgggatgacacttgcatgcaggtacgtgcatacttgtaactcttcagatggatgaagtgctggcatcagttgctgagaccatcaaaaattttgcggttatatacttggtggacattacagaggtgcctgattttaacaccatgtatgagttgtatgatccctgcacggttatgtttttctttaggaacaaacacattatgattgaccttggaacaggtaacaacaataagattaattgggctctcagagacaaacaagagttcattgatatcgttgaaactgtcttccatggtgcaaggaaaggacgtggtcttgtcatctctcccaaagattactctaccaaataccgctactaactttgtgctt

SEQ ID NO: 3796 - DNA, 572 bp, Glycine max
gacaagagagattagattagattacaatcaaatcagtttgagggaaggaattatgtcatacttgctacctcatttgcactccgaagaagaacgagttgttgtcattcgcttcggtcatgattgggatgacacctgcatgcagatggatgaagtgctggcatcggttgctgaaaagataaaaaacttcgcagtgatttatcttgtggatatcactgaggtgccggatttcaacaccatgtacgagttgtatgagccgtgcaccgttatgttcttttttaggaacaagcatattatgatagaccttggaaccggaaacaacaataagatcaattgggcactcaaagacaagcaagagttcattgatattgtcgaaacagtgtaccgtggtgcaaggaagggacgtggtctagtcatttctcccaaagattactctaccaagtaccgctactgagttgctttgcttacttaccctgcactgcaatttattaaattaaccattgtaacattgactctataatatttcattggctttcactacttgctgagcttgtcaccacaatccctaatacctg

SEQ ID NO: 3797 - DNA, 539 bp, Selaginella moellendorffii
cccacctccactccggctatgttgtggatcaagcgatcctcacggaggacgagcgcgtcgtggtgattcgcttcggccacgattgggacgagacgtgtatgcagatggacgaggtgctggccaatgtcgcggagccgctcaagaatttcgccgtgatctacctggtggacatcaccgaggtcccggatttcaacaccatgtacgagctctacgatccctgtactgtgatgttcttcttccgcaacaagcacatcatgatcgaccttggcaccggcaacaacaacaagatcaactgggcgctcaaggacaagcaggagttcatcgacattgtggagactgtctaccgcggcgccaggaaaggtcgaggtctcgttgtttctcccaaggattattccacgaagtaccgctactaagaaggaacaaaagaacaaaacaagaacaagatgacttttcaagcagcagtcccgagcttggaagatcttagttctatctagtattggaaaaggtatactcttttctaatagaacagacgacttaat

SEQ ID NO: 3798 - DNA, 643 bp, Capsicum annuum
tcagcatagtagtgcagccaaaatcaagaaagtcgaaaaagagggataaggatgtcatatttgttgccacatcttcattcaggatgggcagtggatcaagctatccttgctgaagaagaacgcctggttattattcgctttggtcatgattgggatgatacttgtatgcagatggacgaggtgctgtcttcggttgcagagacgatcaagaactttgctgtgatttacctggtcgatatcactgaggtccctgatttcaacacgatgtacgagctgtatgatccatcaaccgtcatgttcttcttcaggaacaagcacattatgattgatcttggcaccgggaacaacaacaagatcaactgggcacttaaggataaacaggagttcatcgatattgttagaagacagtgtaatacgcggtgcaagaaagggtcgtggtttagttattgcacaaaagattactctaccaagtacagatactaagcatatatatttgtacatgctgttacttggttgctttaatatgttgtacgaactgattgacatgtaaaaaattgccatgtatgaattacgaggagcttcttgatgaggcttgggttctttttctctgctacaactgcagacaattaccatctcttttgct

SEQ ID NO: 3799 - DNA, 1068 bp, Cannabis sativa
cacaacaataacccaaaacgtaaattaaaaaaatgctatatggtaatctcccattaaaaacaccacgatttctttttctctctctttctcctcgacgaaaaaaccagaccacttctacggctctaccattcttcttcttcgattcgattcccttcgtcttcttcttcgattcgatacccacttgctgatctactaccagttggtgctctacattcattgatttattattaacacaaccacaagagagagatgtcgtacttgcttccacatttgcactctggatgggctgttgatcagtccatcctcgctgaggaagagcgccttgtcatcatccgatttggccacgactgggatgagacctgtatgcagatggatgaagttttggcatcagttgctgagacaataaaaaactttgctgtgatatacccccccccccccctctacggtcatgtttttcttcaggaacaagcacattatgatcgatctcggaactggaaacaataataagatcaactgggcccttaaggacaaacaagagttcattgacattgtcgagactgtgtaccgcggagctaggaaaggacggggtcttgtgattgctcccaaggattactctaccaagtatcgctactaagctcttatgcaaatctataaatatttgtggttatatttgttagaattcactgtaacttgtttctctaagaatctgtcgagtttctcagagatttatttctctcaaaagtctaaagtcttatgttaactatttggacgcttagtgcgatgtccagaagaatgaaatacaatattacaacttgattgaatggtgtgttagtacataactacatattcttatcttctaatgtgttaaattatatgaatttcacttgaatttggtttttgagcacagttatcactaggactgaacattttggctgggattgactcggacccggccaacctgcgcagacccgattcaaccaacccggtcaattgagaaaacccgttccctagtggcgggtcgggtctaagccggtcaattctttcgggtgggtttgggtctaatttttt

SEQ ID NO: 3800 - DNA, 576 bp, Trifolium pratense
caggcaatcctcgccgaggaagaacgtctcgttgtcatccgtttcggtcacgattgggatgaaacttgcatgcagatggatgaggtgctcgcatcggttgcagagacaataaaaaactttgctgtgatataccttgtggacatcacagaggtacctgatttcaacactatgtatgagctgtatgacccttccacagttatgttcttctttaggaacaagcacatcatgatcgaccttggcaccggaaacaacaacaagatcaattgggctatgaaggacaaacaagaattcattgacatcattgagactgtctacagaggtgcaaggaagggccgtggtcttgtcattgctcccaaagattactccaccaagtaccgttactagtatatatcaatctctagtgggatatgtgtaatttgaactctattttcattctcgtacaaaacctacctcatctggttcaccgtttattaatgtgtaactgtcactaaactatcagtctacacacctacttgtctgtcattttattcggaactgtaactgctatactcgtgagactgtgactgtgtaacatgc

SEQ ID NO: 3801 - DNA, 552 bp, Avena sativa
ggccatcctcgcggaggaggagcgcctcgtcatgatccgcttcggccacgactgggacgagacctgcatgcagatggatgaagtgctggcaggggtggctgagaccataaagaactttgcggtaatctacctcgttgatatcactgaggttcctgacttcaataccatgtatgagctgtacgacccgtcaacagtgatgttctttttccgcaacaagcacatcatgattgatctcggaacgggaaacaataacaagatcaactgggcgatgaaagacaagcaggagtttgtcgacattgtggagactgtctacagaggagcccgtaagggtcgcggtctggtgattgctcccaaggactactccacaaaatatcgttactgagctttgtgtgtctgtctgtcccatatgtgtatctggcctactaggttcggcatgatgccagactgccagcatgtaacaggtcctgtccatcaactttcagaatgttgtgtaactaaatgtctgtatcttgaatattgatatgtcataataaacaggtaatccttggaaca

SEQ ID NO: 3802 - DNA, 449 bp, Aquilegia formosa
tctgctggtacaattgcaccatgtcgtacttagttaaacacttgaacacgggatgggaagtggatcaagaaattgttcgagaagaagaacgtctagtaataatccgttttgggcatgattgggatacaacttgtatgcagatggatgaggtgttggtttctgttgcagaaactataaagaactttgctgtaacctaccttgtggacatctctaaggttcctgattttaacaccatgtacgagctgtatgacccttgtactgtcatgttcttttatcgcaacaagcatattttgattgacctgggcactggaaacaacaataagataaactgggctctcaacaacaagcaggaattcatcgacattgttgagacggtttttcgcggggctaggaagggtcgtggtttggtgatatctccgaaagattactctaccaagtatcgatactag

SEQ ID NO: 3803 - DNA, 1264 bp, Chlamydomonas reinhardtii
ctcttgcctacgtattcttacatctttggacaatagtttgacagccttgccgctgaaattggccagtttgggttctcgttcttgctctgaccgccggcttacgtcgtgtgctattgcatatatcaaacaatacaagtcacaagctttgtaaacaagggcgctcctcaacgcggacggcgggcgtaggcgcagcagcacagcagcatctggaaactcagcgtgggcggggcgtcgctgcggggtgcacattccagcagaaccaccgcttagctcactagcacaacaaagatgtcgtacctgctgccccacttgcgcagcggctatgcggtggatcaggccatcctggcggaggaggaccgtgtggtcatcatccgcttcgggcacgactgggagcccaactgcatgcagatggacgaggtgctggctggcgtggcggaccagatcaagaacttcgcgtgcacctatctggtggacatctccgaggtgcccgacttcaacaccatgtacgagctgtacgacccgtgcaccatcatgttcttcttcaggaataagcacattatgattgatctgggcacgggtaacaacaacaagatcaactggcccatgacagacaagcaagagttcatcgacattgtggaggtggtgtaccgcggcgcgcgtaaggggcgaggtctggtcgtgtcgccaaaggactactcgaccaagtaccgctactgaggcagagacggcccgtggcgggcggcggggcgcctcgcacggtgcgagggtttgggttgcggcagcgggtggcgggcggtcaggtgcctggcgcggtatgcggtcgatttgcggtgcggtatagacagggctatgggttgtggatttgctttggcgcaggacggagcagttttggtgtgatgtgagtcatactatgtgtgagcccgggcacaggctaccagcagagaaaggggcaggatgggggagtggcagacgtggaaaggcggggcggttagtctgagtggtgcgatgactgggcactccaactttgtccaaagtgcaggccggcttgtaacccggtaaggtattgcaatttccgttcgattgggagctgcatgaacggcaacgcgttgcggcgttgggggcgacgacatgcacatgccgcaaggcaaggtttcgaagcccggaacaggagcccagtgtcacataacaagtaatatctacgcgtgctcaatgctacttcgtgtgcgtggtgtctgtggcgctgagcgtctgtaacttactccaa

SEQ ID NO: 3804 - DNA, 818 bp, Pinus pinaster
ctataatattagagcgggcataccctaacgtcttaaagagagacgccgggcagaagatcgagcgagcaaaaatgtcgtacttgctaccccatttgcactccggttgggctgtggatcaggccattctagccgaggaggagcgtctcgtcgtcattcgcttcggccatgactgggacgaaacatgtatgcagatggacgaagtgctgtcatctgttgcagaaacaatcaagaatttcgcagtgatatacctggtggacataacggaggtgcctgatttcaacaccatgtacgaactgtatgacccgtctactgtcatgtttttcttccgcaataagcatataatgatagatttggggacggggaacaacaataaaatcaactgggctatgaaagacaagcaggagttcattgatattattgagaccgtgtacagggggccaggaagggcaggggtctggtcattgcccccaaggattattctaccaagtaccgatactaggtagataacagcaattgtattctatttcatatgctgaactggattttttttaattttatggatggatggaacaaagcgggtcgggtttctttgggaccgaaccccgctgagtcaaaatgaacccgtaaagctaagtggatatcctgttatagacacataaattgttgaaatagtctggttatttgtctttggcctatgaaatggttcattgctagaattttatttaatatgtagcatactattgtttgttgtaatcgtttattatgcttataatccaattatgcattgggtcaccgaattctgataaattatagtaagt

SEQ ID NO: 3805 - DNA, 517 bp, Papaver somniferum
cgtcagaggaagaacgacttgttgtcattcgattcggccatgactgggatgaaacctgcatgcagatggatgaagtattggcttcagttgcagagacgataaagaattttgctgtgatctatctagtcgacattacagaggttccggacttcaataccatgtatgaactctatgacccttcaacagtcatgttttttttccgtaacaagcacatcatgattgatctgggaactggaaacaacaacaagatcaactgggccctcaaggataagcaggaattcatcgacatcatcgagaccgtctatcgcggggccaggaagggccgtggtctagtgattgctcctaaagactactccaccaagtaccgttactagctctttttactgttcgacagttatttctatcaactctcagagactctgtaatactcttaaatccaatgcttgggcttaagctgcctcaaactgcttaacaaatgattgtgaactattcaagctgtgggtaaattgtgaaaata

SEQ ID NO: 3806 - DNA, 768 bp, Picea glauca
agcttcccaattgaagctaaccctagttactggctagtctacgatttgcaatttactgtatacaagtctctttttactgggatattcgtgcatttttttgtgaggctcgtcgacactgaaaacgcatcatgtcgtacatgctcccgcatctccacaatggctggcaggtcgaccaggcgatcctctctgaagaggaccgggtgttggtgatccgttttggtcacgattgggatcccacatgcatgaaaatggacgaagttctgtacagcattgccgagaaggttaagaactttgcagtgatttacttggtggacatcacagaggtgcccgacttcaacaagatgtacgagttgtacgacccgtgcacggtcatgttcttcttcaggaacaagcacatcatgattgatttgggcacgggcaacaacaacaagatcaactggaccatggaggacaagcaggagatgatagacattgtcgagaccgtgtacaggggagcgagaaaaggaagaggtcttgtagtttcaccaaaggactactctacaaaatacagatattgattgttttgttttggatttttatcatggactttatttgtgtttccttgttgaatttttttgggacaaaagactacatgtaagaatttgttttgcatctatgcagtttgtcagttaccccaacacctccatcgcaacaaattaaagcaggccaatattcttattctgtgaataaacattcggcatgtgatgttggttttggaacataataaat

SEQ ID NO: 3807 - DNA, 490 bp, Silene vulgaris
gaacgactcgtcatcatccgctttggccacgactgggatgaaacttgtatgcagatggatgaagtgctggcctcggtggcggagacaataaagaactttgctgtgatttaccttgtggacataacagaggtgcctgatttcaacaccatgtatgagctttacgacccgtcaacaatcatgttctttttcaggaacaaacacataatgatagaccttgggactgggaacaacaacaagatcaactgggccctcaaggacaagcaggagttcatagacatagttgagactgtgtatcgtggtgcgcgcaagggccgaggtcttgtgatagcaccaaaggattactccaccaagtaccgctactaaactaagatgcatttcataccttctttaggtcgacttcacccattcatctgggtggtggaactcgtaccagtttgtgtagtatcttaattcacaagcctggatattgtaaacatgaggatggtttact

SEQ ID NO: 3808 - DNA, 429 bp, Ostreococcus lucimarinus
atgtcttaccttcttccccatctccgcaacgggtgggccgtcgaccaggcgatcttgagcgaagaggaccgcgtcgtggtcattcgtttcggttccgacgccgacgacacgtgcatgcgcatggacgagaccttagcgggggtggcggataagattaaaaactttgccatcatatacttggtggacatctcggaggtgcccgattttaacgccatgtacgagctgtacgacccgtgcacggtgatgttcttcttccggaacaagcacatacagatcgatctcgggacggggaacaacaacaaggtgaactgggcgatggacgataagcaggagttcatcgacatcgtggagacggtgtacacgggcgcgcgcaaggggcggggtttggtgatctctccgagggattactcgacgaaatatcgatactag

SEQ ID NO: 3809 - DNA, 540 bp, Scabiosa columbaria
ggtgcatgagttgaagtaattgccatcagcgcgtgagggagacgcaataattgtgtggtgagaagagatagcaggttcgagaagttttagagttcttcttcttcttcttctgtattcaaatactccattgaagtgtttgtaccacaaacctagagagagaaagagaaagagaaagagagagagatgtcatacttgctaccacatttgcattcaggatgggcagtggatcaagctattctcgctgaggaggaacgtctcgttgtcatccgtttcggtcacgattgggacgaaacttgtatgcagatggacgaagttcttgcatcagttgcagagacgataaagaactttgctgtgatatacctagtggacataacagaggtgccggacttcaatacaatgtatgaactttatgatccatcaacagtgatgttctttttcaggaacaaacacataatgattgatcttggaacgggtaacaacaacaagatcaactgggctctcaaggacaagcaggaattcattgacattgttgaaactgtc

SEQ ID NO: 3810 - DNA, 645 bp, Picea glauca
ttgtggccaagcggttgagaggagttagcagcatagctaacgttagtcgtcggtctttaaacgcagaagtgtcttaaaagagcgtctcctaccttggtgaagatgtcttacatgctccaacatctacacaatggctggcaagtggaccaggccattctctcagaggaggaccgtgcgctggtcattaggttcggacacgactgggacccaacttgtatgaaaatggatgaagtgctgtacagtattgctgaaaaggtgaaaaactttgccgtcatatacctggtcgacatcacagaggtgccagattttaacaagatgtacgagttgtacgatccttgtacagtcatgttcttcttcaggaccaagcacatcatgattgatttgggcacaggcaacaacaataagatcaactggactatggaggacaagcaggagatgatagacattgttgaaacggtatacagaggagcaagaaaaggaagaggtcttgttgtctctcccaaagactattccactaaatacagatactgacctttcttcatcatcatcaggaacaggagagtctggacttttttcacccattttcattgtcattttattaccatttctgaccattattgtatttgacttttatctaaataaacg

SEQ ID NO: 3811 - DNA, 687 bp, Adiantum capillus-veneris
gaagacgggctgagacgggtcacggctccaagaaaaattttgcacgagtgcaccttgttgaaggctatgtagtctttatcacaggcacgcatctggggcttgtcagaatcccgctgaaaagatcaatgactcgattgtctcaaagagagagagagagagagagagggcacaatcgagagctccaaaccatgctccagatctcctgccgcgagtcctggggagtttgacctagcagggccgcacatcatcagcgcctcacaggatttgtgcatcagtgtttcatcgcattgctgtagaggagaagatgtcgtatctgctgccccatctccactttggctgggccgtagatcaagcattcttggtgaagaagagcgtgtcgtcgtcatccgttttggccatgattgggatgagacttgtatgcagatggatgaggtactggcctcagttgcagaaacaataaagaactttgcagtgatatatcttgtggacatcaccgaaataccagatttcaatacaatgtatgaattgtatgatccttgcactgtcatgtttttcttctgcaacaaacatatcatgatcgatttgggaacaggaaacaacaacaaaattaattgggccttgaaagataagcaagagttcatcaacattgttgagacagattacagaggtgcgaggaaagggcgtggt

SEQ ID NO: 3812 - DNA, 774 bp, Rhizophora mangle
gctaaagctgaaatctcaactacttcgttgggcagagagggaagagaagaaggaggcggaagggagggatgtgtacctgccgccacatctgcactcaggatgggcggtggatcaggctatcctggcggaggaagagcggctcgttgtcatccgctttggccacgactgggacgaaacctgcatgcagatggatgaagtgctggcatcagtggctgagacaataaagaactttgcagttatataccttgtggacataactgaggttcctgattttaacaccatgtatgagctgtatgatccatcaacagtcatgttcttctttagaaacaagcacataatgattgatcttggaactggaaacaacaacaaaatcaattgggctctgaaggacaagcaggagttcattgacattattgaaactgtctatcgtggggccaggaagggtcgtggtctggttattgctccaaaaggctactccaccaagtaccgctactaagtgcataagcaactaggcaagtttgtggatggggatgtgtaataactttgaccatagtaagaagcttgatgtctgcatctaactggtgttctgaaatggtacactctgatgcctttgtgtgatgatttccgcgtcatttttcttaaccaaatggtgaagttgagctagggagagtggcttatgatgcaaatgttgtgtgattattttagcagcctgaacttaacccgaatcttcttaaaataacaacttcaggaattatcaattcaataaattactgt

SEQ ID NO: 3813 - DNA, 903 bp, Cucumis sativus
gctcccgacggtgtactgctgcggcatccgacgggaccaactattcaaatcgcttaattcttacgatccacgctccgaccgatctcaattcttgacacccacgatctcacggctgcagatctgcaagtttgaacgccttcgaacttagttcgtcaagctcaagctcgtttggtgagaaatagtggaagctagttactgagcaagagatgtcgtacttgctgccacatcttcattcaggatgggctgttgaccaggcaatccttgcagaagaagaacgtcttgtggtcattcgtttcggtcatgattgggatgaaacttgtatgcaggtctttatctcttccattccatattcttccattcctctttctcagcataattggttcatcatcaaatttaatgttgaccatatggatgaagtgttggcctcggttgcagagactattaagaactttgctgtaatataccttgtggatatcacagaggttcctgatttcaacacaatgtacgagctttatgatccatccactgttatgttcttctttaggaacaagcacataatgattgatcttggtactggaaacaacaataagataaactgggcacttaaggataagcaggagttcattgatatcattgaaacagtctatcgtggagcaaggaaaggacgtggtttagtcattgcacctaaggactattcgaccaaatatcgctactaagattttctgctgcatctgaaagttcgtattgatcttaaacatgtactatatgacattaataacctcctaagcaaaagtaatggtttattctggtatgttaaggtactaccctgtttgtgaataaaagtgtatggtacacaaatttaacgtttatttctaatgttgaattgaatcttaattatgctat

SEQ ID NO: 3814 - DNA, 729 bp, Manihot esculenta
agggatcgtagaggagaagagaagagcaaacaatgtcctacctattgccgcacttgcacacagggtgggccgtcgatcaggctattcttgccgaagaagagcgggttgtgatcatccgttttggccatgactgggacgatacgtgcatgcaggagtcaaacccgtagggctgtagtgctgcgcccgttactgaagaaccgtcaaaaagatgccattgaggaaagattaagatggatgaagtcctggcgtcagttgctgagaagataaaaaactttgccgtcatttatctagtggacatcacagaggtaccggattttaacaccatgtatgagttgtatgatccatccacggtcatgttcttcttcaggaacaaacacattatgattgatcttggaactggaaataacaacaagattaactgggctcttaaagacaaacaagagttcatcgacatagttgaaactgtttaccgtggagcaaggaagggccggggtttggtcattgctccaaaagattattccaccaagtaccgttattagtgcttgagcaagctcattgatttctagctttgcatggtcccgtagaggcaatattgcaaatttgctatatatctaactcggaaatacaatagaaatttgtccttgacatgttcttatagaaccctttataaattggtggtcattagtggaatttacttggtattgtttgcattttaatgcaatttacttt

SEQ ID NO: 3815 - DNA, 427 bp, Tamarix hispida
ggggaggcaatctactgcaaaggccagagcgagacatcgggagtacgcagttttaccatgtcgtacctgctaccacacttgcattcgggatgggcggtggatcaggccattctcgctgaggaagaacgcgtcgttatcatccgtttcggccacgactgggatgaaacctgtatgcagatggacgaagtcctggcttctgttgcggagactataaagaactttgctgttatatacctcgtagacataacagaggtgtctgatttcaacacaatgtacgagtcgtatgatccatgcacggtgatgtcctttttcagaaacaagcacataatgatagaccttggcactgggaacaacaacaagatcgactgggcactcaagaataagcaggaatttatagatatcgttgagacagtttatcgtggtgcaa

SEQ ID NO: 3816 - DNA, 437 bp, Panax ginseng
caggaattcgaattccgggtagtatggttctttctttctgatttctgggctatacgatttgtttatcgagacagagacgatgtcgtacttgctgcctcacttgcactcaggatgggcagtggatcaagccattctcgccgaagaagaacgtctagttgtcatccgattcggtcacgattgggacgaaacttgtatgcagatggatgaagtgctagcttctgttgcagagacgataaagaactttgccgtgatatatctggtggacataactgaggtgcctgacttcaatactatgtatgaactgtatgatccctcaactgtcgtgttcttttttaggaacaagcacatcatgattgatcttggcaccgggaacaacaataagatcaactgggcaatgaaggacaagcaggagttcattgacattattgaaacagtct

SEQ ID NO: 3817 - DNA, 643 bp, Conyza canadensis
cgatcctcgccgaggaagaacgtctcgttgtcatccgtttcggtcacgattgggacgaaacttgtatgcagatggatgaagtgctttcttcagttgctgatacgttgaagaactttgctgtgatatacttggtggatatcactgaagtgccagatttcaatacgatgtacgagctttacgatccatcgaccgtgatgttcttcttcaggaacaaacacatcatgattgatcttggtaccggtaacaacaacaagatcaattgggcaatgaaggacaaacaggagttcatcgacattgttgagacagtgtaccgtggggcgaggaagggtcgtggtttggtcattgcaccaaaggactactcaccgttactaaaaccattcagttgtcattggtggtgtatggcttggaccatgtcttgtaattgaaacaaatataactgtcttattgtgtgtggcctgtatgcgtgatatttcagagtatatgtaatgagaccatgaaattctccgctgtcattattatgtaaacctcttgttatctctttagaaggaccatgaactgcgtgcgtgttcttacgtgcccatttggttttaagtgtattatctatcctcccttataaagagtattagatttcttaaaattcagc

SEQ ID NO: 3818 - DNA, 641 bp, Pseudoroegneria spicata
tttttgcttagcttccaaatctgctccacagctccagcagcacaagaagaaaatatcagcggtgcctgcgtgagatcatccatggagaaggagaaccataaggagggggagggggcgaccgcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctcctcgcccaccacaagcagcagcagcagcagcagcagcccgccaaggctccccagcccaccaagctcggcgctccggccaaagaccacggcccgctccacggccgcgacgactcgcccacgggaaggaagaggttcctgagctatttccagtgctgcatcaaggcctgaagaccagctgctgccaccgccctccgtcgaggtatcacagcatgaagcagcttagcaaatttagcctaggcttctttggtgtttggtcaagcttgcaacaaaaatgtgtaatataattccacgtcctgacgctacctgtttagagaacgaaccggtttatgtggggaacaagttgcttgtgaatgtcaaggttactatcttga

SEQ ID NO: 3819 - DNA, 1035 bp, Secale cereale
tcagcggcagacgcgtcacgcgtgcccgcccgctgcacaacacaacgggcagcgtcacgggcggccgcagccatagactaatcgcaggggaatgattagcggcggaggggttgggttgggttgggttggctaagccctggggtttggcccggcgtcagctgataattaccagctgggcgcgtgtgaatggggaaaactttgattctttgctcgcttggccgtcaacctatataagtaccgccccgtcgatctccttcctctgcccagtcactgtccacacacatttccttgtagttttgtaccacccctctcgtctcatccaggctagacaagtccagcactgtgctgtggtgctccgtctagctagcctttttcgcttagcttagcttccaaatctgctccacggctccggcggcacaagaggaaaatatccgtgtgtccgcgagaggcagatcgtccatggagaaggacaaccacaaggagggggagggggcgacggcgtggatgaccgtgccggcgttcggggactgggacatgaagaacggcgccatgccggactactccatggacttctccaagatccgggagatgcgcaagcagaacaagaaggagctctcccgcgccagcctcggcggcgacgacgacctgctcgcccaccacaagcagcaccagcagcagcagcagaagcccgtcaaggctccccagcccaccaagctcggcgctccggccaaagaccacggcccgctccacggccgcgacgactcgcccaccggaaggaagaggttcctgagctatttccagtgctgcatcaaggcctgaagaccagcttgctgccacggcatgaagcagcttagcaaatttagcctaggcttctttggtgtttggccaagcttgcaacaaaaatgtgtaatataattccacgtcctgacgctgcctgtttagagaacgaaacggtttatgtggggaacagattgcttgtgaatgtcaaggttactatcttgcctagtactgtagtaataataatattcacattga

SEQ ID NO: 3820 - DNA, 807 bp, Secale cereale
gtcggggcccagtcactcgtccacacactactttccttgttagttttcgtacccacccctctcgtctcatccaggctagacaagtccagcactgtgctgtggtgctccgtctagctagcctttttcgcttagcttagcttccaaatctgctccacggctccggcggcacaagaggaaaatatccgtgtgtccgcgagaggcagatcgtccatggagaaggatggccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggtggcgacgacgacctcctcgcccatcacaagcagcaccagcagcagcagcagaagcccgccaaggccgcccagcccaccaaactcggcgctccggccaaagaccacggcccgctccacggccgcgacgactcgcccacgggaaggaagaggttcctgagctatttccagtgctgcatcaaggcctgaagaccagcttgctgccacggcatgaagcagcttagcaaatttagcctaggcttctttggtgtttggccaagcttgcaacaaaaatgtgtaatataattccacgtcctgacgctgcctgtttagagaacgaaacggtttatgtggggaacagattgcttgtgaatgtcaaggttactatcttgcctagtactgtagtaataataatattcacattgaggaatgacatcttgtgcaaga

SEQ ID NO: 3821 - DNA, 768 bp, Secale cereale
gactgtccacacacatttccttgtagttttgtaccacccctctcatctcatccaggctagacaagccccgcactgtgctgtggtgctccatctagctagcctttttcgcttagcttagcttccaaatctgctccacggctccagcggcacaagagggaaaatatccgtgtgtccgcgagaggcagatcgtccatggagaaggatagccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctgctcgcccaccacaagcagcaccagcagcagcagcagaagcccgtcaaggctccccagcccaccaagctcggcgctccggccaaagaccacggcccgctccacggccgcgacgactcgcccacgggaaggaagaggttcctgagctatttccagtgctgcatcaaggcctgaagaccagctgctgccacggcatgaagcagcttagcaaatttagcctaggcttctttggtgtttggccaagcttgcaacaaaaatgtgtaatataattccacgtcctgacgctgcctgtttagagaacgaaacggtttatgtggggaacagattgcttgtgaatgtcaaggttactatcttgcctagtactgtagtaataataatattcacattgag

SEQ ID NO: 3822 - DNA, 757 bp, Secale cereale
cacatttcccttgtagttttgtaccacacctcctctctcatccaagctagacaagtccagcactgtgctgtggtgctccgtctagctagcctttttcgcttagcttagcttccaaatctgctccacggctccagcagcacaagaggaaaatatccgtgtgtctgcgagaggcagatcgcccatggagaaggatggccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctcctcgcccatcacaagcagcaccagcagcagcagcagaagcccgccaaggccgcccagcccaccaaactcggcgctccggccaaagaccacggcccgctccacggccgcgacgactcgcccacgggaaggaagaggttcctgagctatttccagtgctgcatcaaggcctgaagaccagcttgctgccacggcatgaagcagcttagcaaatttagcctaggcttctttggtgtttggccaagcttgcaacaaaaatgtgtaatataattccacgtcctgacgctgcctgtttagagaacgaaacggtttatgtggggaacagattgcttgtgaatgtcaaggttactatcttgcctagtactgtagtaataataatattcacattga

SEQ ID NO: 3823 - DNA, 2434 bp, Triticum aestivum
gggttgccttatgtgattactaatcctgatgctcttctgttggcgcctgaccatgtgtcctgcatgtgtcacctacgggcgatgacaaagtagaaggataaattggccacgtcagaattggaggaatggtttagaagcatcaatttgaataaagaaaatggcaaagtgattgtcaaacctacgagagctggatcaagtatcggcgtagttgtcgcttatggtgctaatgaggcagctgagaaagccgagggaatattttcagagggaattgataataaggttatcatagaagtttttcttgaagggggctgtgagtttacagccattgttcttgacgttgggacagctaataatagtgagcctatcgttttgcttccaacggaagttgagcttcagtcatcaatttctagtgatattcaggaggatacaatatttaactaccgtaggaagtaccttccaactcaacaggttgcgtatcatacacctccacggtttccggcagaggtgatagattgcataagaaaaggagtatcccttttatttcgccactttggcctgcgtgacttcgctaggatagatggttggttcttgccaagtcctgctacttctctgccctcgtctgaaaatggtgttaaatttggaaatacagagtatggtgctgtccttttcactgatattaacttgataagtgggatggagcaaaccagtttcttatttcaacaagcttcaaaggttggattctctcactctcgaatcctccgtacaattgttcagcatgcttgctcacgatttccttcccttgttacaagcaataatgcatggactgctttatccagaaaaatgcaatcagcaaaacaagcattgataatcccgaatggtacatgcaagcagaaggcttttgtgatatttggtggtgatacttcagagcggcaagtatctcttatgagtggcacaaatgtctggcttaatttgcaaggtttcgatgatcttgatgtgacaccatgcttgcttgcaccttcgaatggatattctccccacaatgaagattttagcggaagtgcacgcgatgtttggacactgccatattcattagtgttacgacacacaactgaagaagttcatgctgcatgtttcgaagcaattgaaccagagcgggttgaaataacaactcgcttacgtgatcaagtaatgaaagaacttgaacgagcattaagcaagcaagattggtttgcgggctttgacatcactgatgaacaacctatcaaatactctctgcaacagtggattgattatgttaaagaagctaaagctgtagtgttcatagcagttcatggtggtattggggaggatggtaccattcaatcgctgttggaatctgcaggagttccttacacagggccaggaccaatagcttctagaacatgcatggacaaagttgcaacttcacttgccgttgatcatttggctagttatggcattcacactataccaaaggatgtaagagcaacagaagagctactaaagtcatctcttgttgatatctggaatgacctgaaagcaaaattacaaacagaaacggtatgtgtgaaacctgctcgtgatggatgctcaactggtgtggcaagattgcgatgtccagaggacctagaagtctatgcaaatgcgctgaggggaaagcttccgcgtctgcctgctaactgtctatccagggcacatggagttattgagatgccagtccctcctccggagtcactgatattcgaaccatttatcgaaaccgacgaaattattatctcaaataaatcgaggaatgatagtacccgccatctggtatggaagggcgaaaatgagtggctcgaagtgactgttggtgtggtcggcaaacgtggggagatgcattcattgaatccaagcatcacagtcaaagaaagtggtgatattttgtctcttgaagagaaatttcaaggtggaactggaatcaacttgacaccacctccggcaacaattatgagtgaggatgcgctagagaagtgcaaaaagtgtatcgagatgatggcgaacacattgggtttggagggtttttcacgcatcgacgcatttgttaatgtgcgtagcggagaggtgctgttgatagaggtgaacaccgtacctgggatgactccgtccacagttctgattcaccaggcactcacggaggaaccgcccatctacccccacaagttcttcagaacgctcctcgacctggcgtttgcaagggcagactagctagatatactacacagtagtgcccccaaggtctcttgccagatgaactcgtccatttcagtgcaaataaggtcgtttttatcaccatttatcgatctgtatcatgcaactgccaatgtatgcaagtgactgttatgtcggtgtgaaaaaccgtgtgaaaagtttgtgt

SEQ ID NO: 3824 - DNA, 2743 bp, Secale cereale
cggggcatctcgctcaactccgcgcgctccgtgctcgaccacatccagggtgaggacttgctggtgagctgctactacatcgactgtggcatgaacgcgttcgcgatctcgccagcgcagctgtattccaacaccccttccgatttcgatttcaagctcgaaagtctggcacaagaattcggctccctggctgaattcgcggagcatcttgctgccaatgttgacattgttttcccggtgatacatgggaaatttggtgaagatggcggtattcaggagcttttggagaaagcaaatgttccatttgttgggacgccctctaatgaatgcctccgtgcttttgacaagcataatgcatcgctcgagctcaacgctcaaggtttcttaacagtaccaaactttcttgtagagaaggataaattggccaggtcagagttggaggaatggtttggaagcatcggtttgaataaagaaaatggcaaagtgattgtcaaacctacgagagctggatcaagtatcggtgtagttgttgcttatggtgctaatgacgcagctgagaaagcaaagggaatattttcagaggaaattgatgataaggttatcatagaagtttttcttgaagggggttgtgagtttacagctattgttcttgatgttggcacagctaataacagtgagcctatcgttttgcttccaacagaagttgagcttcagtcatcaattactagcgatattcaggaggatacaatatttaactaccgtagaaagtaccttccaactcaacaggttgcttatcatacacctccacgttttccggcagaggtgattgattgcataagacaaggagtatctcttttatttcgccattttggcttacgtgacttcgccaggatagatggttggtttttaccaactcctgctacttctctgacctcatctgaaaacggtggtaaatttggaaatacagagtatggtactgtccttttcactgacattaatttgataagtgggatggagcaaaccagtttcttatttcaacaagcttcaaaggttggattctctcactctcgaatcctccgtacaattgttcagcatgcttgctcacgttttccttcccttgttccaagcaataatgcatggactgctttatccagaaaaatgcaatcagcaaaacaagcagagataatccagaatggtacatgcaagcagaaggcttttgtgatatttggtggtgatacttcagagcggcaagtatctcttatgagtggcacaaatgtctggcttaatttgcaaggcttcgatgatcttgatgtgacaccgtgcttgcttgcaccttcgaatggatattcttcccacaaccaagattttagcgaaatttcatgtgacgtttggacactgccatattcattagtgttacgacataccactgaagaagttcatgctgcatgtttcgaagcaattgaaccagagcgggttgaaataacatctcgcttacgtgatcaagtaatgaaagaacttgaacgagcattaagcaagcaagattggtttgcaggctttgacatcactgatgaacaacctgtcaaatactctctgcaacagtggattgattatgttaaagaagctaaagctgtagtgttcatagcagttcatggtggtattggggaggatggtaccatgcaatcgctgttggaatctgcaggagttccttacacagggccaggaccaatagcttcgagaacatgcatggacaaagttgcaacttcacttgccgttgatcatttggctagttacggcattcacactataccaaaggatgtaagagcaacagaagaactactaaagtcatctcttgttgatatctggaatgacctgaaagcaaaattacaaacagaaacggtatgtgtgaaacctgctcgtgatggatgctcaactggcgtggcaagattgcgatgttcagaggacctagaagtctatgcaaatgcgctgagggggaagcttccgcgtctgcctgctaactgtctatccagggcacatggagttattgagatgccagtccctcctccggagtcactgatattcgaaccatttatcgaaaccgacgaaattattatctcaaataaatcgaggaatgatagtacccgccatctggtatggaagggcgaaaatgagtggcttgaagtgactgttggtgtggtcggcaaacgaggggagatgcattcattgaatccaagcatcacagtcaaagaaagtggtgatattttgtctcttgaagagaaatttcaaggtggaactggcatcaacttgacaccgcctccagcaacaattatgagtgaggacgcgctgcagaagtgcaaagggtgtatcgagatgatggcgaacacattaggtttggaggggttttcgcgcatcgacgcatttgtaaatgtgcgcagcggagaggtgctgctgatagaggtgaacacggtaccggggatgactccgtccacagttctgattcaccaggcactcacggaggaaccgcccatctacccccacaagttcttcagaacgctcctcgacctggcgtttgcaagggcagactagctagacacatacactagtgcccccaaggcctctcgccagatgaactcgtcgatttcagtgcaaataaggccgtttttatcatcgtgtatccgatcggtggggtgtcgtgcaactgccaatgtgtgcaaagtgactgttatgtcggtgtgaaaaaccgtgc

SEQ ID NO: 3825 - DNA, 3157 bp, Hordeum vulgare
cattgcgccgatcgcatgctgctctccctcgcccagccccgcctcccctccccggcgaccaccaccgcgagtacagcccggccccgcgccctcgccctcgccccgcgccgcgcgctcccctcggccgccaagaccgccagcgccacaggccggctccacgcggtggtctcggagcgggctgtggacgggatggcgccggcgccggcggggcgggaggggtggccgctccgggtcgggctcgtgtgcggcgggccctccgccgagcggggcatctcgctcaactccgcgcgctccgtgctcgatcacatccagggcgaggacttgttggtgagctgctactacatcgactgcggcatgaacgccttcgcgatctcgccggcgcagctgtattccaacaccccttcagactttgatttcaagcttgagagtctagcacaagaatttggctccctgactgaattcgcggagcatcttgctgccaacgttgacattgtcttcccggtgatacatgggaaatttggtgaagatggtggtattcaggggcttttggagaaagcaaatgttccatttgttgggacgccctccaatgaatgcctccgtgcttttgacaagcataatgcatcgctcgagctcaacgctcaaggtttcttaacagtaccaaactttcttgtagagaaggataagttggtcagttcagagctggaggaatggtttggacgcatcggtttgaataaagaaaatggcaaagtgattgtcaaacctactagagctggatcaagtatcggtgtagttgttgcttatggtgctaatgaggcagttgagaaagccgagggaatattttcagaggaaattgatgataaggttatcatagaagtttttcttgaagggggttgtgagtttacagccattgttcttgatgttgggacagctaataacagtgagcctatcgttttgcttccaacagaagttgagcttcaatcatcaattactagcgatattcaggaggatacaatatttaactaccgtaggaagtaccttccaactcaacaggttgcttatcatacacctccacgttttccggcagaggttattgattgcataagacaaggagtatctcttttatttcgccattttggcctgcgtgactttgccaggatagatggttggtttttaccaactcctgctacttctctgacctcatctgaaaacggtggtaaatttggaaatacagagtatggtactgtccttttcactgacattaatttgataagtgggatggagcaaaccagtttcttatttcaacaagcttcaaaggttgggttctctcactctcgaatcctccgtacaattgttcagcatgcttgctcacgttttccttcccttgttccaagcaataatgcatggactgctttatccagaagaattcaatcagcaaaacaagcagagataatccagaatggtacatgcaagcagaaggcttttgtgatatttggtggcgatacttcagagcggcaagtatctcttatgagtggcacaaatgtctggcttaatttgcaaggcttcgatgatcttgatgtgacaccgtgcttgcttgcaccttcaaatggatattcttcccacaacgaaaattttagcgaaagttcacgcgacgtttggacactgccatattcattagtgttacgacataccactgaagaagttcatgctgcatgtttcgaagcaattgaaccagagcgggttgaaataacatctcgcttacgtgatcaagtaatgaaagaacttgaacgagcattaagcaagcaagattggtttgcgggctttgacatcactgatgaacaacctatcaaatactccctgcaacagtggattgatcatgttaaagaagctaaagctgtagtgttcatagcagttcatggtggtattggggaggatggtaccattcaatcgttgttggaatctgcaggagttccttacacagggccaggaccaatagcttctagaacatgcatggacaaagttgcaacttcacttgccgttgatcatttggctagttatggcattcacactataccaaaggatgtaagagcaacaaaagagctactaaagtcatctcttgttgatatctggaatgacctgaaagcaaaattacaaacagaaacggtgtgtgtgaaacctgctcgtgatggatgctcaactggtgtggcaagattgcgatgtcctgaggacctaaaagtctatgcaaacgcgctaaggggaaagcttccgcgtctgcctgctaactgtctatccagggcacatggagttattgagatgccagtccctcctccggagtcactgatattcgaaccatttatcgaaacggacgaaattattatctcaaataaatcgaggagtgatagtacccgccatctggtatggaagggcgagaatgagtggcttgaagtgactgttggtgtggtcggcagacgtggggagatgcattcgttgaatccaagcatcacagtcaaggaaagtggtgatattttgtctcttgaagagaaatttcaaggtggaactggaatcaacttgacaccacctccagcaacaatcatgagtgaggatgcgcttcagaagtgcaaaaagtgcatcgagatgatggcgaacacattgggtctggagggtttttcgcgcatcgacgcatttgttaacgtgcgcagcggagaggtgttgttgatagaggtgaacactgtacctgggatgactccatccacagttctgatccaccaagcactcacggaggaaccgcccatctacccccacaaattcttcagaacactcctcgatctagcgtttgcaagggcaggctagatacgcaagggcccttaaaaacaagaaagatatatacatataagggtctctagccgtggcgcgcgtcgatttcagtgcaaataaaggtcgcttaccgctatgtactacggtatcgatttgtcttgtgcaactgccaatgtatgcaagtgactgttgtgtggaatttcgtagtaatcggtgcggaaagttgtgtggtggctgcacctgcttactcaaagtccaccatgggcatagaatagatactcgttgcgctgagaactccacgtctgtggagccatccaacaaaggtgagtgagtgagtgtcgaatga

SEQ ID NO: 3826 - DNA, 2979 bp, Triticum aestivum
ctcgtgtgcggcgggccctccgccgagcggggcatctcgctcaactccgcgcgctccgtgctcgatcacatccagggcgaggacttgttggtgagctgctactacatcgactgcggcatgaacgcgttcgcgatctcgcccgcgcagctgtattccaacaccccttcagacttcgatttcaagcttgaaagtctagcacaagaattttccaccctatctgaatttgcggaacatcttgctaccaatgttgacattgtcttcccggtgatacatggaaaatttggtgaagatggtggtattcaggagcttttggagaaagcaaatgttccatttgttgggacgccctctaatgaatgcctccgtgcttttgacaagcataatgcatcgctcgagctcgacgctcaaggtttcttaacagtaccaaactttcttgtagagaaggataaattggccaggtcagaattggaggaatggtttggaagcatcaatttgaataaagaaaatggcaaagtgattgtcaaacctacgagagctggatcaagtatcggtgtagttgtcgcttatggtgctaatgaggcagctgagaaagccgagggaatattttcagagggaattgatgataaggttatcatagaagtttttcttgaagggggttgtgagtttacagccattattcttgatgttgggacagctaataatagtgagcctatcgttttgcttccaacggaagttgagcttcagtcatcaatttctagtgatattcaggaggatacaatatttaactaccgtaggaagtaccttccaactcaacaggttgcttatcatacacctccacgttttccggcagaggttattgattgcataagacaaggagtatctcttttatttcgccattttggcctacgtgacttcgccaggatagatggttggtttttaccaactcctgctacttctctgacctcatctgaaaacggtggtaaatttggaaatacagagtatggtactgtccttttcactgacattaatttgataagtgggatggagcaaaccagtttcttatttcaacaagcttcaaaggttggattctctcactctcgaatcctccgtacaattgttcagcatgcttgctcacgttttccttcccttgttccaagcaataatgcatggactgctttatccagaaaaatgcaatctgcaaaacaagcagagataatccagaatgatacatgcaagcagaaggcttttgtgatatttggtggtgatacttcagagcggcaagtatctcttatgagcggcacaaatgtctggcttaatttgcaaggtttcgatgatcttgatgtgacaccatgcttgcttgcaccttcgaatggatattctccccacaatgaagattttagcggaagtgcacgcgatgtttggacactgccatattcattagtgttacgacacacaactgaagaagttcatgctgcatgtttcgaagcaattgaaccagagcgggttgaaataacaactcgcttacgtgatcaagtaatgaaagaacttgaacgagcattaagcaagcaagattggtttgcgggctttgacatcactgatgaacaacctatcaaatactctctgcaacaatggattgattatgttaaagaagctaaagctgtagtgttcatagcagttcatggtggtattggggaggatggtaccattcaatcgctgttggaatctgcaggagttccttacacagggccaggaccaatagcttctagaacatgcatggacaaagttgcaacttcacttgccgttgatcatttggctagttatggcattcacactataccaaaggatgtaagagcaacagaagacctactaaagtcatctcttgctgatatctggattgacctgaaagcaaaattacaaacagaaacggtatgtgtgaaacctgctcgtgatggatgctcaactggtgtggcaagattgcgatgtctagaggacctagaagtctatgcaaatgcgctgagcggaaagcttccgcgtctgcctgctaactgtctatccagggcacatggagttattgagatgccagtccctcctccggagtcactgatattcgaaccatttatcgaaaccgacgaaattattatctcaaataaatcgaggaatgatagtacccgccatctggtatggaagggcgaaaatgagtggctcgaagtgactgttggtgtcgtcggcaaacgtggggagatgcattcattgaatccaagcatcacagtcaaagaaagtggtgacattttgtctcttgaagagaaatttcaaggtggaactggaatcaacttgacaccacctccagcaacaattatgagtgaggatgcgctgcagaagtgcaaaaattgtatcgagatgatggcgaacacattgggtttggaagggttttcacgcattgacgcatttgttaatgttcacagtggagaggtgctgttgatagaggtaaacactgtgcctgggatgactccctccacagttctgattcaccaggcactcacggaggaaccacccatctacccccacaagtttttccgaacactccttgatctggcgtttgcaagggcagactagatacacaagggccctgaaaaaagagaagaagaagatacaagtgtctctagatgtggcgtgcgtcgatttcagtgcaaataaggtcgtttaccactatgtattacggtatcgatttgtgttgtgcaactgccaatgtatgcaagtgattcttgtgtggaatttgatagtcattggtgcgaaaagttgtgtcgaaaaattggtgtccggtcgatgatacctggatcctttgcgtgcaaaagttactaattataaagtcccaggctggtgaatggtggttgcactagctcaaagtccaccagcaccaggggaagctgctgggctgagaactctacatcggtggagccatccaacaaaggtgagtgtgtcgaa

SEQ ID NO: 3827 - DNA, 3439 bp, Triticum aestivum
gcgccgcgcgcactcctcggccgccgaaaccgccgccgcaggccggctccgcgcggtggtctcggagcgggctgttgacgggatggcgccggccgcggcggggcaggaggggcggccgctccgggtcgggctcgtgtgcggcgggccctccgccgagcggggcatctcgctcaactccgcgcgctccgtgctcgaccacatccagggtgatgacttgttggtgagctgctactacatcgactgtggcatgaacgcgttcgccatatcgccagctcagctgtattccaacaccccttcagactttgatttcaagcttgaaagtctagcacaagaattttccaccctatctgaatttgcggaacatcttgctaccaatgttgacattgtcttcccggtgatacatggaaaatttggtgaagatggtggtattcaggagcttttggagaaagcaaatgttccatttgttgggacgccctctaatgaatgcctccgtgcttttgacaagcataatgcatcgctcgagctcgacgctcaaggtttcttaacagtaccaaactttcttgtagagaaggacaaattggccaggtcagagttggaggaatggtttggaagcatcggtttgaataaagaaaatggcaaagtgattgtcaaacctacgagagctggatcaagtatcggtgtagttgttgcttatggtgctaatgaggcagctgaggaagccgagggaatattttcagaggaaattgatgataaggttatcatagaagtttttcttgaagggggttgtgagtttacagccattattcttgatgttgggacagctaataacagtgagcctatcgttttgcttccaacagaagttgagcttcagtcatcaattactaacgatattcaggaggatacaatatttaactaccgtaggaagtaccttccaactcaacaggttgcttatcatacacctccacgttttccggcagaggttattgattgcataagacaaggagtatctcttttatttcgccattttggcctacgtgacttcgccaggatagatggttggtttttaccaactcctgctacttctctgacctcatctgaaaacggtggtaaatttggaaatacagagtatggtactgtccttttcactgacattaatttgataagtgggatggagcaaaccagtttcttatttcaacaagcttcaaaggttggattctctcactctcgaatcctccgtacaattgttcagcatgcttgctcacgttttccttcccttgttccaagcaataatgcatggactgctttatccagaaaaatgcaatctgcaaaacaagcagagataatccagaatgatacatgcaagcagaaggcttttgtgatatttggtggtgatacttcagagcggcaagtatctcttatgagcggcacaaatgtctggcttaatttgcaaggtttcgatgatcttgatgtgacaccatgcttgcttgcaccttcgaatggatattctccccacaatgaagattttagcggaagtgcacgcgatgtttggacactgccatattcattagtgttacgacacacaactgaagaagttcatgctgcatgtttcgaagcaattgaaccagagcggtttgaaataacaactcgcttacgtgatcaagtaatgaaagaacttgaacgagcattaagcaagcaagattggtttgcgggctttgacatcactgatgaacaacctatcaaatactctctgcaacaatggattgattatgttaaagaagctaaagctgtagtgttcatagcagttcatggtggtattggggaggatggtaccattcaatcgctgttggaatctgcaggagttccttacacagggccaggaccaatagcttctagaacatgcatggacaaagttgcaacttcacttgccgttgatcatttggctagttatggcattcacactataccaaaggatgtaagagcaacagaagacctactaaagtcatctcttgctgatatctggattgacctgaaagcaaaattacaaacagaaacggtatgtgtgaaacctgctcgtgatggatgctcaactggtgtggcaagattgcgatgtctagaggacctagaagtctatgcaaatgcgctgagcggaaagcttccgcgtctgcctgctaactgtctatccagggcacatggagttattgagatgccagtccctcctccggagtcactgatattcgaaccatttatcgaaaccgacgaaattattatctcaaataaatcgaggaatgatagtacccgccatctggtatggaagggtgaaaatgagtggcttgaagtgaccgttggtgttgttgggaagcgtggggagatgcattcactaaatccaagtatcacagtcaaggaaagtggtgatattttgtctcttgaagagaaatttcaagggggaactggaatcaacttgacaccacctccagcaacaatcatgagtgaggatgcgctacagaaatgcaaaagttgtatcgagatgacggcgaacacattaggtctggagggcttttcacgcatcgacgcatttgttaatgtgcacagcggagaggtgctgttgatagaagtaaataccgtacctgggatgactccctccactgtcctgattcaccaggcactcacggaagaaccacccatctaccctcacaagttcttcagaacgctcctcgatctggcgtttgcaagagcaggctagatatacaagggccctgaagaaaagaagaagatatatgcgcctctagccggggcgcgtcgatttcagtgcgaatagggtcgcttaccgctatgtactacggtatcgatttgtgttgtgcaactgccaatgtatgcaagtgactcttgtgtgggatttgatagtcattggtgcgaaaagatgtggggtgtccagttgatacctggatccttttgcgtgccagaaagttattataaggtctcaggttggtgaatggtgatcgcactagctcaaagtccaccagcaccaggggaagctgctgggctgagaactctacatcggtggagccatccaacaaaggtgagtgtgtcgaataagtgcacggtcgactgcgaaaaggcagcgatgtatcgaaagcgtgcgcgtgtgcgtgtgctttcggctcaatctatggcatacagaaatgctttctgctcaatcacttctaccatatcccgagcgccttttcgaaagaaaaacaatagctttttggagaaaatatccagagtgcggtctgagtttagtaagaccgagattatttttctatcagtgtggtaactaggcgtttaactaactgctgagagcgatgtgtgtaggtttttctattatgagattgcttgccacatttccacatgtctcgtggacacgatgttgaattagtacctttgtgcgtcagtatgcaat

SEQ ID NO: 3828 - DNA, 2318 bp, Triticum aestivum
cctacgagagctggatcaagcatcggtgtagttgtcgcttatggtgctaatgaggcagctgagaaagccgagggaatattttcagagggaattgatgataaggttattatagaagtttttcttgaagggggctgtgagtttacagccattgttcttgatgttgggacagctaataatagtgagcctatcgttttgcttccaacggaagttgagcttcagtcatcaatttctagtgatattcaggaggatacaatatttaactaccgtaggaagtaccttccaactcaacaggttgcttatcatacacctccacggtttccggcagaggtgatagattgcataagaaaaggagtatcccttttatttcgccactttggcctgcgtgacttcgctaggatagatggttggttcttaccaagtcctgctacttctctgccctcgtctgaaaacggtgttaaatttggaaatacagagtatggtgctgtccttttcactgatattaacttgataagtgggatggagcaaaccagtttcttatttcaacaagcttcaaaggttggattctctcactctcgaatcctccgtacaattgttcagcatgcttgctcacgatttccttcccttgttacaagcaataatgcatggactgctttatccagaaaaatgcaatcagcaaaacaagcattgataatcccgaatggtacatgcaagcagaaggcttttgtgatatttggtggcgatacttcagagcggcaagtatctcttatgagtggcacaaatgtctggcttaatttgcaaggcttcgatgatcttgatgtgacaccgtgcttgcttgcaccttcgaatggatattcttcccacaacgaagattttagcgaaagttcacgcgacgtttggacactgccatattcattagtgttacggcataccactgaagaagttcatgctgcatgttttgaagcaattgaaccagagcgggttgaaataacatctcgcttacgtaatcaagtaatgaaagaacttgaacgagcattaagcaagcaagattggtttgcgggctttgacatcactgatgaacaacctatcaaatactctctgcaacagtggattgattatgttaaagaagctaaagctgtagtgttcatagcagttcatggtggtattggggaggatggtaccattcaatcgctgttggaatctgcaggagttccttacacagggccagggccaatagcttctagaacatgcatggacaaagttgcaacttcacttgccgttgatcatttggctagttatggcattcacactataccaaaggatgtaagagcaagagaagagctactaaagtcatctcttgttgatatctggaatgacctgaaagcaaaattacaaacagaaacggtatgtgtgaaacctgctcgtgatggatgctcaactggtgtggcaagattgcgatgtccagaggacctagaagtctatgcaaatgcactgaggggaacgcttccgcgtctgcctgctaactgtctatccaaggcacatggagttattgagatgccagtccctcctccggagtcactgatattcgaaccatttatcgaaaccgacgaaattattatctcaaataaatcgtggaatgatagtacccgccatctggtatggaagggtgaaaatgagtggcttgaagtgaccgttggtgttgttgggaagcgtggggagatgcattcactaaatccaagtatcacagtcaaggaaagtggtgatattttgtctcttgaagagaaatttcaagggggaactggaatcaacttgacaccacctccagcaacaatcatgagtgaggatgcgctacagaaatgcaaaagttgtatcgagatgacggcgaacacattaggtctggagggcttttcacgcatcgacgcatttgttaatgtgcacagcggagaggtgctgttgatagaagtaaataccgtacctgggatgactccctccactgtcctgattcaccaggcactcacggaagaaccacccatctaccctcacaagttcttcagaacgctcctcgatctggcgtttgcaagagcaggctagatatacaagggccctgaagaaaagaagaagatatatgcgcctctagccggggcgcgtcgatttcagtgcgaatagggtcgcttaccgctatgtactacggtatcgatttgtgttgtgcaactgccaatgtatgcaagtgactcttgtgtgggatttgatagtcattggtgcgaaaaagatgtgggggtgtcccagttgatacctggattccctttgccgtagaaaaaccc

SEQ ID NO: 3829 - DNA, 3395 bp, Brachypodium distachyon
ccggcggcatccgctacaagagcgacacgtccccgcatcgctctccagctcaggccagccaccaccaccacccccaccgcacacgcctgcttcgccgatcgctctccgtcgctgacaaccgcctcctaatccccccctcaccgcattgcaccgcgtgttctcgcatgctgctgctctccctcgcgcaggcgcccccgctgctgctacccgcgacgacccctcgcgccccttcccggcgccgcgagcccgcatcggccagcctaaggcggctcgcgtcacgggcgcgaggcgtctcggtcgctcctcgtcctgtccgcgcggtggtcgccggacgggaggctgaagggatggcggcggcgggggcggagcaggaggggaggccgctccgggtcgggctcgtctgcggcgggccctccgccgagaggggcatctcgctcaactccgcccggtccgtgctcgatcacatccagggggaggatctgttggtgagctgctactacatcgactgcggtatgaacgcctacgggatatcaccggcacagctatattccaacaccccttctgattttgatttcaagcttgaaagtctagcacaagaattccgctccttatctgaattcacggagcatcttgctgccaatgttgacattgtcttcccggtgatacatggcaaatttggtgaagatggtagtattcaggagcttttggagaaaacaaatgtcccatttgtcgggacaccctctaatgaatgtcgtcgtgcttttgacaagcatagtgcatcgatcgagctcaacgcgcaaggtttcttaacagtaccgaactttcttgtagagaaggataagttggccaagtcagagttggagcaatggttccaaagcatcaacttgaataaagaaaatggcaaagtggtggtcaaacctacgagagctggatcaagtattggtgtggttgttgcctatggtgctaatgatgcagctgagaaagccgagggaataatttcagagggaattgatgacaaagttatcgtagaagttttccttgaagggggctgtgagtttacagccattgttattgatgttgggacagctaataccagtgagcctgttgttctccttccaactgaagttgagcttcaatcatctggcaataatgatattcaggaggatacaatatttaactaccgtaggaagtaccttccgactcgacaggttacttatcacacgcctccacgttttccgccagaggtgattggttgcataagacaaggagtatctcttttatttcgccatcttggccttcgtgacttcgctaggatagatggttggtttttaccaactcctgttagtaccctttcatcaggtgaaaatggtggtagatttggaaatacagagtatggtactgtccttttcactgatattaacttgataagcgggatggagcaaaccagttttttattccaacaagcttcaaaggttggattttctcactctcgaatcctccgtacaattgttcagcatgcttgctcgcgatttccttcccttgttccttgcaataattcctggactgctttgtccagaaaaatgcaatcagcaaaacaagcagaggtaatccaaaacggaacacacaagcagaaggcttttgtgatatttggtggtgacacttcagagcggcaagtatctcttatgagtggcacaaacgtctggcttaatttgcaaggcttcgaggatcttgatgtgacaccgtgcttgcttacgcctgcaaatgggtattcttcttcccacaaccaagatggcgaaagttcacgtgacgtgtggacactgccatattcattagtgttacgacataccactgaagaagttcatgctgcatgtttggaggcaattgaaccagagcgggttgaaataacatctcgcttgcgtgatcaagtaatgaaagaacttgaacaagcattaagcaaacaagattggtttgctggctttgacatcgctgatgaacaacctaccaagtactctctgcaacaatggattgaccatgttaaagaagctaaagctgtagtgttcgtagcagttcatggcggtattggagaggatggtaccattcaattgatgttggaatctgcaggagttccttacacagggccaggaccaatagcttctaggacatgtatggacaaggttgcaacttcacttgccgtcgaccatttggctggttatggaattcacacaatacctaagggtgtacgagaaacagacgagctactaagctcatctcttgttgatatctggaatgacctgaaatcaaaactacaaacagaaacagtatgtgtgaaacctgcacgtgatggatgctcaactggcgtggcaagactgtgctgtccggaggacctggaagtctatgtaactgcattgaggagaaagcttcagcgtctgcctgctaactgcctatctagggcacatggagttattgagatgccagtccctcctccagagtctttaatttttgagccatttattgaaaccgacgaaattatcatttcaaataaatcaagggatgacagtgcccgtcatctggtatggaagggagaaaaggagtggcttgaagtgactgtcggtgtagttggcaaatgtggggagatgcattcgttaaatccaagtatcacggtcaaagaaagtggtgatattttatcgctcgaagagaaatttcaaggtggaaccggaatcaacttgacaccacctccagcaacaattatgagcgaggacgcgctgcggaagtgcaaaagttgtatcgagatgatggcgaacacactgggtctggaaggtttctcgcgcatcgacgcatttgtgaatgtgcgcaacggagaggttctgctgatagaggtgaacactgtacctgggatgactccatccacggttctgattcaccaggcacttacagaggacccaccaatctatccacacaagttcttcaggacgctccttgatctggcgtttgcaagggcaaactagatgatgatatacagttcgtccccccatgatctctggaagaactactcgtcggccggccattccagtgcagattaataaggtcgtttataggtgtatttcatgcaactgttgagtgtataagtgactatatcgtatgggtttttgatttactcaatgcatggtgagcttggcaagtgcagtgccaagagtttgcggtgctaattaaagatcttcttaataaaggattagatgattgtgtagtagtcgttggtgaggtccagtgctctaaaagggctttccaccatggtcgatctacggtgcgatttgtgcttaatcagtgaaaagatagtttcaccactatggttaatcaagagtttacttgatggagtgtctacctaactgctgacgggg

SEQ ID NO: 3830 - DNA, 2132 bp, Avena sativa
ggagggaattgatgataaggttataatagaagttttccttgaagggggctgtgaatttacagccattgttattgatgttgggaacagtgagcctgtcgttctgcttccaacagaagttgagcttcaatcatttagtaacactgatattgaggaggatacaatatttaactatcgtaggaagtaccttccaactcaacaggttgcttatcatacacctccacgtttcccggcagaggtgattgattgcataagaaaaggggtatctcttttatttcaacattttggcctgcgtgactttgccaggatagatggttggtttttaccaacgcccgctacttctctactctcatctgaaaacggtggtaaatttggaaatacagagtatggtactgtccttttcactgatatcaacttgataagtgggatggagcaaaccagttttttatttcaacaagcttcaaaggttggattctctcactctcgaatcctccgtacaattgttcagcatgcttgctcgcgatttccttcccttgttccaagaaataatgcatggactgctttgttcagagaaatgcaatcagcaaaacaagcagaggtaatccaaaatggtacatgcaagcagaaggctttcgtgatatttggtggcgatacttcggagcgacaagtatctcttatgagtggcacaaatgtgtggcttaatttgcaagggtttgatgatcttgatgtgacaccatgcttgcttacacctgcaaatggatattcttcttcccacaataatgatttcagcgaaagttcacgtgatgtttggacactgccgtattctttagtgttacgacataccactgaagaagtctgtgctgcatgttttgaggcaattgaaccagagcgggttgaaataacatctcgcttacgtggtcaagttatgaaagaacttgaacaaggattaagaaaaaaagattggtttgcgggatttgacatcgctgatgaacaacctactaaatactctttggaacagtggatcaaccatgttaaagaagctaaagctgtagtgttcatagcagttcatggtggtattggagaggatggtaccattcaatctctgttggaatctgcaggagttccttacacagggccaggaccaatagcttctagaacatgcatggacaaagttgcaacttcacttgccgttgatcatttggccagttatggaattcacaccataccaaaggatgtacgattatcagaagagctagtacagacatctcgtgttgatatctggaatgaactgaaagcaaaactacaaactgaaacagtatgtgtgaaacctgctcgtgatggatgctcaactggtgtggcaagattgtgctgtccagaggacctagaagtctatacaaatgcgttgaggagaaagctgcagcgtctgcctgctaactgtctatctagggcacatggagttattgagatgccggtccctcctccagagtcattgatatttgagccatatattgaaaccgacgaaattatcatttcaaatgaatcaagggatgatagttcccggcatctggtttggaagggaaaaaaggaatggcttgaaataactgttggtgtagttggcaaacgtggggagatgcattcattaaacccaagcatcacggtcaaagaaagtggtgatattttatctcttgaggagaaatttcaaggtggaactggaatcaacctgacgccacctccagcaacgattatgagtgaggctgcgcttcagaagtgcaaaagttgtatcgagacgatggcaaacacactggggctggaaggcttttcacgcatcgacgcattcgtgaacgtgcgcagcggagaggtgctgctgatagaggtgaacaccgtacctgggatgacgccgtccacggttctgattcaccaagcactcacggaagaaccgcccatctacccccacaagttcttcagaacactccttgacctggcgttcgcaagggcaaactagatatgtagttccaccgaggtctctcgagctcatcgatttcagtgcaaataaggctgttttatcaccatgttttgtatcgtgcaactgtcgatgtaagtgactatgtggtatttttggtagtctagtttgctag

SEQ ID NO: 3831 - DNA, 2504 bp, Triticum aestivum
agaaggataaattggctaagtcacaattggaggaatggtttggaagcatcaatttgaataaagaaaatggcaaagtgattgtcaaacctacgagagctggatcaagcatcggtgtagttgtcgcttatggtgctaatgaggcagctgagaaagccgagggaatattttcagagggaattgatgataaggttatcatcgaagtttttcttgaagggggctgtgagtttacagccattgttcttgatgttgggacagctaataatagtgagcctatcgttttgcttccaacggaagttgagcttcagtcatcaatttctagtgatattcaggaggatacaatatttaactaccgtaggaagtaccttccaactcaacaggttgcttatcatacacctccacggtttccggcagaggtgatagattgcataagaaaaggagtatcccttttatttcgccactttggcctgcgtgacttcgctaggatagatggttggttcttaccaagtcctgctacttctctgccctcgtctgaaaacggtgttaaatttggaaatacagagtatggtgctgtccttttcactgatattaacttgataagtgggatggagcaaaccagtttcttatttcaacaagcttcaaaggttggattctctcactctcgaatcctccgtacaattgttcagcgtgcttgctcacgttttccttcccttgtttcaagcaataatgcatggactgctttatccagaaaaatgcaatctgcaaaacaagcagagataatccaaaatggcacatgcaagcagaaggcatttgtgatatttggtggcgatacttcagagcggcaagtatctcttatgagtggcacaaatgtctggcttaatttgcaagggttcgatgatcttgatgtgacaccgtgcttgcttgcaccttcaagtggatgttcttcccacaaccaagatctcagcaaaagttcacgcgatgtttggacactgccatattctttagtgttacgacataccactgaagaagttcatgctgcatgtttcgaagcaattgaaccagagcgggttgaaataacatctcgcttacgtgatcaagtaatgaaagaacttcaacaagcattaagcaagcaagattggtttgcgggctttgacatcactgatgaacaacctatcaaatactccctgcaacagtggattgattatgttaaagaagctaaagctgtagtgttcatagcagttcatggtggtattggggaggatggcaccattcaatcgctattggaatctgcaggagttccttacacagggccaggaccaatagcttctagaacatgcatggacaaagttgcaacttcacttgctgttgatcatttggctagttatggcattcacactataccaaaggatgtaagagcaacagaagagctactaaagtcatctcttgttgatatctggaatgacctgaaagcaaaattacaaacagaaacggtatgtgtgaaacctgctcgtgatggatgctcaactggtgtggcaagattgcgatgtccagaggacctagaagtctatgcaaatgcgctgaggggaaagcttccgcgtctgcctgctaactgtctatccagggcacatggagttattgagatgccagtccctcctccggagtcactgatattcgaaccatttatcgaaaccgacgaaattattatctcaaataaatcaaggaatgatagtacccgccatctggtatggaagggcgaaaatgagtggcttgaagtgactgttggtgtggtcggcaaacgtggggagatgcattcattgaatccaagcatcacagtcaaagaaagtggtgatattttgtctcttgaagagaaatttcaaggtggaactggaatcaacttgacaccacctccggcaacaattatgagtgaggatgcgctagagaagtgcaaaaagtgtatcgagatgatggcgaacacattgggtttggagggtttttcacgcatcgacgcatttgttaatgtgcgtagcggagaggtgctgttgatagaggtgaacaccgtacctgggatgactccgtccacagttctgattcaccaggcactcacggaggaaccgcccatctacccccacaagttcttcagaacgctcctcgacctggcgtttgcaagggcagagtagctagaaatactatacagtactgccccacaggtctcttgccagatgaactcgtcgatttcagtgcaaataaggtcgttttatcaccatttatcgatctgtatcatgcaactgccaatgtatgcaagtgactgttatgtcggtgtgaaaaaccgtgtgaaaagtttgtgtcatcgcgcgaaaagttgtgtgagaatttggtgtccggtcgataggcgctcgccatctcaaggcgggcaggtgacgtaattgggtcggtgtcgatcctttgcgtgccatgaagttgattgacgtctcgggttggcgaatggtggccgcactagctcactcgaa

SEQ ID NO: 3832 - DNA, 3398 bp, Setaria italica
acggccgcgtcagcgtgatcgccgcctcgctcctccactccctccccaccgcccaccgcagcgtgccacatcgcatcgcatgccatgccgctcccccgtccccaagcccttctcctcccccggttcgcctctccgacgcctcgcctcatccgcgtcctcgccccgccgcgccgcgcgctcgtctcgtccccgccactagggttcgcgtccgcggcgcgaggcctcccggctccgctccgcgcggcggtgtccgccgagcagcgggagcccgggatagaggcgggggagcaggggaggccgctccgcgtcgggctcgtctgcggcggtccctccgccgagaggggcgtctccctcaactcggcgcgctccgtgctggatcacattcagggcgatgatttggtcgtcagctgctactacatcgactctggcatgaacgccttcgcgatatcgccggcgcagctatattccaacacaccttcagattttgatttcaaacttgaaagtctagcccaaggatttcactccctatctgacttcgcggagcatctttccaccaatgttgacattgccttcccagtgatccatgggaaatttggtgaagatggtggcattcaggagctcttggagaatgcaaatgttccatttgttgggacgtcgtctaaggaatgccagcgtgcttttgacaagcatagcgcatccctcgagcttgatgtacaaggtttcttaactgtgccaaactttcttgtggagaaggacaagttggctaagcgagagctggaggcatggttccaaaccacaaatttgagcaaagaaaatggaaaagtgattgtcaaacctacgagggctgggtcaagtattggtgtggttgttgcttatggtgtgaatgatgctgctcagaaagctgaggaaataatttcagagggaattgatgatagagttattgtagaggttttccttgaagggggcactgagtttacagctatcgtggttgatgttggggctgctaacaacagtgagcctgttgttctgcttccaacagaagttgagcttcagcactccagcagtagtgatagcaaggaggatacaatattcaactaccgcaggaagtaccttccgactcaacaggttgtttatcatacacctccacgttttccggcagaggtgattgattgcataagacaagggctttctgttttatttcgtcgccttggcctgcatgactttgcaaggatagatggttggtttttaccttctccagttacttctttaccctcagctgaaaatagtggcaaatttggaaataccaagtatggcactatccttttcacggatattaatttggtaagtgggatggagcaaaccagctttttgttccaacaagcttcagcggttggattctctcactctcaaatccttcgtacagttgttcagcatgcttgctcgcggttcccttctcttgttccattcaataatgcacggaccgctttgtccagaaaactacaaccatcaaaacaagcagaatcaatccaaaaaggtacatccagacagaaggtttttgtgatcttcggaggggacacttcagagcggcaagtatcacttatgagtggcaccaatgtctggctcaatttgcaaggttttgatgatcttgacgtgacaccatgttttcttgcacctgctaatggatatttctcctcccatgaccaagatttcagtgacatttcacgtgaagtttggatgctgccgtattcattagtgttacgacataccactgaagaagttcatgctgcatgtgttgaggcaactgaaccagaacgagttgaaataacttctcgtttgcgtgaacaagtaatgaatgaacttgggccagcattaagcaaacatgattggtttgcgggctttgacattgcttatgaacaacctatcaaatactcactgcaacagtggatcaaccatgcaaaagaagttggagctgtagtgtttatagcagtgcatggtggtattggagaggatggtaccattcaaacattgttggaatctgcaggagttccttacacaggaccaggaccattagcttctagaacatgcatgaacaaagttgcaacttcacttgccgttgaacatctgactagttatggagttcacaccatacctaaggatgtaagagcaacggaagaggtactgaagtcatctcttgttgatatctggaacgaacttaaagcaaaattacaaacggagacagtatgtgtgaaaccagctcgtgacgggtgctctactggtgtagcaagattgtgctgtccaaaggacctagaagtctatacaaatgcattgaggaaaaagtttcagcgcctgccagctaactgtctgtccagggcacatggggttattgagatgccagttactcctccagaatcattaatatttgagccttttattgaaactgatgaaattatcatttcaaataaattggagaacggtagtgcccgccatctggtatggaagggtgaaaacgactggcttgaaataactgttggtgtagttggcaaacgtggagaaatgcactcgttaaatccaagcatcacagtgaaagaaagtggtgatattttatctcttgaggagaaatttcaaggtggcactggaatcaacttgacaccacctcctgcaacaattatgagtgaggatgctctgcaaaggtgcaaaaggagtattgagatgatggcgaactctctaggtttggaaggcttttcacgcatcgatgcatttgttaacgtgcgaagtggggaggttctgctgatagaagtgaatactgtacctgggatgactccatccaccgtgttgattcaccaagcactcgcagaggaaccacccgtgtatccccacaagtttttccgtactcttctggatttggcgtttgaaagggcaaaataatactagtctagcttccatcaattctaaggtcattttacttgccatgcatcgatttgattgtgttactactaccaacagtttgaggtactgtttgtttggttatctggatttcgtatgacgactgaactacccgatgcaaacatgctacacgtgtcgttgacacacaagtgcagtaagaactgaagtgacaagccacggcggcacacgcggcagggctatcagccaccagtacgtacgtacaggaacgtagtcgcagcttatgctcgctcgcgtcttatcgagagataagcagggagacatttcggatgatggttgaatatatacttgatttctccatttcttgtgcgtgtgagtctctctctttcttctctccacacaaacgcatgcaattggcgcctcctgtattttttgcgagtgtgtgtaggacgtacgcaactgcaccacgtcgtttcatcgtcatatgtatcgcaata

SEQ ID NO: 3833 - DNA, 2561 bp, Pennisetum glaucum
gggatgcacaaggtttcttaacagtgccaaactttcttgtggagaaggacaagttggttaagcgagagctggaggcatggttccagaccacaaatttgagcagagaaaatggaaaagtgattgtcaaacctacaagggctgggtcaagtattggtgtggttgttgcttatggtgtgaatgacgctgctcagaaagctgaggaaataatttcaaagggaattgatgatagagttattgtagagcttttccttgaagggggcactgaatttacagctattgtggttgatgttgggactgctaacaacagtgagcctgtcgttctgcttccaacagaagttgagcttcagtactccagcagtagtgatagcaaggaggatgcaatattcaactaccgcaggaagtaccttccgactcggcaggttgtttatcatacacctccacgttttccggcagaggtgattgattgcataagacaagggctttctcttttatttcgtcgccttgccctgcatgactttgcaaggatagatggttggtttttaccttctcctgttacttctttaccctcagctgaaaatagtagaaaatttggaaacaccaagcatggcactatccttttcacggatattaatttggtgagtgggatggagcaaaccagctttttgttccaacaagcttcagcggttggattctctcactctagaatccttcgtacagttgttcagcatgcttgctcccgattcccttctcttgttccatgcaataatgcatggaccgctttgtccagaaaattacaaccatcaaaacaagcagaatcgatccacaaaggtatatccagacagaaggtttttgtgatcttcggaggggacacttcagagcggcaagtatcacttatgagtggcaccaatgtctggctcaatttgcaaggttttgatgatcttgacgtgacaccgtgttttcttgcacctgcaaatggatatttctcctcccctgaccaagatttcagtgacatttcacgtgaagtctggatgttgccgtattcattagtgttacgacataccactgaagaagttcatgctgcatgtgttgaggcaactgaaccagaacgaattgaaataacttctcgtttgcgtgaacaagtaatgaatgaacttggaccggcattaagaaaacatgattggtttgcgggttttgacattgcttatgaacaacctatcaaatactcactgcaacagtggatcaaccatgcaaaagaagctggagctgtagtgtttatagcagtgcatggtggtattggagaggacggtaccattcaaacattgttggaatctgcaggagttccttacacaggtccaggaccattagcttctagaacatgcatgaacaaagttgcaacttcacttgctgttgaccatctgagtagctatggagttcacaccatacctaaggatgtaagaacgacagaagaggtactgaagtcatctcttgttgatatctggaatgaacttaaagcaaaactacaaacggagacagtatgtgtgaaaccagctcgtgacgggtgctcgactggtgtagcaagactatgctctccaaaggacctagaagtctacacaaacgcgttgaggaaaaagcttcagcgtctgccagctaactgtctgtccagggcacacggggttattgagatgccagtccctcctccagaatcattaatatttgagccttttattgaaactgatgaaattatcatttcaaataaattggagaatggcagtgcccgccatctggtatggaagggtgaaaatgactggcttgaaataactgttggtgtagttggcaaacgtggagaaatgcactcgttaaatccaagcatcacagtgaaagaaagtggtgatattttatctcttgaggagaaattccaaggtggcactggaatcaacttgacaccacctcccgcaacaattatgagtgaggatgctctgcaaaggtgcaagcagagcattgagatgatggcgaactctctaggtttggaaggcttttcacgcatcgacgcgtttgtcaacgtgcgaagtggggaggtcctgctgatagaagtgaatactgtacctgggatgactccatccaccgtgttgattcaccaagcactcgcagaggaaccacccgtgtacccccacaagttcttccgtacccttctggatttggcgtttgaaagggcatgaatttcgcagttgttttctgttttcacaatgcacgcatcgatgattcatttgattgtgttactgccagcaatttctgaactactacatcatgcacatatacccgatgcaaacatcgacacaagtgcagtactgcaaattgaaggggcgttccaagctgtagagagagggccgggagagagtcgtgttggtgttcccatgtataccggggcgacgcgcacggcggcaagtctatcaaatgcacgcctaagaaattaatttgggatgtttgtttgtttgtttgttgtgtgtgtcctccatctagtggcaatgagagaagcttatgctgccgtcggtcttgtgacattt

SEQ ID NO: 3834 - DNA, 3527 bp, Sorghum bicolor
gctacaaaaagggatgtgggcacgcaccacgacttccgcacttcacatcgctctcccgcactcccactcccgcgcagacggcgcaccagctcgcctctgccggccccgcccccctcctccaccatccccttcccaccgcatcatatcgcatgctgctgtcgcgtccccaaaccctgcccctgcccttgccccgggcccgggccccgctttcctccccgacccttcgccacctccgcgcgctcgtctcgtccccgccactagggttcgcgtccgcggcgcgaggcctcgctccgctccgcctccgcgcggtggtgtccgaccacgagcagcgcgggatggaggcgggggagcaggggaggccgctccgcgtcggcctcatctgcggcgggccctccggcgagaggggcgtctccctcaactccgcgcgctccgtgctggatcacatccagggagaggatttggtggtccgctgctactacattgactctgctatgaaggccttcgcgatatctcctgcgcagctatattccaacacgccttcggattttgacttcaaacttgaaagtttagcccaaggatttgactccttatctgactttgcggagcatcttgccatcaatgttgacattgtcttcccagtgatccatgggaaatttggtgaagatggtggcattcaggagcttttggagaaagcaaatgttccatttgttgggacaccctctaaggaatgcgagcgtgcttttgacaagcataatgcgtcgctcgagctcaatgcacaaggtttcttaacagtgccaaactttcttgtggagaaggacaagttggccaagccagagttagaggcatggttcaaaactgtcaatctgaacaaagaaaatggcaaagtgattgtcaaacctacaagggctgggtcaagcattggcgtggttgttgcttatggtgtgaatgacgctgcccagaaagctgaggaaattatttcagagggaattgatgataaagttatcatagaagttttccttgaagggggcactgagtttacagccatcgtggttgatgttgggactgctaacaacagtcagcctgttgttctgcttccaacagaagttgagcttcagtactccaacagtagtgataccgatgaggacacaatatttaactaccgcaagaagtaccttccaagtcgacaggttgcttatcattcgcctccacgttttccggcagaggtgatcgattgtataagacaagggatttctcttttatttcgtcgctttggcctgcatgactatgcaagggtagatggttggtttttaccttctcctgttgcttctttatcctcagctgaaaatagtgaaaaatttggaaataccaagtatggaactgttcttttcacggatattaatttgataagtgggatggagcaaaccagctttttgttccaacaagcttcagcggttgggttctctcactctcgaatcctccgtacagttgttcagcatgcttgctcgcgattcccttctcttgttccatgcaataacgcttggaccgctttgtccagaaaactacaaccatcgaaacaaataggagcaatccacaaaggtacatcaagacagaaggtttttgtgatcttcggaggggacacttcagagcggcaagtatcacttatgagtggtaccaatgtctggcttaatctccaaggttttgatgatcttgacgtgacaccatgtttgctcgctcctgcaaatggatatttctcatcccatgatcaagttttcagtgacacttcaagagaagtctggacgttgccatattcattagtgttacgacataccactgaagaagttcatgctgcatgtgttgaggcaactgagccagaacgagttaaaatgacaaaacgtttgcgtgatcaagtaatgaatgaacttgggccagcattgagcaaacatgattggtttgcgggctttgacattgcttatgaacaacctatcaaatactctctgcaacagtggatcgaccatgtaaaagaaacagaagctgtagtctttatagcagtgcatggtggcattggagaggatggtaccattcagacattgttggaatctgcaggagttcctttcacaggaccaggaccaatagcttctagaacatgcattgacaaagttgcaagttcacttgcggttgaccatcttgctagttatggagtccataccattcctaaggatgtaagagcaacagaagaagtactgaagtcatctcttgttgatatctggaatgaacttaaagcaaaactacgaacagaaacagtatgtgtgaaaccagctcgtgatgggtgctcaactggtgtagcaagattgtgctgtccaaaggacctagaagtctatacaaatgcattgaggaggaagtttcagcatctgcctgctaattgcctgtccagggcacatggcgtaattgagatgccagtccctcctccagagtcactaatatttgagccttttattgaaacggatgaaattatcatttcaaataaattggggaatggtagtgcccgccatctggtatggaagggtgaaaatgactggcttgaaattactgttggtgtagttggcaagcgtggagaaatgcactcgttaaatccaagtatcacagtgaaagaaagtggtgatattttatctcttgaggagaaatttcaaggtggcactggaatcaacttgacaccacctcctgcaacaattatgggcgaggatgctctgcagaggtgcaagaagagtatcgagatgatggcaaatgctctaggtttggaaggcttctcgcgcattgacgcatttgtcaacgtgcggagcggggaggtgctgctgatcgaagtcaacactgtacctggaatgactccatccaccgtgctgatccaccaagcactcgcagaggaacctcccgtgtaccctcacaagtttttccgcactcttctggatttggcgtttacaagggcgaaatagctcagtcagccatttatttattttacttgtaccgcgcatcggtttgattctgtatcagtaaagcagacaacattgtcattgtgagaaggtgctgttactgttaggtggttgttgaaaggcttggttatctttacttgacgtcagcattactgaacttaacaattcgagtgagcgcgacatacgtgtggcattgtggcaatgtaaatcaaaggatgaaaaatatataaacatgtactactcttgtgttgcataggctggcatgcttagctcttgtgttgccatgtgtgcggtcgtgcacggaagagcatagcagaagcaactcctcagtcaaaccaaacaaagaatcggccagctgctgacctcaacccaacaaccacctcctcaccggccggggcctgtggggccagcagcgatggcacggtgataccgattctgatcaaaaccgttgacacgtgaaacctcccttaagtttgcgagccaagattatcacaacgccgttggttattgaatattgtgagtgattggtacaccaattactac

SEQ ID NO: 3835 - DNA, 3289 bp, Zea mays
cttcacatcgctctcccgctttcccactcccgcgtcggctcccagcaccagctactcctccacggtgcacggccgcatcagcacgatcgctgcctagcctgcctgcctgccctgctcccccaccatgctgctctcgcgtccccaaaccctgcccctgccccgggcccggctctcttccccgacccttcgccacctccgcgccctcgccgcgccgctccgcgcgctcgtctcgtccccgccactagggttcacgtccgcggcgcgaggccccgctccgctccgcgcggcggtgtccgagtccgatcgcgagcagcgggaggctggggtggaggcgggggagcaggggaggccgctccgcgtcggcctcgtctgcggcgggccctccggcgagaggggcgtctccctcaactccgcgcgctcggtgctggatcacatccagggagaggatttggtcgtctgctgctactacattgactgtgctatgaaggccttcgcgatatctcctgcgcagctatattccaacacaccttcggattttgacttcaaacttgaaagtttagcccaagaatttgattccctatctgacttcgcggagcatctcgccacaaatgttgacattgtcttcccagtgatccatgggaaatttggtgaagatggaggcattcaggagcttttggagaaagcaaatgttccatttgttgggacaccctctaaggaatgccagcgtgcttttgacaagcataatgcgtcgctcgagctcaacgcacaaggtttcttaacagtgcccaactttcttgtggagaaggacaagttggctaagccggagttagaggcatggttccaaaccgtcaatctgaacaaagaaaatggcaaaacgattgtcaaacctacaagggctgggtcaagcattggcgtagttgttgcttatggtgtgaatgatgctgcccagaaagctgaggaaattatttcagagggaattgatgataaagttatcatagaggttttcattgaagggggcactgagtttacagccatcgtggttgatgttgggattgctaacaacagtgagcctgttgttctgcttccaacagaagttgagcttcagtactccaacaatagtgataccaaggaggacacaatatttaactaccgcaagaagtaccttccaagtcgacaggttgcttatcattctcctccacgttttccggcagaggtgatcgattgtataagacaaggaatttctcttttattttgtcgccttggcctgcatgactatgcaaggatagatggttggtttttaccttctcctgttgcttctttacccccagctgaaaatagtgacaaatttggaaataccaagtatggaagtgttcttttcacggatatcaatttgataagtgggatggagcaaaccagctttttgttccaacaagcttcagcggttgggttctcacactctcgaatccttcgtacagttgttcagcatgcttgctcgcgattcccttctcttcttccatgcaataatgcttggaccgctttgtccagaaaactacaaccatcaaaacaagtagaagcaatccacaaaggaacatcaagacagaaggtttttgtgatcttcggaggggacacttcagaacggcaagtatcacttatgagtggtaccaatgtatggcttaatcttcaaggttttgatgatcttgacgtgacaccgtgtttgcttgcacctgcacatggatatttctcctcacatgatcaagatttcagtgacagttcaagagaagtttggacgttgccatattcattagtgttacgacataccactgaagaagttcatgctgcatgtgttgaggcaactgagccagaacgagttgaaataacaaaacgtttgcgtgatcaagtaatgaatgaacttgggtcagcattgagcaaacatgattggtttgcgggctttgacatagcttatgaacaacctatcaaatactctctgcaacagtggatcgaccatgtaaaagaaactgaagctgtagtctttatagcagtgcatggtggcattggcgaggatggtaccattcagacattgttggaatctgcaggagttccttacacaggaccaggaccaatagcgtctagaacatgcattgacaaagttgcaagttcacttgctgttgaccatcttgctagttatggaatccgtatcattccaaaggatgtaagagcaacagaagaagtactgaactcatctcttgttgatatctggaatgaacttaaagcaaaactagaaacagaaacagtatgtgtgaaaccagctcgtgacgggtgctcgactggtgtagcaagattgtgctgtccaaaggacctagaagtctatacaaatgcattgaggaggaagtttcagcatctgcctgctaattgcctgtccagggcacatggtgtaattgagatgccagtcccttctccagagtcactaatatttgagccttttattgaaaccgatgaaattatcattgcaaataaattagaggatggtagtgcccgccatcttgtatggaaaggtgaaaatgactggcttgaaataaccgttggtgtagttggcaaacgtggagaaatgcactcattaaatccaagtatcacagtgaaagaaagtggtgatattttatctcttgaggagaaatttcaaggtggcactggaatcaacttgacaccacctcctgcaacaattatgggcgaggatgctctgcagaggtgcaagaagagtatcgagaccatggcaaacgctctaggtttggaaggcttctcacgcattgatgcatttgtcaacgtgcgaagcggggaggtgctgctgattgaagtcaacactgtacctgggatgactccatccaccgtgctgatccaccaagcactcgcagaggaaccgcccgtgtacccccacaggtttttccgcactcttctggatttggtgtttgcaagggcaaaatagctatctcacatttatttttctttttacggtgcgtcggtttgattctgtatcagtcgagtagtatttttatttatatttgtgggaaaaaaatcgtcttctccgtgttgatgcgatgaaaaataaacatgtatagcgttgcgcggtcgtcgtgcacatcagagcagagcagaagcaaccctccacggacgtcaagtcaaaccaacacgtccgggccacaatatggaaagctagctatacaagtatcgtggaatataaactctcaaacttaccaagttttcatcacatcattaatatagaggtttagttctcgac

SEQ ID NO: 3836 - DNA, 1692 bp, Sorghum bicolor
tacatggctacgtctctctcctcccacttcgacccggccggccctatcaaaagcccccttccacaccgcactcccctcaccttcctccaccttcccctcctctgcccccaccgcccgcttccttctgccttgctccgttgcttcctcccaccacagtccactccactcgccggccctgcagctcagtatttgactgagattggtggtggagctgctagcagctcgactcgcttgctacttcttggtcctgacgacggtgcgttcagaccagtgacgacgacgttgtgaggagagggcaaggaagcaaacctgccagggaggtggcgatggagaggtacgaggtgatcaaggacataggatcgggtaacttcggggtggccaagctggtccgggacgtcaggaccaaggagctcttcgccgtcaagttcatcgagcgggggatgaagattgatgagaatgtccaaagagagatcatgaaccacaggtcgctgaggcatccaaacatagttaaatttaaggaggttgtgctaactcccacacatttggccatagttatggaatatgctgctggcggtgagctatttgaaaggatctgcaaagctggaagatttagtgaggatgaggcaagattcttcttccaacaactgatttcaggagttagctattgtcattcaatgcaaatatgtcatagagatttgaaactagaaaacactctcctggatggtagtatagcacctcggctaaagatatgtgattttggttactccaagtcctctgtgttgcactctcaaccaaaatcaactgtcgggacaccagcttacattgctccagaggtccttgctagaaaggaatatgatggaaaggtcgccgatgtttggtcatgtggagttactctgtatgtgatgcttgttggtgcttatccatttgaggaccccgacgaaccgaagaatttccgcaagacgcttactcggattctcagtgtccaatatgcggttcctgattttgtccgagtttcaatggagtgcagacatctgctgtctcggatctttgtggcgatccctgagcaacggataaccatcccagagatcaagaaccacccgtggttcttgaagaacctgcccatcgagatgaccgacgagtaccagatgaacctacagctggttgacatgaatggcccctcgcaaagtctggaggagatcatgaccatcatacaagaggcccggaagcccggtgacgggctgaagcattcgggacagctccctggcctggggagcatggagctggatgacattgatgtcgacgacatagatgttgaggacagcggtgactttgtatgtgccttgtgacgtggttcaagctgtctcggcgctgttgctgtcacgggactctcccccacccttctggtcttgtgttctactgttattccatcttgtttcagcgagctccgagctcccattttgttgttgtaatatcacatgttttgcgtaatcaaggtagtcacgctgtggataaataatagacgttattatgtcatgtattcttgctgaattcttgttcaggtcctgtgtttgccctgtatgaactgggcagtttcatgagtgcctcagcctgatcttttgatctgctgcatgtagccaatgtgttttttatttttattattttactagaagccatcttatgagttaccgagta

SEQ ID NO: 3837 - DNA, 1428 bp, Saccharum officinarum
cccgcttgcttctgccttgccccattgcttcctcccaccacagtccactccactcgccggccctgcagctctgctcagtatttgactgattggtggtggagccgctagcagctcgactcgcctgctacttcttggtcctgacggtgcgttcagaccagtgccgactacgagctgtgaggagagggctaggaagcaagcctgccagggaggtggcgatggagaggtacgaggtgatcaaggacataggatcgggcaactttggggtggccaagctggtccgggacgtcaggaccaaggagctcttcgccgtcaagttcatcgagcgggggatgaagatagatgagaatgtccaaagagagatcatgaaccacaggtcgctgaggcatccaaacatagttaaatttaaggaggttgtgctaactcccacacatttggccatagttatggaatatgctgctggtggtgagctatttgaaaggatctgcaaagctggaagatttagtgaggatgaggcaagattcttcttccaacaactgatttcaggagttagctattgtcattcaatgcaaatatgtcatagagatttgaaactagaaaacactctcctggatggtagtatagcacctcggctaaagatatgtgattttggttactccaagtcctctgtgttgcactctcaaccaaaatcaactgtcgggacaccggcatacattgctccagaggtccttgctagaaaggagtatgatggaaaggttgccgatgtttggtcatgtggagttactctgtatgtgatgcttgttggtgcttatccctttgaggaccccgacgaaccgaggaatttccgcaagacgcttactcggattctcagcgtccaatacgcggttcctgattttgtccgagtttcaatggagtgcagacatctgctgtctcggatctttgtggcgaaccctgagcaacggataaccatcccagagatcaagaaccacccgtggttcttgaagaacctgcccatcgagatgaccgatgagtaccagaggaacctacagccggtggacatgaatgccccctcgcaaagtctggacgagatcatggccatcatacaggaggcccggaagcccggcgacgggctgaagcattcaggacagctccccggcctggggagcatggagctggatgacattgatgtcgatgacatagacgttgaggacagcggtgactttgtatgtgccttgtgacgtggttcaggctgccggcgccgttgctgctgtggactctcccccacccttctggtcttgtcttgtgttctgctgttattccatcttgtttgtttcagcgagctccgagctcccattttgttgttgtaatatcacatcttttgtgtaatcaaggtagtgacgctgtggataaataatagacgttatgtgctgc

SEQ ID NO: 3838 - DNA, 1599 bp, Panicum virgatum
cctcctctgcccccgcctcctgcttccttccactcctcgctcccccgttgcttcctccttccctccacactcggctccactcatcggccctgcagctctcggtactgaccgattggtggaggtagctgctggcctgctgctgcttcttgctcctggcggtgcgttcagaccaggctctgattacgagccgtaggaaggccaaggagcaagataactgacagggaggtggcgatggagaggtatgaggtgatcaaggacataggatcgggcaacttcggggtggccaagctggtccgggacgtcaggaccaaggagctcttcgccgtcaagttcatcgagagggggatgaagattgatgagaatgtccaaagggagatcatgaaccatagatcactgaggcatccaaatattgttaaattcaaggaggttgtgctaactcccacacatttggccatagttatggaatatgctgctggtggcgagctattcgaaaggatctgcaatgcagggagatttagtgaggatgaggcaaggttcttcttccaacaattgatttcaggagttagctattgtcactccatgcaaatatgtcacagagatttgaaactagaaaatactttgctggatggtagtatagcacctcgtctaaagatatgtgattttggttattccaagtcttctgtgttgcactctcagcccaaatcaactgttggcacacctgcttacattgctcccgaggtgcttgctaaaagggaatatgatggcaaggttgccgatgtttggtcatgtggagtaactctgtatgtgatgcttgtcggggcttatcccttcgaggaccctgacgaaccaaagaatttccgcaagactcttactcggattctcagcgtacaatacgccatacctgattttgtccgagtttcaatggagtgcaggcatcttctgtcccggatttttgttgcaaaccctgagcaacggataaccatcccggagatcaagaaccacccgtggttcctgaagaatctgccgatcgagatgaccgatgagtaccagatgagcgtgctaatgaccgacatgaacgtcccctcgcaaagcttggaggagatcatggccatcatacaggaggcccgcaagcctggcgacggtatgaagctcaccgggcagatccccggcctggggagcatggagctggacgacattgacgttgacgatatcgacgtggaggacagcggcgacttcgtctgcgccttgtgacgagcaagtggttggttcaggccgtccgacgccgaagctgctgtgaactcccactctcttcgggtcttttgtgttctgctgttgatccaagttgtttgtctcagcgtgttccgagctcccattttgttgttgtgattccacttgttttctgtaatggaggtagtgacgctgtggataaataatagactttttaaggcttgattcttagtgttcggatcctccgccctgtatgaagaggcagtctcatgaattcgcaatgtttatattcatggcttctttcttcccgttgacctttagcttgatgttttttagatactgcatgccggaaacatctctatgagtttactc

SEQ ID NO: 3839 - DNA, 1672 bp, Setaria italica
acgtctctctctctctcccacttcgacctggccggccctatcaaaagcccccctcctcccttccaccccgcactccttcacctcctcccaccttcccctcctctgcccccacctcccctgcttccttccattcctcgctcgctcctccgttgcttcctcccttcccccgtccacagtccactccactcatcggccccgcacctcggtatttgaccgattggtgccttggtggaggtagcttgcaagcctgttagctgcttcttgcttccggttctcgcgttcataccagtgccgattacggggtgtcagaggccgagaagctcgtgcgcgccagggaggtggcgatggagaggtacgaggtgatcaaggacataggatcgggcaacttcggggtggccaagctggtccgggacgtcaggactaaggatctctttgccgtcaagttcatcgagaggggaatgaagattgatgagaatgtccaaagggaaatcatgaaccacagatcgctgaggcatccaaatatagttaaattcaaggaggttgtgctaactcccacacatttggccatagttatggaatatgcttctggtggtgagctattcgaaaggatctgcaacgctgggagatttagcgaggatgaggcaaggttcttctttcaacaattgatttcaggagttagctattgtcactccatgcaaatatgtcacagagatttgaaactagaaaatactctgctggatggtagtatagcacctcggttaaagatatgtgattttggttattccaagtcctctgtgttgcactcacagcccaaatccactgttggcacaccagcttacattgctcccgaggtgcttgctagaaaggaatatgatggaaaggtcgccgatgtttggtcatgtggagtaactttgtatgtgatgcttgtcggggcttatccctttgaggaccctgatgaaccaaagaatttccgcaagactcttactcggattctcagcgtacaatatgccattcctgattttgtccgagtttcgatggagtgcaggcatcttttgtcccggattttcgttgcaaaccctgaacaacggataaccatcccggagatcaagaaccacccgtggttcctgaagaacctgcccatcgagatgactgacgagtaccagatgagcgtgctaacggccgacatgaacttcccctcacaaagcctggaggagatcatggccatcatacaggaggcgcggaagcctggcgacgggatgaagctcactgggcagctccctggcctgggaagcatggagctggatgacattgacgtcgacgacatcgacgtcgacgacagcggtgatttcgtctgcgccttgtgacgagcaagctgttggttcaggccgtccgacgccgaagccgccttgaaattcctttctcttctggtcatgtgttctgctgttgatccacgacgtttgtttcagcgtgctccgagctcccattttgttgttgtgatatcactgtcacttcacttgttttctgtaaccgaggtagtgacgctgtggataaataagactttttaaggctgtattcttgctgaattcttagtgttcggatcctctgtttgccctgtatgaaggggctgtttcatgaatgtcgcaatgtgtatgttcgtgggcctgttctttcc

SEQ ID NO: 3840 - DNA, 1438 bp, Pennisetum glaucum
cttctgcaaatctgagttggggtgggggcagaggaggggaaggtgggaggtgcctgctacctgccgcttcttgcttctggtcgtctcgcgttcagaccagtgtggattacggggagtgtattaagaggccgagaacgaataagctcgtcccggtcagggaggtggcgatggagaggtacgaggtgatcaaggacataggatcgggcaacttcggtgtggccaagctggtccgggacgtcaggaccaaggagctcttcgccgtcaagttcatcgagaggggaatgaagattgatgagaatgtacaaagggaaatcatgaaccacagatcgctgaggcatccaaatatagttaaattcaaggaggttgtgctaactcccacacatttggccatagttatggaatatgctgctggtggcgaactattcgaaaggatctgcaactctgggagatttagcgaggatgaggcaaggttcttcttccaacaattgatttccggagttagctattgccactccatgcaaatatgtcacagagatttgaaactagaaaatactctgctggatggtagtatagcacctcggttaaagatatgtgatttcggttattccaagtcatctgtgttgcactcacagcccaaatccactgttggcacaccggcttacattgctcccgaggtgcttgctagaaaggaatatgatggaaaggtcgctgatgtttggtcatgtggagtaactttgtatgtcatgcttgtcggggcttatccctttgaggaccctgatgaaccaaagaatttccgcaagactcttactcggattctcagtgtacaatatgccattcctgattttgtccgagtttcgatggagtgcaggcaccttctgtcccggattttcgttgcaagccctgaacagcggataaccatcccggagatcaagaaccacccttggttcctgaagaacctgcccatcgagatgactgaggagtaccagatgaccgtgctaacagccgacatgaactccccttcgcaaagcctggagaacatcatggccatcatacaggaggcgcggacgcctggtgacgggatgaagctcaccgggcagctccccggcctgggaagcatggagctggacgacattgacgtggatgacatcgacgtcgatgacagcggtgacttcgtctgcgccttgtgacgagcaggcagctggttcaggccgtccggcgtgccttgaaatccttctctcttctggtcacgtgttctcgtttgtttcgttcagcgtgctccgagctcccattttgttgtttgtgatatcattatcacttcacttgttttctgtaaccgagatagtgacgctgtggataaataagagtttttaaggctgtattcttgctgaattcttagtgttcggatgatctgtttgccctgtatgaagggctgtttcat

SEQ ID NO: 3841 - DNA, 1583 bp, Panicum virgatum
ggacccggccgggccctatcaaaagcccccttcttcccttccacaccgcactccctcaccttccaccttccctcctctgcccccgcctcctgcttccttccactcctcgctcctccgttgcttcctccttccctccacagtcggctccactcatcggccctgcagctctcggtattgaccgattggtggaggtagctgctggcctgctgctgcttcttgctcctgccggtgcgttcagaccagtggctctgattacgagccgtaggaaggacaaggagcaagcctgacagggaggtggcgatggagaggtacgaggtgatcaaggacataggatcgggcaacttcggggtggccaagctggtccgggacgtcaggaccaaggagctcttcgctgtcaagttcatcgagaggggaatgaagattgatgagaatgtccaaagggagatcatgaaccatagatcactgaggcatccgaatattgttaaattcaaggaggttgtgctaactcccacacatttggccatagttatggaatatgctgctggtggcgagctattcgaaaggatctgcaatgcagggagatttagtgaggatgaggcaaggttcttcttccaacaattgatttcaggagttagctattgtcactccatgcaaatatgtcacagagatttgaaactagaaaatactttgctggatggtagtatagcacctcggctaaagatatgcgattttggttattccaagtcttctgtgttgcactctcagcccaaatcaactgttggcacacctgcttacattgctcccgaggtgcttgctaaaagggtatatgatggaaaggttgccgatgtttggtcatgtggagtaactctgtatgtgatgcttgtcggggcttatcccttcgaggaccctgacgaaccaaagaatttccgcaagactcttactcggattctcagcatacaatatgccatacctgattttgtccgagtttcaatggaatgcaggcatcttctgtcccggatttttgttgcaaaccctgagcaacggataagcatcccggagatcaagaaccacccgtggttcctgaagaatctgccaatcgagatgaccgacgagtaccagatcagcgtgctaatgaccgatatgaacgtcccctcgcaaagcttggaggagatcatggccattatacaggaggcccgcaagcctggcgacggtatgaagctcaccgggcagatccctggactggggagcatggagctggacgacattgacgttgacgatatcgacgtggaggacagcggtgacttcgtctgtgccttgtgacagagcaagtggttggttcaggccgtccgacgccgaagctgcagtgaactcccactctcttctggtcttttgtgttctgctgttgatccaagaagtttgtttcggcgtgttccgcgttcccattttgttgttgtgatttcacttgttttctgtaatggaggtagtgatgctgtggataaataatagacattttaaggctggattcctagtgttcggttcctctgccctgtatgaaggggcagtctcatgaattcgtaatgtct

SEQ ID NO: 3842 - DNA, 1749 bp, Panicum virgatum
agcgagcccacgcgtgcaccaccaccacgacggccgatgacgacggcaatactactggtatggctacatggctacgtctctctctcctcccacttcgacccggccgggccctatcaaaagcccccttcttcccttccacaccgcactccctcaccttccaccttccctcctctgcccccgcctcctgcttccttccactcctcgctcctccgttgcttcctccttccctccacagtcggctccactcatcggccctgcagctctcggtattgaccgattggtggaggtagctgctggcctgctgctgcttcttgctcctgccggtgcgttcagaccagtggctctgattacgagccgtaggaaggacaaggagcaagcctgacagggaggtggcgatggagaggtacgaggtgatcaaggacataggatcgggcaacttcggggtggccaagctggtccgggacgtcaggaccaaggagctcttcgccgtcaagttcatcgagaggggaatgaagattgatgagaatgtccaaagggagatcatgaaccatagatcactgaggcatccgaatattgttaaattcaaggaggttgtgctaactcccacacatttggccatagttatggaatatgctgctggtggcgagctattcgaaaggatctgcaatgcagggagatttagtgaggatgaggcaaggttcttcttccaacaattgatttcaggagttagctattgtcactccatgcaaatatgtcacagagatttgaaactagaaaatactttgctggatggtagtatagcacctcggctaaagatatgcgattttggttattccaagtcttctgtgttgcactctcagcccaaatcaactgttggcacacctgcttacattgctcccgaggtgcttgctaaaagggtatatgatggaaaggttgccgatgtttggtcatgtggagtaactctgtatgtgatgcttgtcggggcttatcccttcgaggaccctgacgaaccaaagaatttccgcaagactcttactcggattctcagcatacaatatgccatacctgattttgtccgagtttcaatggaatgcaggcatcttctgtcccggatttttgttgcaaaccctgagcaacggataagcatcccggagatcaagaaccacccgtggttcctgaagaatctgccaatcgagatgaccgacgagtaccagatcagcgtgctaatgaccgatatgaacgtcccctcgcaaagcttggaggagatcatggccatcatacaggaggcccgcaagcctggcgacggtatgaagctcaccgggcagatccccggactggggagcatggagctggacgacattgacgttgacgatatcgacatggaggacagcggtgacttcgtctgtgccttgtgacagaacaagtggttggttcaggccgtccgacgccgaagctgcagtgaactcccactctcttctggtctttttgtgttgtgctgttgatccaagttgtttgtttaagcgtgttctgcgctcccattttgttgttgtgatttcacttgttttctgtaatggaggtagtgatgttgtggataaataatagactttttaaggctggattcttagagttcggatcctccgccctgtatgaaggggtcgtctcatgaattcgcaatggcttgtttctttccgttgacctttagcttgatgttttttaggcactgcatgccgaaatctctatgagtttact

SEQ ID NO: 3843 - DNA, 1678 bp, Brachypodium distachyon
agcctcgtcaaaaggcccccaacgagccagccccccttccacaccttcctctccctccctgccgctgctgcttcttcgctcctccccgctctcgctcggcgttgctcccttcctcctcccggtgtccactctccactcaccactggctccgttccgttcggcgcttgaccgaccttcgccccgagggctgagctactgcctactcagctgccgcttcttcttgctccggcgacccgtcacggaccgcgctgcgtgtggtctgggatggagcggtacgaggtgatcaaggacttagggtcgggcaacttcggggtggccaagctggtccgggacgtcaggaccaaggagctgttcgccgtcaagttcatcgagaggggccacaagatcgacgagaatgttcaaagggagattatgaatcacagatctctaaggcatccaaacattgttagattcaaagaggttgtgctaactcccacgcatttggccatagttatggaatacgctgctggtggcgagctattcgaaaggatatgcagtactggaagatttagtgagaatgaggctaggttcttcttccaacaactgctttcaggagtcagctattgccattccatgcaaatttgtcatagagatttgaaactagaaaatacactcttggatgggagcgaagcgccgcggctcaagatatgtgatttcggttactccaagtcgtctgtgttgcactctcagccgaaatcgaccgttggcactccagcttacatagctccggaggtcctttctagaagggaatatgatgggaaggtcgctgatgtttggtcctgtggagtaacactatatgttatgcttgttggcgcttatccttttgaggaccctgtcgaaccaaagaacttccgcaagacaattacccggatactcagcgtacaatacgcagtacctgattacgtccgaatttcaatggagtgcagacatctgctgtcccggatttttgttgcaaaccctgagcaacgaataaccatcccagagatcaagaaccacccatggttcctgaagaatctgcccattgagatgaccgacgagtaccagttgaggctgcagatggttggcatcaacgcgccctcccaaaccctggaggatagcatggccatcatccaggaggcgcggaaaccgggtgacgggtccaagttcgctgggcagttgtgcgtgcccggcctagggagcatggagctcgacgacatagatgctgacgacatcgacgttgaggacagcggtgacttcgtgtgcgcgttgtgacgagcggttgtggttcaggcttgaacaattcccctttgtggtctggtctttgtcatgtgttcatccttttgttgtgtcgctgttggtttcagagtgccccacactctgtatgttgtatggcatattttctgtaaccgaggtagtgacgctgtggataagtataatatatatacttccatgtgttgctgatgttcttagctggattactgatttcttgcttcccttgcagtttactttggttggagggattatcttacctgttgatcacttgatccatcatgtgttcatcccataatcatttcctatttaactgccaccgatttgtactgtctttgttttacagtcattcgcaacgatgacggtaaaatacttaagtgatgatgtgcca

SEQ ID NO: 3844 - DNA, 1739 bp, Triticum aestivum
cccgctccctctcctcgctcgggtgcttcctccctcccggtgtccactccactcgccactggctccgttcggtgcttgaatcttgaccgacccgcctgagccggcagccaccggcggcctgctgccgcttgcttctcgctccagtggtgcctacgagctgcggacggacggacggacggacggagggggtccgggatggagcggtacgaggtgatcaaggacatagggtcgggcaacttcggggtggccaagctggtccgggacgtcaggaccaaggagctcttcgccgtcaagttcatcgagagggggcacaagattgatgagaatgttcagagggagattatgaaccacagatctctgaggcatccgaacattgttagattcaaagaggttgtgctaactcccacacatttggccatagttatggaatacgctgctggcggtgagctatttgaaaggatctgtggttctggaagatttagcgagaatgaggctaggttcttcttccaacaattgctttcaggagttagctattgccattccatgcaaatatgtcatagagatttgaaactagaaaatacgctcctggatgggagcgaagcaccccggctcaagatatgtgatttcggttactccaagtcctctgtgttgcactctcagccaaaatcgaccgtcggtactcctgcctacatcgcccccgaggtcctttctagaagggaatatgatggaaaggtcgctgatgtttggtcctgtggagtaactctatatgtgatgcttgtgggcgcttatccttttgaggacccagacgaaccgaagaatttccgcaagacaattactaggatactcagtgtacaatactcagtacctgattatgtccggatttcaatggagtgcagacatttgctgtcccggattttcgtggcaaaccctgagcaacgaataaccatccaagagatcaagaaccacccgtggttcctcaagaatctgccgatcgagatgaccgacgagtaccagatgagcctgcacatggtcggcgtcaacgctcccccgcagaccctggaggagatcatggccatcatccaggaggcgcggataccgggcgacggttccaagttcgccgggcagctgtcagtgcctgggctagggagcatggagctcgacgacatagatgatgtcgatgtggacgtcgaggacagcggtgactttgtgtgcgcgttgtgacgagcaggcgtggcggttccccttggtggtgtggcctttgtgtttgtaatgtgttcatccttctgttgtgccatttgtttcagagggttgtggtgtgctgttgtatgattacatgtgtttctgtaagcgttgttcgtagtgatgctgtggataaagtataagtataactatacttccatatgtgtttggtgtcctcagctggattcctggtgatttgcttctctgtgtgcttcggcagtttacgtcagaaggtagtccagaagcggatgcaaattgtgctctacatcaacgatatttgaaagacgaaatgtgtgctgggttcgtggtagatggatggcatgtatggttttctccttcggcgtcttagtcgtagtagggtgttagatcttagtttgatagctcacctttggtgagccaccttagaggttcgcaaagcagcatattagcgacgtaatgtcggttgttatgtgacttgtaatttgatctttatgatatgagtgagacacatattaacatgg

SEQ ID NO: 3845 - DNA, 1430 bp, Triticum aestivum
tgtccactccactcgccactggctccgttcggtccgtgaatcttgaccgacccgcctgagccggcagccaccggtggcctgctgccgcctctcgctccagtggtggtgtggctacgagctgcggacggagggggtccgggatggagcggtacgaggtgatcaaggacataggctcgggcaacttcggggtggccaagctggtccgggacgtcaggaccaaggagctcttcgccgtcaagttcatcgagagggggcacaagattgatgagaatgttcaaagggagattatgaaccacagatctctgaggcatccgaatattgttagattcaaagaggttgtgctaactcccacacatttggccatagttatggaatacgctgctggcggtgagctattcgaaaggatctgcagttctggaagatttagcgagaatgaggctaggttcttcttccaacaattgctttcaggagttagctattgccattccatgcaaatatgtcatagagatctgaaactagaaaacacactcctggatggaagcgaagcaccccggctcaagatatgtgatttcggttactccaagtcctctgtgttgcattctcaaccaaaatcaaccgtcggtactcctgcctacattgcccccgaggtcctttctagaagggaatatgatggaaaggtcgctgatgtctggtcgtgtggagtaaccctatatgtgatgcttgtcggcgcttatccttttgaggacccagacgaaccaaagaatttccgcaagacaattactcggatactcagcgtacaatatgcagtacccgattacgtccggatttcaatggagtgcaggcatttgctgtcccggattttcgtggcaaaccctgagcaacgaataaccatccaagagatcaagaaccacccatggttcctcaagaatctgccgatcgagatgaccgacgagtaccagatgagcctgcatatggtcggcgtcaacgctcccccgcagaccctggaggaggtcatggccatcatccaggaggcacggataccgggcgacggatccaagtttgccgggcagctgtcggttcccgggctagggagcatggagctcgacgacatagacgacgtcgacgcggacgtcgaggacagcggcgactttgtgtgcgcgttgtgacgggcaggtgtggttccccttggtggtgtggctttgtgtttgtaatgtgttcatccttctggtgtgtcgtctgttgcagagggttgcggtgtgctgttgtatgattacatgtgtttctgtaaccgttgttcgtagtgatgctgtggataaagtataagtataactatatacttccatatgtgtttggtgtcatcagtaggattcctggtgatctgattctctttacgcttcggcagtttatatatttgttactatttttttgca

SEQ ID NO: 3846 - DNA, 1318 bp, Avena sativa
tctcccctcgctcggctgcttccttcctccctcctggtgtccactccactcaccactgcccccgttcggttcttgaccgacctgcctgagctgctgctgcttctcgctccagtccagtgccgattgcgagctctgacctctgaggagagtcccagatggagcggtacgaggtgatcaaggacataggctccggcaacttcggggtggccaagctcgtccgggacgtcaggaccaaggagctcttcgccgtcaagttcatcgagaggggccacagatcgatgagaatgttcaaagggagattatgaaccacagatctcttaggcatccgaacattgttaggttcaaagaggttgcgctaactcccacgcatttggccatagttatggaatacgctgctggtggcgagctattcgaaagaatctgcggttctggaagatttagcgaaaatgaggctagattcttcttccaacaactgctttcaggagttagctattgtcactctatgcaaatatgtcatagagatttgaaattagaaaacacactcctggatggtagcgaagcaccacggctcaagatatgtgattttggttactccaagtcctctgtgttgcactctcaactaaatcaaccgttgggactccagcttacatcgctccggagtcctttctagaaaggaatacgatggaaaggttgctgatgtttggtcctgtggagtaactctatatgtgatgcttgttggtgcttatccatttgaggaccctgacgaaccaaagaacttccgcaagacaatcactcggatactcagcgtacaatacgcggtacctgattacgtccggatttcaatggagtgcagacatctgttatcccggattttcgtggcaaaccctgagcaacgaataacgatccaggagatcaagaaccacccgtggttcctcaagaatctgccgatcgagatgactgacgagtaccagatgagcctgcacatggtcggcatcaactctcccccgcagaccctggaggacatcatggccatcatccaggaggcacggaaaccaggcgacggaaccaagttcgcggggcagctgtccgtgcccggcctagggagcatggagctcgacgacattgatgatgttgacgccgacattgaggacagcggcgacttcgtgtgcgcgttgtgacagacatgtgtctttgtgtcctggtcttttgtgatgtgtgttcatcattctgtcgtgtcgttgttcgttttccagtgagttgcaatctgctgttgtactgtcacccatcttttatgtctgtcgataaatataatatatat

SEQ ID NO: 3847 - DNA, 1395 bp, Saccharum officinarum
gcccattgccgacctcaaactcaaccccgcctcgactcctggaccagctgacctccgctccgctcccaccaccaccaccggggcccagacgccaatctccaccccacaccttcgtcgtcttcttcctctgctgcggttagcctggccgtggccgcctcctgctcttgggcgatctcgcgctgcgatggagcggtacgaggtgatcagggacatcgggtcgggcaacttcggggtggccaagctcgtccgggacgtcagcaccaaggagctcttcgccgtcaagttcatcgagagaggtcagaagattgatgaacatgttcagagggagattatgaaccaccggtccctgaagcacccaaacataattagattcaaggaggtagtgctaactcccacacatttggcaatagttatggaatatgctgccgggggtgagctatttgaaaggatttgcaatgcggggagatttagtgaggatgaggcaaggttcttcttccaacaactgatttcgggagtgagctattgtcattccatgcaagtatgtcatagagatctgaaactagaaaacactctcttagatggtagtgttgcacctcggctcaagatctgtgatttcggttactccaagtcttctgtgctgcactctcaaccgaaatcaactgttggcacacctgcatacattgctccagaggtcctctctagaaaagagtatgatggaaaggttgctgatgtttggtcttgcggagtaacactatatgtgatgctcgtcggcgcatatccttttgaagaccctgatgacccgaagaacttccgcaagacgatcactagaatactcagcgtacagtactcaattccagactatgttcgtgtttcaacggagtgcaggcatctgctgtctcggatattcgttggaaatccagagcagagaataaccattcctgagatcaagaaccacccgtggttcctcaagaacctgcccatcgagatgaccgacgagtaccagcagagcatgcagctggcagacatgaacaccccggggcaaagcctggaggaagtcatggcgatcatccaggaggcgcggaagccaggggacgccgtgacccttgccgggcacctgccctgcctggggagcatggaccttgatgacattgattcggacgatatcgatgacattgacatcgaaaacagcggcgacttcgtttgtgcagtgtgatgctctcatgcgtggttcggtagcagagtagcagcgagctttcctttggttgttggtgtctgtagatccttgtttgtgttatgcttccattcgtttctggatcacacttgttgtgtaaccgagaaattggcgttgctgtggacaacatacatcatgaaacttatatgccgaaatctacacag

SEQ ID NO: 3848 - DNA, 1383 bp, Pennisetum glaucum
accaccaccaccacggcaccaccacgcgggcccaggcgcccaatctccaccccacaccctcgtcttcctcgtctcctgccgccgctctgctcgctctgggcgccgcgccccctctttgatcttgcgattcgatggagcggtacgaggtgatcagggacatcggctcaggcaacttcggggtggccaagctggtgagggacgtcacgaccaaggagctcttcgccgtcaagttcatcgagagaggccagaagattgatgagcatgttcaaagggagattatgaaccaccggtcactgaagcatccaaacataattagattcaaggaggtcgtgctaactcccacacatttggcaatagttatggaatatgctgctggcggtgagctatttgaaaggatttgcaatgctgggagatttagtgaggatgaggcaaggttcttcttccaacagctgatttcgggagtgagctattgtcattccatgcaagtatgccatcgagatctgaaactggaaaatactctgttagatggtagtgttgcaccacggctcaagatctgtgattttggttattccaagtcttctgtgttgcactctcaaccaaaatcaactgttggcacacctgcatacattgctccagaggtcctctctagaaaagaatatgatggaaaggttgctgatgtttggtcctgcggagtaacactctatgtgatgctggtcggtgcatatccatttgaggaccctgatgacccaaggaacttccgcaagacaatcactaggatactcagcgtacaatactcaattccagactatgttcgagtttcaacggaatgcaggcatctgttgtcccggatatttgtcggaaatcctgagcagagaataaccattccagaaatcaagaaccacccgtggttcctcaagaacctgcccattgagatgacagacgactaccaacagagcatgcagctggcaggcgtgaacagctcggagcaaagcctggaggatgtcatggcgatcatccaggaggcgcggaagccaggggagggcatgaagcttgccgggcagttgtcctgcctggggagcatggatcttgatgacattgatttggatgatatcgacgacattgacatcgagaacagtggtgattttgtttgcgcaatgtgatgcccgcgttgtttaaccggtcgagtagtagactagcagcgagattgatgtgtgtagatcttcgtattgcttcggtttgcttctggatcacatatgttctgtgaccgaggaaattcacattgctgtcgtgaacttacatgctggagtctacacagaaatcatttgtgtaattgtgttctcgaaactgatgggcttattgttttttaaccattcaactattaaa

SEQ ID NO: 3849 - DNA, 1462 bp, Setaria italica
tgcccgcatcaaactcaaactctgcctcgactccctatagctgccgacctccgccccattcccatcaccaccaccacgcgggcccaggcgcccaatctccgccccacgccctcgtcttcctcgtcttctgctgccgctctgctcgccctggccgccgccccctcttcgatcttgtgctgcgatggagcggtacgaggtgatcagggacatcgggtcgggcaacttcggggtcgccaagctggtgcgggacgtcacgaccaaggagctcttcgccgtcaagttcatcgagagaggccagaagattgatgagcatgttcaaagggagattatgaaccaccggtcactgaagcatccaaacataattagattcaaggaggtcgtgctaactcccacacatttggcaatagttatggaatatgctgctggcggtgagctatttgaaaggatttgcactgctgggagatttagtgaggatgaggcaaggttcttcttccaacagctgatttcgggagtgagctattgtcattccatgcaagtatgccatagagatctgaaactagaaaatactctgttagatggtagtgttgcaccacggctcaagatctgtgattttggttattccaagtcttctgtgttgcactctcaaccaaaatcaactgttggcacacctgcatacattgctccagaggtcctctctagaaaagaatatgatggaaaggttgctgatgtttggtcctgcggagtaacactctatgtgatgctggtcggtgcatatccatttgaggaccctgatgatccaaggaacttccgcaagacaatcactaggatactcagtgtacaatactcaattccggactatgttcgagtttcaatggaatgcaggcatctgttgtctcggatatttgttggaaatcctgaacagagaataaccattccagaaatcaagaaccacccgtggttcctcaagaacctgcccattgagatgacagacgactaccaacagagcatgcagctggcagacatgaacagctcggagcaaagcctggaggaagtcatggcgatcatccaggaggcgcggaagccaggggaggccatgaagcttgccgggcaggtatcctgcctggggagcatggatatggatcttgatgacattgatttggatgatatcgacgacattgacatcgagaacagtggtgattttgtttgcgcaatgtgatgttcatgcgtggttcaaccggtcaagtagcagactagcagcgagattcctttggttgttgatgtatgtagatccttggattatgctttggtttgcttctgaatcacatatcttctgtaaccaagaaattcacattgctgtggatagcatacaacgtgaacttacatgctgaaatctatacagaaatcattgtgttctcggtgctgtactgaatataagcccatcagttctgttgagattcctatc

SEQ ID NO: 3850 - DNA, 1944 bp, Panicum virgatum
tcagaaaaggaaaaaataatgataaaatacttttgtacgtacggccctgccttggacggcgacccgtcggctcggcaaccctggacggctcccgcagcgacacatggtcggtgtacaggggcacgtctctttctcctcccccgttgccacctcaaactcaactccgcctcctcgactccctagccgacctccgccgcattcccacacacccccatccgccacggccaccacgcgggcccaggcgcccgatctccatcccacaccctcgtcgtcttcgtcttcgtcttcgtcttctgttgccgcttggctcaccctggcggcctcgctgttcgatctcgcgctgccatggagcggtacgaggtgatccgggacatcgggtcgggcaacttcggggtggccaagctggtgcgggatgtcagcaccaacgagctcttcgccgtcaagttcatcgagagaggccagatgattgatgagcatgttcaaagggagattatgaaccaccgatcactgaagcatccaaacataattagattcaaggaggttgtgctaactcccacacatttggcaatagttatggaatatgctgctggtggtgagctatttgaaaggatttgcaatgctgggaggtttattgaggatgaggcaaggttcttcttccaacaactgatttcaggagtgagctattgtcattccatgcaaatatgccatagggatctgaaactagaaaatactctcttagatggcagtgctgcacctcggctcaagatctgtgattttggttattccaagtcttctgtgttgcactctcaaccaaagtcaacagttggcacacctgcatacattgctccagaggtcctcactaagaaagaatatgatggaaaggttgctgatgtttggtcctgcggagtaacactgtatgtgatgctggtcggtgcatatccatttgaggaccctgatgacccaaggaacttccgcaagacaatcactaggatactcagtgttcaatactcaattccagactacgttcgagtttcaatggaatgcagacatctgttgtcccgcatatttgtcggaaatcctgagcagagaataaccattccagaaatcaagaaccacccgtggttcctcaagaacctgcccatcgagatgaccgatgagtaccaacagagcatgcagctgccaggcatgaacagcccggaacaaagcctggaagaagtgacggctatcatacaggaggcgcggaagccaggggaagccgtgaaggttgccgggcaggtatcctgcctggggagcatggatcttgacgacattgatttggactatatcgacgacatcgacatcgagaacagtggcgactttgtttgcgcaatgtgatgttcatgtttgtggttcaaccggtaaagtagcagagtagcagcgagcttccgttggttgttgatgtatgtagatccttggattatgcttctattggcatctggatcagatacgttctcagtgatgtattgaatattttttttgaaaatttgatgtagtgaatatgaccatcatttctgttgccattcctatcgtctagtttcaataacatagcttgcattcatttgctgatgtgcagtattactttatcatttgctgacggcactatcacattcgtaaagagaaatcgatcgatctgacggatgagcaagccggccggcgcggcgtgcacggaggctacacggagatcttctaggtggcaccggcacggcgcttcttgggttccgacggcgtcctttcgtgcttgcgagccagcaggtgcggcggcgcgcggaggcccagcaccacggctcgcttaatcgggggcggcggcatcgccgagccggtgccgggcgctggcggctcccacggctggaagacccgcgcgcgccgttgctcctcctcctcctcctcctgcccgtgccccttccg

SEQ ID NO: 3851 - DNA, 1440 bp, Panicum virgatum
ggacctccgccgcattcccacacacccccatcccccacggcccaccgcgcgggcccaggcgcccaatctccatccccacaccttcgtcgtcttcgtcttcgtcttcgtcttcgtcttctgctgccgctcggctcaccctggcggcctcgctgttcgatctcgcgctgcgatggagcggtacgaggtgatccggggcatcgggtcgggcaacttcggggtggccaagctggtgcggaacgtcaggaccgaggagctcttcgccgtcaagttcatcgagagaggccagatgattgatgagcatgttgaaagggagattatgaaccaccggtcactgaagcatccaaacataattagattcaaggaggttgtgctaactcccacacatttggcaatagttatggaatatgctgctggtggtgagctatttgaaaggatttgcaatgctgggaggtttagtgaggatgaggcaaggttcttcttccaacaactgatttcaggagtgagctattgtcattcaatgcaaatatgccatagagatctgaaactagaaaatactctcttagatggcagtgctgcacctcggctcaagatctgtgattttggttattccaagtcttctgtgttgcactctcaaccaaaatcaactgttggcacacctgcatacattgctccagaggtcctcactaagaaagaatatgatggaaaggttgctgatgtttggtcctgtggagtaacactgtatgtgatgctggtcggtgcatatccatttgaggaccctgatgacccaagaaacttccgaaagacgatcactaggatactcagtgtgcaatactcaattccagacgatgttcgagtttcaatggaatgcagacatctgctgtctcgcatatttatcggaaatcctgagcagagaataaccattccagaaatcaagaatcatccgtggttcctcaagaacctgcccattgagatgaccgacgagtaccaacagaacatgcagctgccaggcatgaacaccccggagcaaagcctggaagaagtgacggctatcatacaggaggcgcggaagccaggggaagccacgaaggttgctgggcaggtaccctgcctggggagcatggatcttgacgatgttgatttggactatatcgacgacatcgacatcgagaatagtggtgactttgtttgcgcaatgtgatgttcatgtttgtggttcaaccggtcaagtagtagactagcaagcgagcttcagttggttgttgatgtatgtagatccttggattatgcttctatttgcatctggatcagatgcgttctgtaacagagaaattggcgtctgtggattgcatacaacatgaacttacattctgaaatctatgtaggaatcatttgtgttctcagtgatgtattgaatttgaccatcagttctgttgtgattcc

SEQ ID NO: 3852 - DNA, 1545 bp, Brachypodium distachyon
gcggcgacacatggccgggctacaagcatacgtctccctcctccgtccccacctcaaggctcggctccccagttgatcccatccccatccccatccccgcctcaagggttccagaagcccacctagccagcccgccagccacacctcttctcccttctcgcgggcaccatcgagctagctagccagcttcttcttcccctgtgctctgcctctgctggagggaaggcatgacgagcgatcaagggatggatcggtacgaggtgatgagggacatagggtccgggaacttcggggtggccaagctggtgcgcgacgtcgccaccaaggagcacttcgccgtcaagttcatcgagagaggccaaaagattgatgaacatgttcaaagggagattatgaaccaccggtctctgaagcatccaaatataattagattcaaggaggtcgtgctaactcccacacatttggcgatagttatggaatatgcctctggcggtgagctatttgaaaggatttgtaatgcaggaagatttagtgaggatgagggaaggttcttcttccaacaactgatctcaggagtgagctattgtcattctatgcaagtatgtcatagagatctgaaactagaaaatactctgttagatggtagtgttgcacctcgactcaagatttgtgactttggttactccaagtcttctgtgttgcactctcaaccgaaatcaactgttggaacaccggcatacattgccccagaggtcctctctagaagagaatatgatggaaaggtcgccgatgtttggtcttgtggagtaacactttatgtgatgcttgttggggcatatccttttgaggatcctgacgagccaaggaacttccggaagactatcactaggatactcagtgtgcagtactcaattccggactacgttcgagtctcaacggagtgcatacatctgttgtcccggatttttgttggaaatcctgagcagcggataacaatcccggagatcaagaaccacccatggttcctcaaaaacctgccagtggagatgacagacgagtaccagaggagcatgcaactggcagacctgaacacgccatcgcagagcctggaggaagtcatggcgatcatccaggaggcgcggaaaccaggcgacaatgccctgaggcttgctgggcaggtggcctgcctcgggagcatggatctcgacgacattgactttgacgatatcgacgacatcgacgtcgagaacagtggggatttcgtgtgcccgttgtgaggccccaccaggagtggttcaaaaatcatcgggatttaatttgtttgtggaattatccgagtgtggatccctgtcgtggcatgcttcgtttcgtttctggatcagcaacagagagggtagcgcaatctgtgtataaatacgaagtatcaataataacactgatttacatgcttgttattcgctcagtgcattctgcgcgtcatatttttttagcgtataactcatatttcgttcattaaattggtgatatagacatatgaatcaaata

SEQ ID NO: 3853 - DNA, 1417 bp, Triticum aestivum
tcacggctcgggcccagagtttaccccatcccaatcccctcctctacctcgtgggttccagaacgcagccagctccattcacaccctcctgtcttgcttcctcctccttcacaaggtgcttcttctcaggggagcgctggagcgatcaggagaaagaggggaggatggatcggtacgaggtggtgagggacatcgggtccggcaacttcggggtggccaagctggtgcgggacgtcaggaccaaggagcacttcgccgtcaagttcatcgagcgaggccacaagattgatgaacatgttcaaagggagattatgaaccaccggtcactcaagcatccaaatattattcgattcaaggaggtcgtgctaactcccacacatttggcaatagttatggaatatgcctctggcggcgagctatttcaaaggatttgcaacgcagggagatttagcgaggatgagggaagattcttcttccaacaattgatttctggagtgagctattgtcactctatgcaagtatgtcatagagatttgaaactagaaaacactctcttggatggtagtgtcgcacctcgactcaagatttgtgacttcggttactccaagtcttctgtcttgcactctcaaccgaagtcaactgtcggcacgccggcatacatcgccccggaggtcctctctagaagagagtatgatggaaaggtcgccgatgtttggtcttgcggagtaacgctctatgtgatgcttgtcggggcatatcctttcgaggaccctgatgagccaaggaacttccgcaaaactatcactaggatactcagcgtacagtactctgttccggactacgttcgagtctcgatggactgcatacatctgctgtcccgcattttcgttggaaatcctcagcagcgaataaccatcccggagatcaagaaccatccatggttcctcaagagattgcccgttgagatgaccgatgagtaccaaaggagcatgcagctggcagacatgaacacgccgtcacagagtctggaagaagccatggcgatcatccaggaggcgcagaaacctggcgataacgccctagggattgccgggcaggttgcctgcctggggagcatggatctagacgacatcgatttcgatatcgacgacattgacgttgagagcagcggggatttcgtgtgcccgttgtgacgctcatgagtggttcaaaagttctcttgatggtttacgtgtggatggatccctgtttgtcatgcttccatttagattttgttctggatcacaaattctctgtagcccacagattggccttgctgtgtaaacagtgtaagataagtctacatgcttatatcgaaatcagtagttttacccgaaaaactcttgcttcccagtttatatataaagcaacacagctg

SEQ ID NO: 3854 - DNA, 1380 bp, Avena sativa
gctccacctcaaggctcggctcccgagttaaccccatcccctcctcgacctcgagggttccagacgaccagccagctccttccactcccacaccttctccctctctggccccccttctgtgccatcgagctgcttgctctcctgttcttgagagggagggcgtgaggagcgatcgagaaaaaggatggatcggtacgaggtgataagggacatagggtccgggaacttcggggtcgccaagctggtgcgcgacgtcaggaccaaggagcacttcgccgtcaagttcatcgagagaggccagaagattgatgagcatgttcaaagggagattatgaaccaccggtcactcaagcatccaaatataattcgattcaaggaggttgtgctaactcccacacatttagcaatagttatggaatatgcctctggcggtgagctatttgaaaggatttgcaatgcagggagattcagcgaggatgagggaaggttcttcttccaacaattaatttctggagtgagctactgtcactctatgcaagtatgtcatagagatctgaaactagaaaatactctcttagatggtagcgtcgcacctcgactcaagatttgtgacttcggttactccaagtcatctgtcttgcattctcaaccgaagtcaactgttggcacaccggcatacatcgccccagaggtcctctctagaagagaatatgatggaaaggttgctgatgtttggtcttgtggagtaacactttatgtgatgcttgtgggggcgtatccttttgaggaccccgacgagccaaggaacttccgcaaaacgatcactaggatcctcagtgtacagtactccattccggactacgttcgagtctcagcagattgcgtgcatctgctgtcccgcattttcgttggaaatcctgaacagcgcataaccatcccggagattaagaaccatccatggttcctcaaaaacctgcctgttgagatgaccgacgagtaccagaggagcatgcagttggcagacatgaacacggcatcacagaacctggaagaagtcatggcgatcatccaggaggcgcggaagccaggcgataacgcccttaggcttgctgggcaggttgcaagcctggggagcatggatctagacgactttgattttgacgatattgacgacattgacattgagaacagtggagatttcgtgtgcccgttgtgatgctcatgagtggtccgaaagtagcgggatttgatttttttgtatggtttatctgtggatggattcctgtttctcatgcttctagtttacatgcttcccgtgaccgagagattggccttgttgtatatataaacaaatgatttgcaatgttgtgttcttagcgg

SEQ ID NO: 3855 - DNA, 1363 bp, Secale cereale
gccagctccattcacaccctcctgtctgccttgcttcctcctcccgcaccataccatcgaggtgcctgccctcctcctcttcttcttctacttcttcggagagcgcgcgtgcggactgaccagaggaggggtggatggatcggtacgaggtggtgagggacatcgggtccggcaacttcggggtggccaagctggtgcgggacgtgaggaccaaggagcacttcgccgtcaagttcatcgagcgaggccacaagattgatgaacatgttcaaagggagattatgaaccaccggtcactgaagcatccaaatattattcgattcaaggaggttgtgctaactcccacacatttggcaatagttatggaatatgcctctggcggcgagctattccaaaggatttgcaacgcagggagatttagtgaggacgagggaaggttcttcttccaacaactgatttctggagtgagctattgtcactcgatgcaagtatgtcatagggatttgaaactagaaaatactctcttggatggtagtgttgcacctcgactcaagatttgtgactttggttactccaagtcttctgtcttgcactcccaaccgaagtcaactgtcggcacaccggcatacatcgccccggaggtcctctctagaagagagtatgatggaaaggtcgctgatgtttggtcttgtggagtaacgctctatgtgatgcttgtcggggcatatccttttgaggaccctgatgagccaaggaacttccggaaaacgatcaccaggatactcagtgtacagtactccattccggactacgttcgagtctccatggattgcatacatctgctgtcccgcattttcgttggaaatcctcagcagcgaataaccatcccggagatcaagaaccacccatggttcctcaagagattgcccgttgagatgaccgatgagtaccaaaggagcatgcagttggcggacatgaacacgccgtcgcagagtctggaagaggccatggcgatcatccaggaggcgcagaaacctggcgagaacgccctagggattgctgggcaggttgcctgcctggggagcatggatctggacgacattgatttcgatatcgacgacattgacgttgagagcagcggggatttcgtgtgcccgttgtgatgctcatgatgagtggttcaaaagttctcttgatggtttacctgtggatggatccctgtttgtcatgcttccattagattttcttctggatcacaaattctctgtagcctactgattggccttgctgtgtaaacagtgtaagataagtttacatgcttatattatatcaaaatcactagttttaccggaaaaaaaaaaaa

SEQ ID NO: 3856 - DNA, 1296 bp, Elaeis guineensis
aaagaaccggggggtggtgggtcttgtctctctgggattgatgcttgcttgcttcgatttctctccgttctctgaatcgaaatggagcggtacgaggtgttgagggaaatcggggccggtaattttggggtggccaagcttgtgagagatgtttggaccaacgaactctatgccgtgaagctgatcgagagagggcacaagattgatgaacatgttcagagggagatcatgaatcacagatcactgaggcatccaaatatagttagattcaaggaggtcgtgctaacacctacacatctagccatagttatggaatatgctgctggtggtgagctttttgtgaggatatgcaatgcaggacgatttagcgaggatgaggcacggtttttctttcaacaattgatatcaggagtcagctattgccattccatgcaaatatgtcatcgagatcttaagttagaaaatactctgttggatggtagcacagcaccccgccttaagatatgtgactttggttactcaaagtcttcagtgctgcattcccaaccaaagtccactgttggcacaccagcttacattgctccagaggttctttcaagaaaggaatatgatggaaagattgcagatgtttggtcttgtggagtaacattatatgtaatgctggttggggcttatcccttcgaggatccagatgatccaaggaattttcggaagacacttgggcggatacttagcgtccggtactccattccagactatgtacgagtatcaaaggaatgtagacatcttttatctcggatatttgtagctaatcccgaacagagaattaccattccagaaataaaaagccacccatggtttctaaagaacctgccagttgagctaactgatgagtatcagaacagcttgcagagttctgacatgaacactccatcccaaagcatagaagaaatcatggccatcatacaagaggcacggaagcctgccgagagtccaaaacttggtggtgggcactttgttggaggcgacagtggggacctagatgacatggatgcagatgtggaccttgatgacattgagacaagtggggattttgtttgtgctctttgaaagttaggaatgcatgatctgcctactagcttgtggttatgtgaattcttccatccttcgttggaagaaaatgggatgtttaactccatgaggagtaattccagtttgtcatgcatagagatcactgttattgtgtagatgaaccaagtcatgctcgtgatgtggaatacaccaaatttctttgtt

SEQ ID NO: 3857 - DNA, 1611 bp, Amorphophallus konjac
gtgttgcctttttgttcctggttgtttatgggtgaagggagaccaagagggaagctgtgggaaggagggtgaggtgagatcactcgggttgatgtccttgccctgttgcattctgttgttggccgggttaagccaatctctgtaggagggatggagaggtttgaggtgctgaaagatatcggttctgggaactttggggtggccaagctggtgagggacaggtggaccaaggagcaattcgcagtcaagttcatagagaggggccaaacgattgatgagaatgtacagagggagatcatgaatcacagatctctgaagcatccaaacattgttaggttcaaagaggtattgctgactcctactcatctagcaattgttatggaatatgctgccggtggtgagcttttcgagaggatatgcaatgcagggaggttcagtgaggacgaggctaaggtttttcttcagcaactaatatcaggagtcagctactgtcactccatgcaaatttgtcatagggatctaaaattggaaaatacactgttggacggaagcgtggctccccgcgttaaaatatgtgactttggttattccaagtcttcagtgctgcactctcagccaaaatcaacagtgggaactccggcttacattgcaccggaagtattatctaggaaggaatatgatggaaagattgcagatgtttggtcatgtggagtaaccttgtacgtaatgctagttggagcttatccttttgaggaccccgatgatccaaggaacttcagaaagacaatcgcacggatacttagtgtacagtactccattcctgactatgtgcgagtgtcaacagaatgccgacatcttttatcacgcatatttgtagcaaaccctgaaaagaggataactattccagagataaagaaccacccatggtttctgaagaacttgccaatagaactgacagaggatgcgcagggtaaccttcagaataacgacgtcggtggtccgtctcagagcattgaagatataatgtccataatacaggaagcacggaaacctcccgaggggcctaaggttgggagtgggccgttcgttggcgggggcagcatggaccttgacgatgtggatgccgatgcagacctcgacgacatcgaaacgagcggggactttgtatgcgccctgtgaacatgtcaacgttaatgcgcagggcagctgattcctcggcagagctgattctattcctccagagatagacacccatcataatctccactgtgtcgaggaacggaactaaatgcttctcttctctgccattctttccggcagaataggtgcagattctttctgcacaaaaggtttggaagctgttgtgggtatagattacaagccgaatctgccatgtccatgtggttcatgggtactctcccggtaattgcttgctgcaatggacgacggagcttcgattgttgacatctgagaaacttttcagagtttgcttctgggaagggattacagacttccggtttttaagaggagagtgtgtcatagatgggaagtgcagtgcggtgcctcttgtttgcgtcttctttttaccgccaatttgtactttcgtttccg

SEQ ID NO: 3858 - DNA, 1790 bp, Vitis vinifera
ggaaaattcagcgggtgccgtagggacgtggcaaatctaggaccgccagccgttccctcatggccatggaaaacaagggtatccgcatgctgcacaccgcctgatactaacaaaaccatgtcattgtcagctgcaaattccaggtctctccacgtttttctacacgtttctccggtcaccatgctcacagcgtaaaatacaattgaaggctgcccgaccgatacaatgggggtttgtacttcatcaaggacgggataaactcaaaactacaagttgcctttactccaacagcttagaaatccatgcccctttctttgacgaagaactgaggcgatagagaggggagaggaaaaaattggaaatatatagctagactcttcggattttgtagtttgatgatctaaagctatggagcgttacgagattattaaagatattggatctgggaatttcggggttgccaggcttgtttcggataagcgcactagagaactctttgctgttaagtttattgagagaggccagaagattgatgaacatgtgcaaagggaaattatgaaccatagatcattgatgcatcccaatatagttagattcaaggaggtcttgctgacaccaactcatctagcgatagtcatggagtatgctgcaggaggagaactctttgggaggatatgcaatgctggtagattcagtgaggatgaggcaagatttttcttccaacaactgatatctggagtcagttactgccattcaatgcgaatttgtcatagagatcttaagctggaaaatacactcttagatggaagtacagcaccacgtgtcaaaatatgtgattttggatactcaaagtcatctgtgttgcactctcaaccaaaatctactgttggaacaccagcctacattgcacctgaggtcctgtctagaaaagaatatgatgggaagctctcagatgtttggtcctgtggggtcactttatatgtgatgctggttggggcgtatccctttgaagatcctgatgatcccagaaacttcaggaagacaattggtagaatacttagcgtccactactcaattccagattacgtcagagtgtccattgagtgtagacatctgctatctcgagtttttgtggcaaacccagataagagaataacaatcccggaaattaagacacatccgtggttcttaaagaacttgcctatagaaatgatggatggaggaagctggcagaaaaatgatgtaaataacccatcccaaagtgtagaagagatactatccataatacaagaggcaaggaaaactaccggagtgcgcaaggcgggtgggccttttatggaaggcagcatggatcttgatgacattgacgctgatgaagatatagaaactagtggtgattttgtgtgtccattgtaaacaatttatacaaatcaaaagatatagaaagtggcgatgattttgcgtgttcattttaaacaatttatacgaacatattccaccttgctgaggcagtgcgtccatggtcagaggcatcgattatcagatttttgttaagttggaggaatccgtttgtctgcttacatgttccttgtgtgtaacgaagctaaataagtccaaattgtttctgcttggggaattatgtggaatattttataattgtaacatgaactgtctcatggatctgatttttttttttccccaatttattgctattctgggcttcctatgaagccagccgccccccaccaaccaaaaaccccgattcatgaaacccagggtatttgagaaaa

SEQ ID NO: 3859 - DNA, 1438 bp, Populus trichocarpa
ctaaacctccacaaacttttccatttcaaacgttttaggcatgtgtttatgttctgattttccaagtcgttgagaagaaaagaacagaaacgtttatagacagatcgacagaggagtggagaagtgagacttgaatataactatataaaaattgcagtatttttgctgttgctatacttcttttggtagctatggagcgttatgagattatcaaggatattgggtctggaaattttggggtggctaagctggtcagagataaatggactaaagagttctttgctgttaagtttatcgagagaggccaaaagattgacgagcatgtgcaaagggaaattatgaatcataggtcattgaagcatcccaatatagttaaatttaaggaggtcctgttaactcccacccatttagctattgtgatggaatacgctgcaggaggagaactttttgagaggatatgcaatgctggtagatttagtgaggacgaggcaaggattttcttccaacaactgatatcgggagtaagttactgtcactcaatgcaaatttgtcacagagatcttaagcttgaaaatacactcctagatggcagcacagcgccgcgtgtcaagatctgcgacttcgggtattcaaagtcagctgtgttgcattctcagccaaaatctaccgtgggcaccccagcttacattgccccggaagttctattaaaaaaggaatatgatgggaagatctcagatgtatggtcctgtggggttaccctatatgtaatgctagtcggggcatacccatttgaagatcctgatgatccaaaaaacttcagaaagacaatcgggaggatactcagtgtcaactattcaattccggattatattcgtgtttctgtagagtgcaatcatcttttatcgcgaatatttgtggctaaccctgaaaagagaattaccattccagaaataaaaaatcatccatggttcttaaagaacttgcctatagagctgatggaaggacaaagctggcagagcattgacgtcaacaacctgtcccaaagcattgaagaagtcctgtctataatacaggaggcaagcaaaccagtctccctgtcaaaggctgtagggcatttgcttggaggcagcatggatcttgatgacttggatgctgacgcagaccttgaagatatcgagacaagtggtgatttcgtgtgcccatgatgattaaaactatgtaaatagattgtcaactttcctgaggtattgtctcaatgattgtgagcaccagatcttcactaaggaactctttacacagtataatccatgtttggccatgtggcatatggatgccccatctgtagatcccttgtgtttctttgttcaatcgatcacagcaacattttgtaaggtcttgacgtgcatggcatggttaattcagatacctctagaacccg

SEQ ID NO: 3860 - DNA, 1514 bp, Populus trichocarpa
actcggacttcggtggcaataacttgcaaggtacgtacagggctacctaaacctccacaaacttttccatttcaaacgttttaggcatgtgtttatgttctgattttccaagtcgttgagaagaaaagaacagaaacgtttatagacagatcgacagaggagtggagaagtgagacttgaatataactatataaaaattgcagtatttttgctgttgctatacttcttttggtagctatggagcgttatgagattatcaaggatattgggtctggaaattttggggtggctaagctggtcagagataaatggactaaagagttctttgctgttaagtttatcgagagaggccaaaagattgacgagcatgtgcaaagggaaattatgaatcataggtcattgaagcatcccaatatagttaaatttaaggaggtcctgttaactcccacccatttagctattgtgatggaatacgctgcaggaggagaactttttgagaggatatgcaatgctggtagatttagtgaggacgaggcaaggattttcttccaacaactgatatcgggagtaagttactgtcactcaatgcaaatttgtcacagagatcttaagcttgaaaatacactcctagatggcagcacagcgccgcgtgtcaagatctgcgacttcgggtattcaaagtcagctgtgttgcattctcagccaaaatctaccgtgggcaccccagcttacattgccccggaagttctattaaaaaaggaatatgatgggaagatctcagatgtatggtcctgtggggttaccctatatgtaatgctagtcggggcatacccatttgaagatcctgatgatccaaaaaacttcagaaagacaatcgggaggatactcagtgtcaactattcaattccggattatattcgtgtttctgtagagtgcaatcatcttttatcgcgaatatttgtggctaaccctgaaaagagaattaccattccagaaataaaaaatcatccatggttcttaaagaacttgcctatagagctgatggaaggacaaagctggcagagcattgacgtcaacaacctgtcccaaagcattgaagaagtcctgtctataatacaggaggcaagcaaaccagtctccctgtcaaaggctgtagggcatttgcttggaggcagcatggatcttgatgacttggatgctgacgcagaccttgaagatatcgagacaagtggtgatttcgtgtgcccatgatgattaaaactatgtaaatagattgtcaactttcctgaggtattgtctcaatgattgtgagcaccagatcttcactaaggaactctttacacagtataatccatgtttggccatgtggcatatggatgccccatctgtagatcccttgtgtttctttgttcaatcgatcacagcaacattttgtaaggtcttgacgtgcatggcatggttaattcagatacctctagaacccgatcgcttgttcttctctttattaaatggcg

SEQ ID NO: 3861 - DNA, 1507 bp, Citrus sinensis
ccctaatgtcgtaactgcagtcaaaataatcttaaatcttttactttcttctgcttccaagactttttaacttaatgatgacggtaacttgcaagccgcgacctctgttaccggcttgagtttcagaagcctttttctttttttggtccttcaagttcaagccttgcaaagaagaggaaatcatggagagatatgagattgtgaaggacatagggtctgggaactttggggtagccaagcttgtcagagacaaatggacaagggagcttcttgctgttaagttcattgagagaggccaaaagattgacgaacatgtgcagagggaaatcatgaaccacagatcattgaagcatcctaatattgtcagattcaaagaggttctgctgacccctactcatctagccatagtcatggaatatgctgctggaggagaactgtttgagaggatatgcaatgctggcagattcagtgaggatgaggcaaggtttttcttccagcaactgatatcaggagtcagttattgccattctatgcaaatttgtcacagagatctcaagcttgagaatacactcttggatggcagcactgctccacgtgttaagatatgtgactttgggtactcgaagtcttctgtgttgcattctcaaccaaaatctacagtaggaaccccagcatacattgcacctgaagttctaactaaaaaagaatatgatgggaagattgcagatgtttggtcttgtggggtcaccttatatgtgatgctagttggggcatatccttttgaagatcctgaagatccaaaaaactttagaaagacaatcggtcgaatactcagtgtccactactcatttccagattatgttagagtttccctggagtgtaaacatctactttctaggatttttgtggcaaattccgaaaagagaattactattccagaaatcaaaaaccatccatggttcttaagaaacttgcccatagagcttacagaaggagggagctggcaaagccatgatgtaaataacccatcccaaagccttgaagaagtgctgtccctaatacatgaagccacaaaaccccttgaggctcccagagtcgggggacatttacttggtagcagcatggaacttgatgacttagatgctgatgctgatcttgaagataccgagacaagtggcgattttgtgtgcccattgtgatcaaagcatataaataaagaggtattgttttcaccatcccaagaatcagaattttgttagtgaaagtgattaagtgattactctattacaaatcctttgttttaacatttggcacatttatatatgatctttctgtatcacctgtgttgtataggtattaatataatatcttctttttttttaactacaattatatgctgttgggaaaagcatatcataaagcgacctgatatatatataatatgattgtagcaccttctaaatgtgttgacgtgtaggattattcattcagactccatggatacttc

SEQ ID NO: 3862 - DNA, 1575 bp, Fragaria vesca
tggctgctctggtttgtctcatatgccccccatgaagacttttagaggtgaaggagaagaagggaccgattgattgctggcttaacccaataaagctttcagctttctgcattaagagagagttgagacttggaggcctttccataacccatgaagaagatgcttcacgcaaacataaaggaagcgactttatagcttcacagttcaataatacaagaagaagaagcataaaagagacagagagctagagagcttgtggtaccaaaatagttgctacttagtacttgaagcttttgctagagtttttgaaatggagaggtatgagatagtgaaagatattggttctgggaactttggtgttgcaaaattggtgaaggacaaatggagtggtgagctctatgccatcaagttcattgagagaggccagaagattgatgagcatgtacagagagagatcatgaaccacaggtcactgaagcatccaaatatcataagatttaaggaggtcttgttaacacaaaccgatttagcgattgtcatggaatatgcagcaggaggagaactttttgaaagaatatgcaatgctggtagattcagtgaagatgaggccagatttttcttccagcagctgatttcaggagtcagttactgtcattcaatgcaaatctgtcacagagatcttaaactggagaacacacttctagattcaagctcagctccacgtctcaaaatatgtgatttcggttattccaagtcatctgtgctgcattcacaacccaaatcaactgtaggaacacctgcctatattgcaccagaagtcctgtcaaaaaaagagtatgatgggaagatagcagatgtttggtcttgtggggttaccctatatgtgatgctggttggtgcttatccttttgaagatccagaagatcccagaaatttcaggaagacacttcagcgaattctcagcgtcagctattcaattcctgactatgtacgcgtttccagggaatgtacacatcttctttctcgaattttcgttgctaaccccgaaaagagaattacaatcccagagataaagcagcacccctggtttctgaaaaatttaccatcggaattcatggatgaagatgacatgcagattggtgaggttcagaaaaatgagatttcacaaagtgttgaagatatagtgtccattattcaagaggctcgaaaacttggtgatggcatcaaagttggacattttcttgggagcatggaccttgatgagatagatgatgccgacatcgatgatatagaaactagtggtgattttgtatgtgcgttgtgatctgtagtggtgcaaagttcttatcataacacacctttaacacttagcagcttctcaaggccaaaaaccttttttcccaaaaggaagttggaaggatgagccgatgaggcatcttcttttgatgttggggaatcaaactatctgttgcagaaagtgttgttattttcctttgcttggaagtttgctcaatcggtctgtttatcttttcttcttgtctttctaagagaatgctaatttcattctaaacaaaa

SEQ ID NO: 3863 - DNA, 1285 bp, Setaria italica
gaagaagtaaccctagttaacagtcgaagctacggagaccgagccatgccgatcgaggacgtgagcatcgagacgaccgaggcggcgggcccccaaaaggtgccgtactgggacccgccgccggcgccgctcctggaaacgagcgagctgatgaagtggtcgctgtaccgcgcgctcatcgccgagttcgtggccaccctcatcttcctctacgtgagcatcgccaccgtcatcgggtacaaggaccagtccaaggccctggcgtgcaacggcgtcggattcctcggcgtcgcctggtcctttggcgccaccatcttcatcctcgtctactgcatcggcggcatctcaggtgggcacatcaacccggccgtgacgttcgggctgttcgtggggcggaagctgtcgctgttgcgcaccgtgctgtacatcgtggcgcagtgcctgggcgccatctgcggcgtggccatcgtgaagggcatcacgggggatcagtacagcctcctcggcggcggcgcaaactcagtggccgacggcttctccgtcgtggccggcctcggcgccgagatcatgggcacgttcgtcctcgtttacaccgtcttctccgccaccgaccccaagcgcaccgcgcgagactcattcatcccggtgctggtgccgctgccgattgggttcgcggtgttcgtggtgcacctggcgaccatccccatcaccggcacgggcatcaacccggccaggagccttggcgccgccgtaatcttcggcgaggcatggaaaaaccactggatcttctgggttgggccgctgatcggggcaacggcggcggcgctgtaccacaagctcgtgctgcgcggggaggccgccaaggcgctcggctccttcaggagcaccagcgccacggtgtgagcacgcgtgcgaacggcgagagaagcttttggagattaggcagccctgcttcctgcaattgatttctctgctcatcggttattcgttgtcgtctcgtttaattaatatactacagcagctagcagatccttgcatgaactgcatgtacgtgtaagagtgtcgaggtgtgcgcttgcttgtctgtgccatttgtttttgggtttgggactgcaaggtcgtcgtgtccatgtataaacctttatatgttctgctttataagtactttgttaggaatagctcctactccctccattccaaattgtaagtcattccaagaatcttgaagagttaaagcacctcaagtttgatcaaaattataaagaaaattataaagatttatgac

SEQ ID NO: 3864 - DNA, 1976 bp, Panicum virgatum
ccaaaccattttatgtgaaaccaaaccaaacgagagctgaagtaaccagtttcccacctaactgaagtaggaccaaagcaaaatccaaactgttgtgcccggtttccacccgaactgttatcaggttgaatctgatccggctcccctactcgatcgggcaaggcgagcaggtggaacgaaaggggaaaagcgcctgcaatgcagcgctgggggcaagcttgccagtttgccaccggccggccgggccggtcacgggtcaccaaaacaaccagatgcgcaacagccctcgcattccattctagtgtgtagtagctcctcttttaattcagttcctaaaagaagcacaatctcgtacttgttcgttttaaaaagatgaaagaagttcgccgtaatttgagcttgcagcgacacgccgacacaccttaccgcaagcgcaacgtgcacaccaaaccctgcgtggataagagcacgcgcgcgcacatgagcaaaacaatcgtgtagctttcacgtcagctcatatgtgcgagccaacttttggacgctatcgaatttcaccatcttcattttgaaaattctagcaaagtacgggaaaaaaggataaatttgtggggaacggtgagtcacaaggaaagaatcgtttgaaatatctttcgtcggccgtctgcgggccgcttctcgatcgctagctgctagcttcttcccctatttaaaccacggccactgccttcccctccgcgcgtctaagaaccctaacagtagagagaagctaggagctagcgctgtgcgcgacactgagctgagagaaggcaccgccggccggaccatcatgccgaaggaggatgtgagcatcgaggcggcggcagccgagaaggcgccgtactgggacccgccgccggcgccggtgctggacacgagcgagctgcagaagtggtcgctgtaccgcgcgctcatcgccgagttcgtggccaccctcatcttcctctacgtgagcatcgccaccgtcatcgggtacaaggcccagtccaacaacctgcagacgtgcaccggcgtcgggttcctcggcgtctcctggtccttcggcgccaccatcttcatcctcgtctactgcaccggcggcgtctcaggcgggcacatcaacccggccgtgacgttcgggctgttcgtggggcggaagctgtcgctggtgcgcaccgtgctgtacatcgtggcgcagtgcctgggcgccatctgcggcgcgggcatggtgaagggcatcgtggggggcgatctctacgacaccttgggcggcggcgcgaacgcggtcggcagcgggttctccgtcgcggcggccctcggcgccgagatcgccggcacgttcgtcctcgtgtacaccgtcttctccgccaccgaccccaagcgcaccgcgcgcgactccttcatcccggtgctggtgccgctgccgatcgggttcgcggtgttcgtggtgcacctggcgaccatccccatcaccggcacgggcatcaacccggcccggagcctcggcgccgccgtcatgtacaacaaggcatggagttaccactggatcttctggatcgggccggcgatcggggcgacggcggcggcgctgtaccacaagctcgtgctgcgcggggaggccgtcaaggcgctcggctccttcaggagcaccagcgccacggtgtgagccagcatgcccagcggcgaatgaagcttttgaaactggaggcctgcactgctccccactatatccattgtcctccaactgatttctctgctcaatcattcgtatgtcctcccgtttaattaaagtactagcagatccttgcatgatgaactgcctgtcaaggtgcgcgcgcttactgcttgtcgatctgtgccattttattttttttatttgggactacaaggtcgtcgaacatgtataaataaacatttatatgttatgctttatgagtattttgttgagaatgctgccttaa

SEQ ID NO: 3865 - DNA, 1229 bp, Panicum virgatum
agagaagctagtagctagcgctgtgcgcgacactgagctgagagaaggcaccaccggccggaccgtcatgccgaaggaggacgtgagcatagaggaggacgtgagcatagaggcggcggccgccgagaaggcgccgtactgggacccgccgccggcgccggtgctggacacgagcgagctgggcaagtggtcgctgtaccgcgcgctcatcgccgagttcgtggccaccctcatcttcctctacgtgagcatcgccaccgtcatcgggtacaaggcccagtccaacaacctccagacgtgcaccggcgtcgggttcctcggcgtcgcctggtccttcggcgccaccatcttcatcctcgtctactgcaccggcggcgtctcaggcgggcacatcaacccggccgtgacgttcgggctgttcgtggggcggaagctgtcgctggtgcgcaccgtgctgtacatcgtggcgcagtgcctgggcgccatctgcggcgcgggcatcgtgaagggcatcgtggggggcgatatctacgacgcctatggcggcggcgctaacgcggtgggcagcgggttctccgtcgctgcggccctcggcgccgagatcgccggcacgttcgtcctcgtgtacaccgtcttctccgccaccgaccccaagcgcaccgcgcgcgactccttcatcccggtgctgctgccgctgccgattgggttcgcggtgttcgtggtgcacctggcgaccatccccatcaccggcaccggcatcaacccggcccggagcctcggcgccgccgtcgtgtacgacatggcatggaaaaaccactggatcttctggattgggccggcgatcggggcgacggcggcggcgatgtaccacaagctcgtgctgcgcggggaggccgtcaaggcgctctgctccttcaggagcaccagcgccacggtgtgagccagcggcgagggaagctttttaaactggcggcctgctccccactatactatcctccaactgatttctctgctcaatcatcgttgtcgtcctgtttaattaaagtactagcagatctttgcatgataactgcatgtcaaggtgcgccctcttactgctttgtcgatctgtggcatttgttttttttatttgggactacaaggtcgtcgaacatgtataaataaacatttatatatatgttttgctttatgagtattttgttgagaatacaatagactgctgccttaac

SEQ ID NO: 3866 - DNA, 980 bp, Panicum virgatum
gacagagatctctcgcttgggaatattattgtcaacttcagcttagggaaaccacaaattcacaacaaatggacttccgcagctattaaggtgtatcgtgatacagtttcaactggcctagtaccttcaagcgatgttttatctcaagtgttgggatgtttgaggcctcctcattacaattcgctgaagagtagttttattgagaacatgcaaataagttgtgatattccacataatccaaatataaattcactcttcgaaggattcggtgaatatgacattcgtgctttttcgattctggaggaggctgcttcactaggagcagttggaagtatttccatgaaagatactaggattgttattgatgcaagaaaagttaaggatccacacagccgaggtttctcttcttacaacattgagatccttgaagcatcgacttgctgcaggtgcaaggttaccaaacgtgacaatcttgttacccacagaaaagaaacaggtcgacattgatgaaagggaaaaaacactaaagcttgctggaagaattggtcaagcagttggttctctcctgaggcgattaggaatttcataccaaggggaggagtcccacgggaggatgaggatcaatggcctcacgttaaggagatggttcaatccaaaattgaatagcaaatcctccagtgccgcaccagctgacttgctttcactatcgtcacgtttagccaaagggattgctgatcagcaacgcgacatcagaagcctttcattctagtaatgcacgtcaatccagtagcaacagatctcggtaacctttgtgagaacgtccaggatagtaaaatgtgtgaatagtttgttcagaggaaggaaatatatatactacatatatgtcatctgtgaaaagattattcagaataaagaaatgcacacatctaactttgtaatcaggatgcataaaattaattcagttttttagtgaatgaacc

SEQ ID NO: 3867 - DNA, 1235 bp, Saccharum officinarum
cttaaaggctgttgatatccttaatgagatgaacagattaggggtccatccaaatgagataacgtactcagtcttatttgttgcttgcgaaagaaatggtgaagcacaactaggtttggatttgtttgaacaattaaaaatggatggcattggcatcaatcccaccattattggttctcttactggtttgtgtcttcaaatgttcgacaatgatttctcacttggaaatattattgtcaacttcagctcagggaaaccacagattgacaacaaatggacttcctcagcagttatggtgtatcgtgaggcagtttcagctgggctactaccctcaagtgatgttttatctcaagtgttggggtgccttaggcttcctcatggctcttctctgaagagtagtttcattgaaaacatggggataagtagtgatattccacaacacccaaatataaattcacttttcgaaggattcggtgaatatgacattcgagctttttctatactggaggaggctgcttcattaggagcagttggaagtatttccatgaaagagacccgaattcttattgatgctagaaagttaaagatctacacagccgaggtatctcttcttagaacattaagatctttgaagcatcgactggctgcaggttcaaggttaccaaacgtgacaatcttgttacccacagaacagaaacaagttgacattgatgaaaaggagaaaacacttaaacttgctggaagaattggtcaagcagttggctctctcctgaggcgattaggaatttcataccaaggggaggagtctcatgggaggatgaggatcaatggcctcacgttaaggaggtggttcagtccaaaactgaatagcaaatcctctgctgccgcgccagctgacttgcttccactaccttcgcggttagccaaagggattgctggtcagcaacgcgacattagaaacctttcactcgagtagtagaccagtactgcacggctatcctacagcaaccgatctcagtaacccgtgtgataagaagcgtagtatagtaagatgtgtcaagagttttttttttgggttgatagtggatatgcgaagagtttggtagaaggaaatacataatccatcaatctgtaaaggtattattcaaaagaaagatatacacgatacgtcaaacttttgtaatcatgtcacgtaatgagattttttcccctgaacataatatacgtatacagtt

SEQ ID NO: 3868 - DNA, 1066 bp, Zea mays
cctactgacatgacttgtcttcaggtttgtgccttcaaatgttcaacattgatttttcgcttgggaatattattgtcaacttcagctcagggaaaccacagattgacaacaaatggacttcctcagcagttatggtgtatcgtgaggcagtttcagctgggctactaccctcaagtgatgttttatctcaagtgttgggatgtctgaggcttcctcatggcagttctctgaagagtactttcattgaaaacatgggagtaagttgtgacattccacaatacccaaatataaattcacttttcgaaggattcggtgaatatgacattcgagctttttctatattggaggaggctgcttcattaggagcagttgcaagcatttccataaaagaaacccggattgttattgatgctagaaagttaaagatcttcacagccgaggtatctcttcttagaaccttaagatctttgaagcatcgattggctgcaggttcaaggttaccaaacgtgacaatcttgttacctacagaaaagaaacaagttgacattgatgaaaaggagaaaacacttaaacttgctggaagaattggtcaagcagttggctctctcctgaggcgattaggaatttcataccagggggaggaatctcatgggaggatgaggatcaatggcctcacgataaggaggtggttcaatccaaaactgaatagcaaatcctctgctgccggcccagctgacttgcttccactaccttcgcggttagccaaagggattgctggtcagcaacgcgatattagaaacctttcactcgagtagtagactagtactacacggctatcctggaagcgatctcagtaacccgtgtgataagaagcgtagtatagtaagatgtgcaaacgtgtgaagagtttgttcggtagaaggaaatacataatccatcaatctgtaatgacagtagtcgaaggaaagatatgcacgatgcatcaaacttttgtaatcatgtcaggtaaagggattttcccctgaacataatatacatatagagttacatatttggacgcctgctc

SEQ ID NO: 3869 - DNA, 4395 bp, Oryza sativa
aagataatttaggcgcgcaaaacagcgacctccacacaccctcgcaaactccggataaacctcatcatctcatcatcttccccgccttaatcactccaccgcctcctccttcccctcccctcttcgcctcgtccgccatggacgcctcctcctcctcctcctcaacgccccacgccctcaccctcctcacctcctccccacgcttcctccacctccccctctgctccccttccccccgccgccgccacgccggtggtggtgcgctgctcctgcgcccgccgcatcgccgcagggcggagcccgggggagtacgccatgctcgccgcgcgccgagctgcttgctcggcggcggcggttcggcgggagccgccgtggcgttgggtgggtcggcggttgccgcggcggctgcgctcctcgccgccgccttgcagcttgtctggctacggtggcgcggcggggattctcccgaggaggaggaggtcagcatatgctttctgagtgattacggatttgaaaaataaaacggatcatttttctttttgggtcaaatggaatgcggccctacaggtcatagttgaagaattctgttttaatctcactgaaacggaattctccattcttccaagaaatcatctactacctctgtaaatgtgataaaagaaaactgtattaatcaaggaatgtaaattatgaatggacagaactgtaaacggccagtacaagtcatgcctactagtttccacatatttgtctaatgcaagaaataaatcaggatagaaaaaccttattctggttttgtctacagatgagctaaatctgtgtgagtttacgcggtcagttggtagctactaaattgacaaatttgggaaaatcaactaaactggtgtccattgtgagacaatacttgttaaggttcaaaaatcatcattgccttatttatacttttatcataatcgcttgtcatatccaatatcaagcacagtctttctcatttcttgcaagatgaaaaagtgtcttatttttcagttgggcatggaaaatggcagctgacgatgcacttttagcaaaaaaaaaaaagggaacatgatttaatacaaaaaaatcaatttctttctaacttgtggagatatcgcaatcatgcaggtttcacatgaacatgacaaaagaatcgtaaataataaggcccttggcacatcgacagacttgttagatgacagtagctattcatctcgaagaactcatgaaaatgtcttttcagagccatctgtttctggaagaatgactgtggatagaacggattgccaaactgatgttttttctggtgtagatactgtaaataatacaacacaggttggttctgtaattagtacttacaggtcgttagacacatttgaaggtgtttatggaccagcaaacacaagttccatagaaaaggtccaagatattctcccacaatcgcgttctgtgtctgatggacaacatcaaagcagacattttgctaacagaagggctcagctaggtggactgcctcatcagtttttatcactttcaaaacagaacgagcagactaaaaatggccaaggtcctcctgataataaaacagatagtgagggtgccaatttacttggatgccatcaaagtgatcaaggagactatgttgattttacgtctctttcatccttcaaaagaatcaacgagcatccactgaattttattcctgaagcccatgccagcaatctgtttgaaccaagaaaagcatccgagttcacaaattcttatgcagggggctcatatttgagagcagggcgattggttccagttgcatgcttaagggatggtcctgtgagtaaacaaaagaaagcaatgaatgaccatgatgatgcaaagttaattggctggagtatttctaatttactgagcaaggagaatccagaaaactctacttcagcaaatagagctggattgaggggaacaaaggacgtgccagattacttgaggagatacaatagtttgttaattgatggaagattgaaagactctgtggatctattggaaagcatggagcaaaagggattgcttgatatgaataagatccaccatgctagctttctgaatgcctgtaagaagcaaagggctgttccggaagctgttcgtttttgcaagttgatcaataacccaaaaatgagtaccttcaatatgcttttatctgtgtgcgctaattcgcaagattttgatggggctctccaagttatggtgctcctaaaggaagctgggctaaaacctgattgtaaactttacacaacacttatatcgacttgtgccaagtgtggaaaagttgatgctatgtttgaggtcttccatgagatggtcagtgctggaatagagccaaatgttaacacatatagtgcactgattgatggctgtgcaaaagctggtcaagtagcaaaagcatttggtgcttatggtatcatgagttcaaagaaggtgaagccagatcgagttgtctttaatgctttgatcagtgcatgcggtgaatctggagcggttgctcgagcttttgatgttctatcagaaatgacagcagaagcctctgaatctaaaggatccaaaccgattcttcctgatcatgtcacagttggagctctgatgaagacatgtattcaggctggccaggctgatcgagctcgtgaggtatacaaaatgcttcaggagtacaatataaagggtactccagaagtttacacaatagcattgagaagctgtagcttgactggtgatttaggatttgctctgaagatctatgaagatatgaacaagattggagtacaacctgatgagatgtttctgagtgctctagttgatgttgctggccatgctaggagggctgatgctgcctttgagataatgaaagatgcaagagcaaagggatatcaagttggaaccattgcatacagttcattaatgggtgcttgctgcaatgccaaggactggaaaaaggcattgcagctatttgaggagatcaagtcaatcaaattaatgccaaccgtttcaatgatgaatgctctgatcaccgcattgtgtgatggtgatcaagttttgaagtcttttgaggtccttagtgagatgaagagattaggagtctgtccaaatatgataacctattcggtgttatttgtggcttgtgaaaggaatgctgaagcacaactgggtttggatctatttgaacaattaaaaatagacagtattgacctcaatcccacaatcgttggttgtcttactggcttgtgtctacaaatgttcgacaatgatctttcactgggcaatatcgttgtcacattcaacttagggaaaccacagattgagaacaaatggacctcctcagcaattaaggtctaccgtgaggcaatttccacaggactattaccctcaagtgatgttttgtctcaagtgttgggatgtttaaggtttcctcatgataatacattaacaaatactttcattgaaaatatgggaataagttgtgatattccacatcatcccaatgtgaattcactgttggaaggttttggtgaatacgacattcgtgccttttcaatactggaggaagctgcttcgttaggagcagttgaaagtatttccatgaaagatacccgtattcttgttgatgcccgaaagtcaaagatctacactgcggaggtttcagttcttacaacattgaggtctttaaagcatcgactagctgcaggcgcaaggttacccaacgtgacaatattattacccacagaaaagaaacaagtcggccttgatgaaagggagaagacacttaaacttgctggaagagtcggtcaagcagttggttccctgctgaggagattaggaatcaaatatcatggcgaggagtctcatggaaaaatgaggatcaacgggcttactctaagaaggtggttcaatccgaaattgacgagcacatcctccactggaacaccagctgacttgcttcctctgccgtcacgattagccaaaggaattgcagatcagcagcgcaacatcagaaacctttctcttgagtaatccatgattgaccttcctttctcgtggatcaatttttgcgtaccatcaagcaagggcaagagaaaaatcttagaaaccacccagaaaatagttcagcttgataaaatatgtaaagagtttctttgtttacaggaaatttatatatcatacatagacacttgtgtgcatcagattgcacaaacgcatatcaggatatagatcttcagctgcttttgcagatgaatttgtcttccatcttgtaacatggtgccaagatcacattgaaaataagaatataagaatggcgtggctgtgacgtttttattttcttgaaaaaaaaaaaaa

SEQ ID NO: 3870 - DNA, 1268 bp, Panicum virgatum
ctggtttatgtctacaaatgtttgacagagatctctcgcttgggaatattattgtcaacttcagcttagggaaaccacaaattcacaacaaatggacttccgcagctattaaggtgtatcgtgatgcagtttcaactggcctagtaccttcaagcgatgttttatctcaagtgttgggatgtttgaggcttcctcattacaattcgctgaagagtagttttattgagaacatgcaaataagttgtgatattccacataatccaaatataaattcactctttgaaggattcggtgaatatgacattcgtgctttttcgattctggaggaggctgcctcactaggagcagttggaagtatttccatgaaagatactaggattgttattgatgcaagaaagttaaggatccacacagccgaggtttctcttcttacaacattgagatccttgaagcatcgacttgctgcaggtgcaaggttaccaaacgtgacaatcttgttacccacagaaaagaaacaggtcgacattgatgaaagggaaaaaacactaaagcttgctggaagaattggtcaagcagttggttctctcctgaggcgattaggaatttcataccaaggggaggagtcccacgggaggatgaggatcaatggcctcacgttaaggagatggttcaatccaaaattgaatagcaaatcctccagtgccgcaccagctgacttgcttccactatcgtcacgtttagccaaagggattgctgatcagcaacgcgacatcagaagcctttcattctagtaatgcacgtcaatccagtagcaacagatctcggtaacctttgtgagaacgtccaggatagtaaaatgtgtgaatagtttgttcagaggaaggaaatatatatactacatatatgtcatctgtgaaaagattattcagaataaagaaatgcacacatctaactttgtaatcaggatgcataaaattaattcagttttttagtgaatgaatcatttttgtctccttcacgttctttgtcacgctgtttctatgtagctcatgggttgaatgcctgattttgtaatttacgacatcaagtgtgcatttgaatttgtcagggtcgacaagaatctcttctctaatagacgaaacctgaccctgccagggaccaaaatcgagcacataattgaaccacgtctacgataaaaaaaatctaccgttgatcattgccttgttttaaaccgacagctctttatagtattgtcgtggtgtggcaaa

SEQ ID NO: 3871 - DNA, 1129 bp, Pseudoroegneria spicata
  misc_feature (213)..(213): n is a, c, g, or t
  misc_feature (1068)..(1068): n is a, c, g, or t
acttccctctgtgacggcgatcaagttttaaaagctgctgaggtccttaatgagataaaggaactaggtgtccgtccaaatgagataacctattcggtcttatgtgtggcttgcgaaagaaatggtgaagcacaactagctcttgatttatttgagcaactaaaagtagatggtattggcctcaatcccaccattgtcggttgtcttactggnttatgtctacaatgttttcctatgatctttcacttggcaacatcattgtcagattcaaccaagggaagccacagattgacaataaatggacttcctcagcaattatggttttccgtcaggcaatcacagctggtctgctaccctcaagcgatgttttatctcaagtgctgggatgtttgaggtttcctcatgacagttcattgaaaaccactttcattgataatatgggaataagttgtgatatgccacatcaccccaatacaaattcactgttggaaggattcggtgaatatgatatccgtgctttttcagtactggaggaaggtggtttgttaggagcagttgcaagcacttccacaaaatatagtcaaattgtcattgatgcaagaaagtcaaacatctacacagccgaggtttctcttctatcgacattgaagtctttgaagcatcgactagctgcaggtgcaaggttaccaaatgttacaattctattacccacagaaaagaaacaagttgatcttgatgaaagggagaaaacacttaaacttgctggaagagtcggccaagcagttggctccctgttgagaagattaggaattaaatatcaaggcgaggagtcccacgggaggatgaggatcaacggcctcacattaagaaggtcgttcaacccaaaatttacaagcgctccctccacaggagctccagttgagttgcttccactgccctcgcggttagcgaaagggattgctgatcagcagcgtgatatcagaagcctttctctgtagtgcaggtcttgcctttttccgtgtctcgatttttgtgtataccagaaggcaattactgtatgaaaaaacnaaaatccgaacgcatttattaccgtcgatttcagatcgtgtgcagagtttttttccgctca

SEQ ID NO: 3872 - DNA, 2183 bp, Secale cereale
aagccccgcttcgccgacttcagcctcgtgccccagggctggggcgcctacgtctccccctgggtcgccgcgctcggccccgcctacccgcgcctcgagcgcatctgcctcaagcggatgaccgtctccgacgacgagctcgcgctcatccccacctccttcccgctcttcaaggacctctcgctcgtctgctgcgacggcttcaccacgcgcggcctcgccgtcatcgccgagggctgccggcatcttcgagcactggatctgactgaagattatttccacgaggaggagagcgaggtggtggattggatctccaagtttccagagtgcaacacgtcgctggaatcgcttgtgttcgattgtgttagcgtcccattcaacttcgatgccctggaggcacttgttgcacgctcaccagctctgcgccgtctgcgcgttaatgaccatgtgtcgatagagcagctgcgccgtctcatggcaagggcaccccagctaactcatcttggcaccggatcattccgatctgagccaggccctggtggtgctttgtctgtgtctgagctcgctgcctctttcgcagcgtccagatcacttgtttgtttgtcaggtttcttggatgtcaatgcagcatacctcccagcaatctaccaagtttgtgccaatctcacttccgtcaattttagctttgcgggtctgactgctgaagagttcataccagttattcaccactgcgtcaatcttcgcactttatgggttcttgatactgtgggtgatgaaggccttcaggctgtggctgaaacatgctcaaatcttcgcgagctacgagtttttcctctggatgccaccgaggattctgagggctcagtctcagatattggtctccaggcaatctcagaaggctgccggaagctcgaatcaattctctacttctgccagcgcatgacaaatgcagcagtaattgctatgtccgagaactgccctgaccttttggtgttccgcctctgtattatgggccgccaccgccctgatcggattactggggcgcccatggatgagggttttggggcgattgtgatgaactgcaagaagctcaccagactttcagtctctggcctgctgactgataaggcgtttgcatacattggaaaacacgggaaactcataaagaccctgtctgttgcctttgctgggaatagtgacatttctcttcaacatgtgttcgaggggtgcactaggctgcagaagcttgaggtcagagacagcccttttggcgacaaaggattgctctctggcctaaactatttttacaacatgaggttcttctggatgaactcatgcaggctaactgtgaagggttgtggggatgtagctcagaagatgcctaatctggtggttgaagtaatgaaggaaaatgaaggggaaatggataccgttgataagttatacctgtatcgatcattggcaggaccaagggatgacgctccagcatttgtcaacatcttgtagtactgccattgaagaagtttgttgtatgttcatgtttgttctactattcctgatcattgctgttgtattcatgttcaagtatgccagagccagagaggaagctccccgcggatgattttggatcacgggaaatatgaatgcatcatttaataagcagaccaccagttattctttttgggctgattgcatcgagacttaaacaggtttctttgatgtatgtatcttggtgaggcatctcatcttgcgagttaccattttcccaacggtatctgagttatttacctgggcagcaccagactgaggccctttgttgttgtaccatagctgagttatcagaaccgattgcacagcgactggctgcaggccgactccaattcggcagcggattttagatggttccttctgccctcaagtcttctccagccattgatgttttgccatccactgttcaatccatctgctcagacgaagggggctggcatttcctacgttggaatgtttccatcaacttttttgccttgtattttagattatcccggccacgataaattttatcttcccaattttttttagtttccacagcttacttctgtagatcaatgtagaccattaccacttttcttggtcacaaccttctgctgttattaatcaagaagatattggatgatgagattcaa

SEQ ID NO: 3873 - DNA, 2392 bp, Triticum aestivum
tcggcaactgctacgccgtctcgccgcgccgcgccgtcgagcgcttcgggggcgtgcgcgccgtcgtgctcaaggggaagccccgcttcgccgacttcagcctcgtgccgcacggctggagcagctacgtctccccctgggtcgccgcgctcggccccgcctacccgcgcctcgagcgcatctgcctcaagcggatgaccgtctccgacgacgagctcgcgctcatccccaagtccttcccgctcttcaaggagctctcgctcgtctgctgcgacggcttcaccacccgcggcctcgccgtcatcgccgagggctgccggcatcttcgagtactggatctgactgaagattatttccatgaggaggagagcgaggtggtggattggatctccaagtttccagagagcaacacgtcgctggaatcgcttgtatttgattgtgttagtgtcccattcaactttgaggccctggaggcacttgttgcacgctcaccagctctgcgtcgtctgcgcgtcaatgatcatgtgtcgatagagcagttgcgtcgtctcatggcaagggcaccccatctaactcaccttggcactggatcattccgatctgagccaggccctgggggtgctttgtctgtgtctgagctcgctacctctttcgcggcgtccagatcacttgtttgtttgtcaggtttcttggatgccaatgcagcatacctcccagcaatctaccaagtttgtgccaatctcacttccctcaattttagctttgcgggtctaacagatgaagagttcataccagttattcgccactgcatcaatcttcgcactttatgggttcttgatactgtgggtgatgaaggccttagggctgtggctgaaacatgctcaaatctccgtgagctacgtgtttttcctctggatgccaccgaggattctgagggctcagtctcagatattggtctccaggcaatctcagaaggctgccgaaagctcgaatcaattctctacttttgccagcgcatgacaaatgcagcagtaattgctatgtccgagaactgccctgaccttttggtgttccgcctctgtattatgggccgccaccgccctgatcggattaccggggcgcccatggatgagggttttggggcgattgtgatgaactgcaagaagctcaccagactttcagtctctggcctgctcactgataaggcatttgcatacattgggcaatatggcaaactaataaagactttgtctcttgccttctcggggaacagtgacctgtcgcttcagtttttgttcgagggatgcactcggttacagaagcttgaggtcagagatagcccattcagtgataggggactgctttgtggtttggattatttctacaacatgaggttcctgtggatgaattcatgcaggctaaccatgaggggttgtagagaggtagctcagcggatgcctaacttggttgttgaagtaatggaggagcaaaatgaggataaggtggaaacagagactgttgataagttgtacctgtaccgctcactagcagggccaaggggtgatgcaccgccattggtgaaaattttgtagtcatcgcttattttgtgggagtttggtggtgatccgaagcagaacttttcttgtcctactggacctgctcatccttgttctgttattcctgaacgagagctggtcgttttgtgttcttgatcaagttaactggagccagtggacggaagtttcctgtggagggttttcatgatttcacaggacgcaacaatgtattattcactggaccgaaggagcaccggcattgcttacgcctcgcaacgaattcacaattgttctcatgatcaggcggcatttgctgttgaagcagtttgggtacctcactacatgtgtatcatcttgatcagcatctgctatgccgggagcagttgaagacaagggaatcagattccggcctcgcgtcgatcccagtattgcagcacagatgagcaggggctgattgcactcaagagtccagttagcgcttctgtttcatccatccagacagaggagtgggcatgccaatgtgaattccactctgctaccatccatgtacttgtgcttagaagatgactatggtaaaagaaagcctcccctttgtttgtactttgtagcctccctcgagacattgttgtttttgtagaccattattattattatctcttgttacattcaactttgcctcgcctttattatgctgagaactacccaaggagttgaaactctattatcagcaaattttgttctttcatcctactactaccacaactatcatgctgcttgtcaactgtcatagccacccctcattgctgccactactaacataacatggctcttgccta

SEQ ID NO: 3874 - DNA, 3070 bp, Zea mays
cccagcagtccgcctctccctcgctctcagatctaatcattatttaatccattttttcccagtctcacatgagcacgcctcactcgtcctccacctcctccgtcccccaccgcgcctccgctccccagatcccccaatccctaaccctagcgccacccacggcgtgctccgcctcgccttcctcctccttctcctcctcctccgcgtccggcatgcgggacgcgggggaggacgacgactccgactccccgccgtcgcagatgtcggaggacgaccccggcgccggcgccggcgacaggtgggagccggatctgaggggcgggggcggcaggcgggcgccgccggaccaggtgctggggaacgtgctcgagaccgtgctccagttcctcaccgccgcgcgcgaccgcaacgccgcctcgctcgtctgccgctcctggtaccaggccgaggcgcagacgcgccgcgagctcttcatcggcaactgctacgccgtctcgccgcgccgcgccgtcgagcgcttcggcggcctgcgcgccgtcgtgctcaagggcaagccccgcttcgccgacttcagcctcgtgccctacggctggggcgcctacgtctccccctgggtggccgcgctcggccccgcctacccttgcctcgagcgcatctgcctcaagcggatgaccgtctccgacgacgacctcgcgctcgtcgccacctccttcccctgcttcagggacctctccctcgtgtgctgcgacggcttcagcacgctcgggctcgccgtcgtcgccgagcgctgccggcatcttcgtgtgctggatctgattgaagactacgtcgaggatgatgaggacgagctggtggattggatctccaagttcccagagtgcaacacctctctggagtcgcttgtcttcgactgtgtcagcgtcccgttcaactttgaggccctggaggcacttgtcgcacgctcaccggctctgcgccagttgcgtgtgaaccaccatgtgtcagtagagcagctgcgccgtctcatggcaagagcaccccagctcacgcactttggaaccggtgcattccgatctgagggcgcccctggtgggggtttggctgtgactgagcttgctacatcttttgctgcatccaggtctctcatttgtctatcaggtttccgggaggtcgatccagaatacctcccagcgatctaccctgtctgtgccaagctcacgtcactaaacttcagctttgcaagcctaaccgctgcggaactcaagccagttattcgcaactgcaccaatcttcgcactttttgggtccttgatactgttggcgatgaaggcctacgtgctgtggctgatgcatgctctgatctccgtgagctgagagtttttcctttggatgcctctgaggattctgagggttcggtctcagatgtcggtcttgaggcaatctcaaaaggctgccggaagctagaatcaatcctctacttttgccagcggatgacaaatgcagcagtaattgatatgtcgaagaactgtcccgagcttgtagtgttccgcctctgcattatgggccgccaccgccctgaccgggtcaccggggagcccatggacgaaggttttggcgcaattgtgatgaactgcaagaaactcaccaggctttcggtctctggcctgcttaccgataaagcctttgcgcacattggaaaacatgggaagctaataaagaccctctccgtcgccttcgccgggaacagtgacatgtccctccagtatgtattcgaggggtgcaccaagttgcagaagcttgaggtcagagacagccctttcagtgacagggggctgctctccggactggactacttctacaacatgaggttcctatggatgaactcatgcaggctgacgatgaggggctgtagagatgtagctcggcagatgcaaaatctggtggtcgaagtaattaaggaccactccgaagatgaaggggagggggagaccgttgacaagctgtacttgtatcggtcgctggcaggaccgagggatgatgctccgccatttgttaccctcttgtagcactggtatttgaaggacagccccgcaccgtactgacggacatgtttgttaggtcattccttaccatcaagttgccatggccagcgagggaaagcgtagcgtcccgtgggtgatattcacaagttgctgcaggagcgctcgtgtaaaatcaagtaaagaacctgccgattattccttggaacttgatctggcatgggggcggcatccagagttggggcagttgaggagcacatccagacctagtatagcagtgatgggtagtaactgattgcacaggaactgactgcacactgactccagtcagcaggctccggatggttctttggcagtggcacccaagtctccagttatttactttgccatcttccgttccattttttcagctcagaccaaggaatggcggcggcgctggtgcgtgctgcctatgccgggaagcttcaatggctccaccggccattaattataagttctagtggatccaaaactcaatcccgctatttttctccccctcccattgtttgtagcactccagagttatttttgtagacctgtagtgtagaccaccaccactacccctttcctccgtcccacgccctctgctattttaaatcaagaagctactggaggagacctgggaattcgatcggcatttgcttggttcgtgcccccacccaccccctggcggctgctcgtcaacgtcactgttccattgcttgccagttgccatgatcgtcgtgctcctagatattatgagctcgacctcgacagctctgtcgctataataaacgcccgtagcctagcctgcgtgttgaaattgccatcatgacgataggccctaccaatgatttgctctgatgctgatagtgggccgtccttcgtttcatgtcgagcgagcgagcgagcctcgtgacatcaactgccctgccctgatggccgtctgtttctattctgctgctgacgctttcagggtcctggaggggtcgtcatggctgatgctgaggaag

SEQ ID NO: 3875 - DNA, 2942 bp, Zea mays
tgatcaccgttcgtttctctcctccagcgaggagaggatagtccaaaccgaaagcagccaaacggtgaggagggagagaccgcgagagcgagagaatataaaaaggagtgggctttctttcgatcgctgcgctgcgtcccaggcagtcctccgagcagtgctagtccaccttgctagctcgcccgctcgtcgcgctccctcgatcagatctaatcattatttaatcctttttttttccagtctcacatgagcactccccactcgtcctccacctcctccgtcccaccacaccgcgcctcccctccccagatcccccaatccctaaccctagcacccacggcgtcctccgcctcgccctcctcctcctccgcgtccggtatgcgggacgcggcggaggacgactccgactcgccgccgtcgcagatgtcggaggacgaccccggcggagggggcggggaccggtgggagccggatctgcggggcggcaacggcggcggcggcggcggcgggaggtgggctccgccggaccaggtgctggagaacgtgctcgagaccgtgctcgagttcctcaccgccgcgcgggaccgcaacgccgcctcgctcgtctgccgctcctggtaccgcgccgaggcgcagacgcgccgcgagctcttcatcggcaactgctacgccgtctcgccgcgccgcgccgtcgagcgcttcggcggcctgcgcgccgtcgtgctcaagggcaagccccgcttcgcggacttcagcctcgtgccctacggctggggcgcctacgtctccccctgggtggccgcgctcggccccgcctacccgcggctccagcgcatctgcctcaagcggatggccgtatccgacgacgacctcgcgctcgtcgccagctccttccccttcctcagggacctctcgctcgtgtgctgcgatggcttcagcacgctcggtctcgccgtcatcgccgagcgctgccggcatcttcgtgtgctggatctgatcgaagattacgtagaggacgacgatgaggagctggtggattggatctccaagttcccagagtccaacacctctctggagtcgcttgtcttcgattgtgtcagctgcccgttcaactttgaggccctggaggcacttgttgcacgctcaccggctttgcgacggctgcgtgtgaaccaccatgtttcagtagagcagctgcgtcgtctcatggcaagagcaccccagcttacgcactttggaactggtgcattccgatctgagggtgcccctggtggggggttggctgtgactgagctcgctacatcttttgctgcatccaggtctctggtttgtctatcaggtttccgggaggttgacccagaatacctcccggcgatctaccctgtctgtgccaacctcacgtcactaaacttcagctttgcaagcctaaccgctgcggaactgaagccagctattcgcaactgcacgaatcttcgcactttctgggtccttgatactgtgggtgatgaaggccttcgtgctgtggctgatgcatgctctgatctccgtgagctgagagtttttcctttggatgcctctgaagattccgagggttcggtctcagacgttggtcttcaggcaatctcagaaggctgccggaagctggaatcaatcctctacttttgccagaggatgacaaatgcagcagtaattgatatgtcgaagaactgtcctgagctcgtagtgttccgcctctgcattatgggccgccaccgacccgatcgggacactggggagcccatggacgaaggtttcggtgcaatcgtgatgaactgcaagaaactcaccaggctttcggtctccggcctgctcaccgataaggcctttgcgtacatcggaaaacacgggaagctaataaagaccctctccgtcgccttcgctgggaacagtgacatggccctccagtatgtattcgaggggtgcaccaagctgcagaagcttgaggtcagagatagccctttcagtgacaggggtttgctctcaggactggactacttgtacaacatgaggttcttgtggatgaactcgtgcaggctgacgatgaggggctgtagaggtgtagctcagcagatgcagaatctggtggtcgaagtaatcaaggaccactccgaagatgaaggggaggctgagaccgttgacaagctgtacttgtatcggtcactggcagggccaaggaatgatgctccgccgttcgtcaccctcttgtagtgctgctgccgccaccggaagaacacagccctgctgtacccacgaacatgtttgttgtattgttaacttaccaagttttcagagcaagcgaggggagcgtcctgcggatgattttcaaggtgctgcaggcgaggggagcgtcccatcgtaaaatcaatcaagtcagaacctgccgattattcttttccacacttgatctggcgtgggcggcatccagagttggggcagttgaggagcacatccagatccagagcgagagacatctgatggcctcctcattcatggcgccagcgcttacagtaatagcagtgatggatgggtagtgtctgattgcacaggaactgactgcacactgatggctccagtcagcaggcttgggggacggttctgtggcgctctcaagtctccagctacttgtgctttgtgccatctcccgttccatttttcagatcagaccaatgaattgggtggggcattgctgcctacgtccaaagcttcagtgctccaccaccggccattacttgtgttttagattactccaaaactcgaccactccgctatttttttccctcccttttcccccattgtttttttagcattcctgagctatatttttttttgtagacctgtagaccatcatgctatttttgaatgaagaatctattggaggaaatttgatcggctttgccccctca

SEQ ID NO: 3876 - DNA, 2527 bp, Secale cereale
gccgcccgaccaggtcctggagaacgtgctggagagcgtgctggagttcctcaccgccgcgcgcgaccgcaacgccgcctcgctcgtctgccgctcctggtaccgcgccgaggcgcagacgcgccgcgagctcttcatcggcaactgctacgccgtctcgccgcgccgcgccgtgcagcgcttccgcggcgtcgccgccgtcgtgctcaagggcaagccgcgcttcgccgacttcagcctcctccccgacggctggggcgccaacgtcaagccctggctggaggcgctcggccccgcctacccgtgcctcgagcgcatctgcctcaagcgcatgaccgtcaccgacgacgacctcggcctcgtcgcgcgctccttcccgcaattcaaggagctatcgctcgtctgctgcgacggcttcagcaccctcggcctcgccgtcatcgccgagcgttgccggcacctgagggttctggatctgatcgaggactatgtggatcaggaggacgaagcagtggactggatttccaagttcccagtgtcaaacacatcactagagtccctcatgtttgactgcgttagtgtcccattcaactttgaggccctggaggcccttgtggcacggtcaccttctcttcgtcggctgcgtgtgaaccaccacgtttcagtggagcagctccgccgtctcatggcacgggctcctcagctcacacaccttggcactggggcctttcgtcctgaggctccacaaggtggaggcatgtcggtgtctgaactcgcaccctcgtttgcagcctcaacatccatagtctgcctctctggattccaggaggtcaacccagaataccttccagcaatctaccctgtgtgtggtaatctcacctcccttaacgttagcttcgcaagcctaactgctgaggatctgacaccagtcattcgccaatgccacaaacttcagacattctgggttcttgatactgtgggtgatgaaggcctcagggctgtggccgagacatgctctgatcttcgtgagctgcgagtatttccgctggatgccaccgaggactccgatgggtctgtgtcagatgttgggcttcaggctatatccgaaggttgccgaaagcttgaatccatactttacttttgccagcggatgacaaatgctgcagtcgtagctatgtcctacaactgccctgaccttgtggtgttccggctttgcatcatgggtcgccaccgtcctgatcgtatcacgggggagcccatggatgatggctttggcgcgatcgtgatgaactgcaagaagcttactaggctctctgtctctggcctgctcactgataaggcatttgcatacattgggaaatatggcaaactaataaagactttgtctcttgccttctcgggcaacagtgacctgtcgcttcagtttttgttcgagggatgcactcggttacagaagcttgaggtcagagatagccctttcagcgataggggattgctttgtggtctggattatttctacaatatgaggttcctgtggatgaattcatgcaggctaaccatgaggggttgtagagaggtagctcagcggatgcctaacttggttgttgaagtaatggaggagccaaatgaggacaaggtggaaacagagaccgttgataagttgtatctgtaccgatcactagcagggccaaggggtgatgcgccggagttggtgaaaattttgtagtcattgcttattttgtgggagtttggtggtgatccgaagcagaacttctcttgtcccactggacctggtcatccttgttctgttattcctgaacgagagctggtcgatttctgttcttgatcaagttaactggggtcagcgggcggaagtttcctgtggagggttttcatgatttcacagaaaacaattatgtgtcattcattgtactgaaggagcacccattgtactgaaggagcacccaccggttatgcgtatctctggaaacaaacaaattcactgattgcgctgatgatgaggcggcatttgctgttgaagcagtttggcaccttactatatgtatccccttgatcagcatctgctatgtggggaacagttggagacaagagaatcagaattcgggctcgcacctccgctgatccggatattggagcatgcatcgatgagcaaggcctggtcgctctcatagtccggttcacatgtcttagatggtttctttcttttcaagacttcaaaccgtgggtttccttcgggagcttgtgtttggttcatctgcccatacagaggaatccctatgccagtgtgaattgccatctcctgtcatctactactactagtgctgtagaaggtgtcaatatctaactatggtaaagcctcaccttttgtttgtactagtactactttgtagctttcctccagacgttgttatttttgtagacccttgtaggccattattattatctcttgttacattccttgtctcgcctttattatgctgagaactgcccaaggacttaaaacttt

SEQ ID NO: 3877 - DNA, 2906 bp, Hordeum vulgare
aatcattatttaatccttttccagtctcacatgagcacttcctccccagccccaacccccacctcctcctccgatcccccaaccaccaccaccaccaccaccacctcctccgatcccatcaccggcccctcctcctcctcctcccccgcctccggcatgagcggggcggcggaggaggcggactccccgccgacgcacatgtccgaggactcctccggctcctcctccggcggcaggcggacgccggatctgaggggcggcaacaacggcggcggcccgcgcgcctcctcctccgcgccgcccgaccaggtcctggagaacgtgctggagagcgtgctcgagttcctcacggccgcgcgcgaccgcaacgccgcctcgctcgtctgccgctcctggtaccgcgccgaggcgcagacgcgccgcgagctcttcatcggcaactgctacgccgtcgacccgcgccgcgccgtctggcgcttccgcggcgtccacgccgtcgtgctcaagggcaagccgcgcttcgccgacttcagcctcctccctgacggctggggcgccaacgtcaagccctggctggaggcgctcgggcccgcctacccgtgcctcgagcgcatctgcctcaaacgcatgaccgtcaccgacgacgacctcggcctcgtcgcgcgctccttcccgcagttcaaggagctctcgctcgtctgctgcgagggcttcagcaccctcggcctcgccgtcatcgccgagcgttgccggcatctgagggttctggatctgatcgaggactatgtggatcaggaggacgaagcagtggactggatctccaagttcccagtgtccaacacatcactagagtccctcatgtttgactgcgttggtgtcccgttcaattttgaggccctggaggcccttgtggcacgctcaccttctcttcgtcggctgcgtgtgaaccaccacgtttcagtggagcagctccgccgtctcatggcacgggctcctcagctcacacacctcggcactggggcctttcgtcctgaggctccacaaggtggagccatgtcggtgtctgaactcacgccctcgtttgcagcctcaacttctatagtctgcctctctggattccaggaggtcaacccagaataccttccagcaatctaccctgtgtgtggtaatctcacctcccttaatgttagcttcgcaagcctaactgctgaggatctgacaccggtcattcgccaatgccacaaacttcaaacattttgggttcttgatactgtaggcgatgaaggcctcagggctgtggctgagacatgctctgatcttcgtgagctgcgagtatttccactggatgccacggaggactctgacgggtctgtttcagatgttggtcttcaggctatctccgaaggttgccggaagctcgagtccatactttacttttgccaacagatgacaaattctgcagtcgtagccatgtccaataactgccctgaccttgtggtgttccgtctttgcatcatgggtcgccaccgtcctgatcgtatcaccggggagcccatggatgatggctttggcgcgatagtgatgaactgcaagaaacttactaggctctctgtctctggcctgctcactgataaggcgttttcatacattgggaaatatggcaaactgataaagactttgtctcttgccttctcgggtaacagtgacctatcgcttcagtttttgtttgaggggtgcactcggttgcagaagcttgaggttagagatagccctttcagcgataggggattgctttgtggtctggattatttctacaacatgaggttcctgtggatgaattcatgcaggctaaccatgaggggttgtagagaggtagctcagcggatgcctaacttagttgttgaagtaatggaggagccaaatgaggataaggtggaaacagagaccgttgataagttgtacctgtaccgatcactagcagggccaagggatgatgcaccgccgttggtgaaaattttgtagccatcgcttattttgtgggagtttggtggtgatccgaagcagaacttttcttgtcctgctggacctgatcattctcattctgttattcctgagcgagagctggtcgattgggttgttcttgatcaagttagctggggccagtggttggaagcttcctgtggagggttttggtgatttcacaggaaacgattatgtgtcactcattgcaccgaaggagaccgacaatgcttatgcctcgcagcgaattcacaattgctctgatgatgaggcagcatttgctgttgaagcagtttgggaccttactacatgtgtatcttgttgatcagcatctgctatgcggggagcagttggagacaagggaattagaatccggcttcgcactcgcgttgatccccagtattgcagcatagatgagcagggactgattgcgctcaagagtccggttagcatgtgcttagattgtttctttcccttgaagcctcatacatgtgtttccttggcacgcttctgtttcattcatccatccatccaggcaaaggagtgcgtgcctatgccgatgtgaattgcactctgccaccatccatgtacttgtgctgtagaggaagactatggtaaaagaaagcctcaccttttgtttgtactattttgtagcctccagaatgttttgtttttgtagacccttgtaggccattactattattatctcttgttacattccttgtctcacctttatgatgctgagaagtacccgaggacttgacattttgttctttcatcctagtagcacaactgtcatgttgcttgccaactgtcatcgccactcacattgttgccactaacatggctcttgtgagttgtgagcaaaacaaaagcatgcattactg

SEQ ID NO: 3878 - DNA, 2199 bp, Panicum virgatum
cgcccagaaccctagccccggcggcgcgcccgctcgcttccatggccgcgtccttggctgcgacggcggcgatgagccgggacgcgttccgcgcggcggtgaccaacacgctggagcggcgcctcttcttcgtgccctccttcaagatctacggcggcgtcgcggggctctacgactacgggccccccgggtgcgccgtcaaggccaacgtcctcgccttctggcgccagcattttgtgttagaggaagggatgcttgaggttgactgtccatgtgtgacaccagaagttgtcttgaaagcctctggtcatgtggataaatttacagacttaatggttaaagatgaaaagacaggcaactgctaccgtgcagatcatttgctcaaggatttttgtaaggataagcttgagaaggaccagacattgtcaccagagcaggcagaagaatacaataaaattcttgctatcttggatgatctctctgcagagaaattgggtgctaagattaaggaatatgggattgttgctcctgacactaagaacccattgtcagatccctaccccttcaatctcatgtttcagacttccattgggccgtcaggtttgagtccagggtatatgaggccagagacagcacagggtatctttgtgaactttaaagacttgtactactacaatggcaacaagctacctttcgctgcagctcaaattggccaggccttcaggaatgagatatctccccgccaaggccttctgagagtccgtgagtttacattagcggaaattgagcactttgtggacccagaggacaaatcccaccccaaatttggtgatgtctctgacctagaattttttatgtttccaagagaggatcaaatggcaggaaagtcagccacaagacttaaacttggaaatgctgtatccgagggaactgtgaacaatgagacccttggctactttattggaagggtctaccttttcttgacacaacttgggattgataaagatcgtctacgcttccggcagcatctgccaaatgaaatggctcactatgctgctgattgttgggatgcagagattgagtgctcttatggatggattgagtgtgttggaattgctgataggtctgcctatgacttgcgtgcacactcggataaaagtggtgagaaacttgaagcacatgaaaagtttgcagaacccagagaagtggagaaattagttataaccccatcaaagaaggagcttggtcttgcattcaaagggaaccaaaggatggttcttgaagcattggaagcaatgggtgagactgaagctttggagatgaaagctgcgttggagtccaagggggaggttgagtttaaaggtgtgcacccttgggaaggatgttacgataaagaaaaacatggtttcaattaatattgagaagaaaaaagaacaccaaaggaaatttactccttccgtcattgaaccatcctttgggattgggcgcattatatactacctttttgagcactgtttctaccaaaggcctggcaaggcagaggatgagcagttaaatgtgtttggtttcccccctcttgttgccccaataaagtgcactgtctttccactggtgaagcttgagaaatttgaggttgttgccaagaaaatctcaaaggccttgacagcagcagggatttcacatattatcgacatgacaggtaacacaataggaaaacgctacgcaaggacggacgagctcggcgtgcccctggcgatcacggttgacaacaccacaagcgtgacggtgcgtgaccgggacagcaaggaccagatccgtgtggaggtggatgaggtggcctcggtggtgaaggaggtgacggacgggcagagcacctgggccgacatcatgtggaggtacccggcgcacactgcctcggtcgccgaggatgaggaggccgaaccctgaagagcacagccaaaacaatatccaacgatcgttggcccctgatagcatttcctgcttaaaagaaacagaatgcgttgtcgtgtaagtctacggtagcctgattcctgcaaatttccacatagtttatttgtgaattgtgatgtttgacccgtagattctgctgttcgtttcatttttttttttcaccttgcgaactgcaatgtttgatgaatcctttgtcagattgcaattttcacagtgttccttttttgt

SEQ ID NO: 3879 - DNA, 2521 bp, Zea mays
gcacgagcatcgcggcggcggaggcgagggcacgcgcgggtatcgcgggagcggggcatggggaggcggagggagcgcgacggcagaaccgtgcactatagtcgaatatgaacgcctacgatacaaacataaggagtagtaaagataaagatgtagagagttttttccgatgacccatgccgcactcaccaaaaatatctgcgggccagcgcgcgtgcacattggacaagtggacaaccgaggtcaccgactagtgggccccacacgtcagcccctcgatccgcttcccatctgatgctcgtgctccgccgcgtctccttcctcctctcgtcgccctcccctcgcgcaccgctcgcaaaacctctcctgctcctacgcccgccccaaaccctagccccgacagcgcggcagctcgtggctatggccgcgtcagtcccgtcggcgggtggggcggggacgatgagccgcgacgcgttccgcgcggccgtgaccaacacgctggagcgccggctcttcttcgtgccctctttcaagatctacggcggcgtcgcggggctctacgactacggacccccaggttgcgctgtcaaagctaacgtcctcgcattctggcgccagcattttgtattggaggaagggatgcttgaggttgactgtccatgtgtgacgccagaagttgtcttgaaagcctctggacatgttgataaatttacagacttaatggttaaagatgaaaagacaggcaactgctaccgtgcggatcatttgctgaaggacttctgtaaggataagcttgagaaagatcacacattgtcaccagagatggcagaagaatacaatagagttcttgctatcctggatgatctcactgcagaacaattgggtgctaagattagggagtataagattgttgctccagacaccaagaactcattatcagatccatacccttttaatctcatgtttcaaacttccattggaccatcaggtttgagcccagggtatatgaggccagagacagctcagggtatatttgtgaacttcaaagacttgtattactacaatggcaataagctgccattcgctgcagcccaaattggtcaggccttcaggaatgaggcatgactttatatctccccgtcaaggccttttgagagtccgtgagtttactttagcggaaattgagcactttgtggacccagaggacaaatcccatccaaagtttggtgatgtttctgatctagagttctggatgtttccgagagaggatcaaatggcaggaaggtcagccacaagacttaaactcggaaattctatatctgagggaactgtgaacaatgagacccttggctacttcattggaagggtctaccttttcttgacacaacttgggattgacaaggatcgtctccgtttccgtcaacacctgccaaatgaaatggctcattatgctgctgattgttgggatgcagagattgaatgctcctatggttggattgagtgtgttggaattgctgataggtctgcctatgacttacgtgcccactcggataaaagcggcgagaaacttgaagcacatgagaagtttgctgaacccagagaagtggagaaattagttataacgccatcaaagaaggaacttggtcttgcattcaaagggaaccagaagttggttgttgagtcattggaagccatgaccgagaccgaggcactggacatgaaagccgcgttggaatccagaggggaagtcgagttcaaggtgtgtacccttgggaaggatgtcaccataaagaaaaacatggtttcaatcaacatcgagaagaaaaaggagcaccagaggaaatttactccttccgtcatagagccatcctttgggatcgggcgcatcatatactgcctttttgagcactgcttctaccaaaggcctggcaagaccgaggatgagcagctaaacgtgttcaggtttccccctctcgttgctccaataaagtgcaccgtctttccattggtcaagctcgagaaatttgaggctgttgccaagaagatctccaaggccctgacagcagctgggatttcacatatcatcgacatgacaggtaatacaataggaaaacggtacgcaaggacggacgagattggtgtccccctggcgatcacggttgatcacaccacgagcgtgacggtgcgcgatcgtgacagcaaggaccagatccgcgtggatgtggacgaggtggcctcggtggtgaaggaagtgacggacgggcagagcacctgggctgacatcatgtggaggtacccggctcacacggcctcggccgccgacgaggatggggcacagccctgaagaggcacagccacaacaccacccaacgatcgttggtctctgatagttccttcctgcgttccttaacagaaacagactgcattgttgtgtaagcctacagtagccagattcctgcacatttaaatttccacaaacaaatagtagcctctgtgttataaattctgctacaacatttca

SEQ ID NO: 3880 - DNA, 2397 bp, Elaeis guineensis
tatcccctaccccatccaaaaccctttcccctttcctccgctgccgcctcctctccgccctctctgctgccgcgagcccctcgctcatggccgcatccgaggactccctccggcaggccctcgtcgagaagcagaccgccgtcgacgcccaggctgaggcagtccgggccatcaaggcccgccctggcgcctccaaggaggagatcgacgctgccgtcgaggccctcaaggccctcaaggtcgagcatggtgccgccgcgaggcgccttcaggccgccgtcagcagcaacggcgacggcagcagcaaggaggccttccggcaggccgtcgtcaacacgctcgagaggaggctcttctacatcccttctttcaagatctaccgtggcgttgccggcctttacgactacggcccccctggctgcgccgtcaagtccaacgtccttgccttttggcgccaccattttgttttggaggagaatatgttggaggtagattgcccctgtgtcacgcctgagatagtcctgaaggcatctggtcatgtggataagttcactgacctgatggtgaaggatgagaagactgggacatgttaccgcgctgatcacttactaaaggactattgcaaagggaagctcgagaaggacctcacgttatcgtctgagaaggctgcagagttcaagcatgtcattgcggtgttggatgatctttctgctgaagagttaggggcaaagctgaaggagtatgatatcagagcacctgatacagggaaccccctctctgatccataccctttcaatctcatgtttcagacttccattgggccatctggcctgctccctgggtatatgaggccagaaacagcacagggtatctttgtgaattttaaggacttgtactattacaatggcaacaagcttccatttgcagcggctcagattggacaggcatttagaaatgagatttcacctcgtcaaggtcttttaagagttcgtgagttcacactagctgagattgagcactttgtagatcctgaggacaaatcccacccaaaatttgttgatgttgccaacctggagtttttgatgttccctagggaggatcaactatcagggcaaccggccaagacaatgatccttggcgaagcagtttcaaagggaacaatcaacaatgagacacttggttacttcatggggcgggtgtaccttttcttgacacatctaggaattgacaaagatagattgcgcttcaggcagcatctgccaaatgagatggctcactatgctgcagactgttgggatgcagagatagaatgctcctatgggtggattgaatgtgttgggattgctgatagatctgcttatgatttacgtgctcattcagagaaaagcggggtcctgctggttgctcacgagaagttctcagaacctagagaggtggagaaactggttataactccatcaaagaaagaacttggtcttgcgttcaagggtagccaaaagatggtggttgaagcattggaggccatgggtgaaaaagaagcattggaaatgaaaaaggcgttggaagacaaaggggaggtggagttccaagtctgtccactaggaaaattggtggtcttaaagaaaaacatggtatctatcagtgtggaaaaaaagaaggaacatcaaagggtttttactccttctgtcattgagccatcttttggtattggacgaatcatctactgtctttttgagcattctttctacacaagaccaagcaaatcagaggaagaacagctaaatgtgttccgcttccctcctcttgtggctcctattaagtgcactgttttcccgttgatcaagactcagctgtttgatgaagtggccaaactcatagcgaaatcgctaacggcagctggaatctcgcatattatagatattacaggcacgtcgatagggaaacgttatgcaaggacagatgagattggtgtcccttttgccataactgttgattccactactagtgtgacgatacgtgagagggacagcaaggagcagatccgtgtgagcatagatgaggtggcttcagttgtgaaagaagtcacagacggacaaagcacatgggctgatgtgctgtggagatacccaacccacgctgctccacatgctgatgagtgaagaggctggttgaatgtatatagtgatgggtgagcaatcccatgtcgctgaattttcaaattaacggaagttattatgctagtgatgtcaagttaaccaggaaaaagaagatttatcttgcttgcttgattatttatattctgtaatggtggggtcagcttgatttgataaattgatgggtatatagtgtatatgataaagtacgtacctttaagataaaatttttgatcttttaagt

SEQ ID NO: 3881 - DNA, 2382 bp, Elaeis guineensis
gccgcctcctctccgctctctccgccgccccgaccctctcgcccatggccgcctcagaggactccctccggcgggccctcgccgagaagcaggccgctgtcgacgcccaggctgaggccgtccgggccctcaaggcccgctccggcgtcgccaaggacgagatcgacgccgccatcgaggtcctcaaggccctcaaggtcgagcacggcgccgccgcgaagcggcttcagtccgccgttagcagcaacggcgatggcagcagcaaggaggcgttccggcaggccgtcgtgaacacgctcgagaggaggctcttctacatcccctccttcaagatctatcgcggcgtcgctggactctacgactacgggccccctgggtgcgccgtcaagtccaatgtccttgccttttggcgccagcactttgttttggaggagaacatgttggaggttgactgtccctgtgtcacgccagagatagtcttgaaggcatctggtcatgtggataaattcactgacctgatggtgaaggatgagaagactgggacttgctaccgtgctgatcacttgctcaaggattattgcaaggggaagcttgagaaggacctcacattgtcacctgataaggctgcagagttcaagcatgtcgtcgcagtgttggacgatctttctgctgaagagttaggggcaaagctgaaggagtatgatattagatcgcctgatactgggaaccaactctctgatccataccccttcaatctcatgtttcagacttcgattggcccatctggcctgcttcctggatatatgaggccagaaacagcacagggtatctttgtgaatttcaaggacttgtactattacaatggcaacaagcttccatttgcagcagctcagattgggcaggcatttagaaatgagatttcgcctcgccaaggtcttttaagagtccgtgagttcacattagcagagattgagcactttgtggatcctgaggacaaatcccacccaaagtttgttgatgttgccgaactggagttcttgatgttccctagggaggagcaactagcagggaaatcagccaagacaatgatccttggtgaagctgtttcaaagggaacaatcaacaatgagacacttggttacttcataggacgggtgtatcttttcttgactcgtctgggaattgacaaagataaattgcgcttcaggcaacatctgccaaatgagatggctcactatgctgctgactgttgggatgctgagatagaatgctcctatggatggattgaatgtgttgggattgctgatagatctgcttatgatttacgtgctcactcggagaaaagtggtgtccctctggtcgctcatgagaagttctcagaacctagagaggtggagaagctggttattaccccatcaaaaaaagaactaggtcttgcatttaagggtaaccaaagaatggtggttgaagcattggagggcatgagtgaaaaagaagcactggatatgaaacaagctttggaagataaaggagaggtggatttccaagtctgtacacttggaaaatctgtggttataaagaaaaacatggtatctatcagtatggaaagaaagaaggaacatcaaagggtttttaccccttctgttatcgagccatcttttggtattggacgaataatctactgtctctttgagcattctttctacacaagaccaagcaaatcagaggatgaacagctgaatatgttccgcttccctcctcttgtggctcctattaagtgcactgttttcccattaatcaagtctcagcagtttgatgaagtggccaaactcatagctaaatcactaacggcagctgggatctcacatataatagatgttacaggcacgtctatagggaaacgttatgccaggacagatgaacttggtgttcccttcgccataactgttgattctaccaccagtgtgaccatacgtgagagggatagcaaagggcagatccgtgtaagcatggatgaggtggcctcagttgtgaaagaaatcacggatgggcaaagcacatgggctgatgtgctgtggagatacccaactcatgttaccacgcatgctgatgaggaatgaagaggcttccaaacgaataaagtgatatgaaagcaatcccttatcttgctggtttttcaaactactggaacttatgaggtaattgtcgtcaaccagcaaaaagaagttttatcttatttgtttgtgctctaagtggttggacatcttcattttataaatggatcggcatatgatgtacgggatacaatttgtacctttaaggtaaggttttttttttttttgatctttctaatttgtagttgtcatatacattcaagtactt

SEQ ID NO: 3882 - DNA, 2099 bp, Musa acuminata
cccatcatggctgactccgaggagtcgctccgccgagctctttccgagaaacaggccgccgtcgacgcccaggccgaggccgtacgggcactcaaggcacggcccgcatccgccccgtccgagatcgacgccgccgttgaggccctcaaggccctcaaagtggaggccgccgccgccgccaggctcctccaggccgctgtcagcagaaatggcgacggatccactgccggcagtagggaggccttccgccaggccgtcgtcaacacgctcgagaggcggctcttttacatcccatccttcaagatctaccgcggggtcgctgggctctatgactacggccctcctggctgtgcagtcaagtctaacgtcctcgccttctggcgtcagcattttgtcctagaggagaacatgctggaggttgattgtccctgtgtcactcctgaaattgttctcaaggcatctggtcatgttgataagttcactgatctaatggtgaaggatgagaagacaggtacttgctatcgagctgaccacctacttaaagactattgcaaagagaagctcgagaaggatcttacattgtcagctgagaaggctgcggagcttaagcatatactagctgtgttggacgacctttctgctgatgaagtgggtgccaagattaaggaatatggtatagcagctccggacaccaagaacccactgtctgatccttacccctttaatctcatgtttcagacttccatcggcccatctggcttgagccctgggtatatgaggccagagacggcacaaggtatcttcgtgaattttaaagacttgtattattacaatggcaacaagcttccatttgcagcagctcaaataggccaagcctttagaaatgagatttcaccacgccaaggtcttctgcgagttcgtgaatttacattagcagagattgaacactttgtggatccagaggacaagacccacccaaaatttgttgatgtttctaacttggagttcttgatgtttcctaggaaggagcaaatggcaggtgaatcagcaaaaccaatgatccttggtgaggcaatttcaaagggaactgtcaacaatgaaacacttggctactttataggacgggtgtatctctttttggcttgcctcgggatagataaagatcgattacgcttcaggcagcatttgccaaatgagatggctcactatgctgctgactgttgggatgcagagatagaatgctcttatggttggattgaatgtgttggaattgctgatagatctgcttatgatttacgggctcattcagagaaaagtggtgtcgctctggttgctcatgaaaagttttcagaatccagagaggtggagaaattagttattgtgccatcaaagaaagaacttggtcttgcatttaagggcaaccaaaagatggtagttgaagcattagagaccatgagtgaaaaagaggcactgaaaatgagagcatctttggaatctaaaggagaggtggacttccatgtgtgcactcttggaaaagctgttgtcataaccaaaaatatggtgtcaattagcatcgagaagaagaaagaacatcaacgggttttcacaccctcagttattgagccatcttttggaatcggaagaataatttattgcctttttgagcattctttctacacccgaccgagcaagtcagaggatgaacaactgaatgtgttccgttttcctcctcttgtggctcccattaagtgcactgttttcccactgatcaagacacagaaatttgatgatgtggctaaaatcatagcaaggtcactcacagcagctgggatttctcatattatagatatcacagggacatcaataggaaagcggtatgccaggacagatgagattggtgtaccctttgccataactgttgattcaaccaatagcgtgaccatccgggaaagggacagcaaggagcagatccgtgtaagcatcgatgaggtggctaaagttgtgaaagaggtgacagatgggcaaagtacatgggctgatattatgtggaggtatccagcacatgctgcctcacttgtggatgaagaataaaactttta

SEQ ID NO: 3883 - DNA, 1343 bp, Phalaenopsis aphrodite
caatagacttccatttgcagcagctcagattggacaggccttccgaaatgagatttcaccaaggcaaggcctgctgagagttcgtgagttcacattggcagagattgagcattttgtggatcctgaagacaaatcccatcctaagtttgttgatgtggctgacatagagttcctgatgtttccaagggaactgcaaatggcaggcgaatcagcaaaaccaatggttattggagaagctgttaggaagggaaccgtcaacaatgagactctcggttactttattgggagagtatacctcttcctgacccgccttggtatcgacaaagaacgccttcgttttcggcagcatttaccaaatgagatggctcactatgctgcagactgttgggatgctgagatagagtgttcatatggatggattgaatgtgttggaattgcagatagatctgcctatgatttacgtgctcatacggacaaaagtggtgttccgctggttgctcatgagaagtatccagaacccagagaagttgagaagctagtgattgctccatcaaagaaagagttgggtcttgcattcaagggcaaccaaaagatggtcgttgaagcattagaggccctgaaccatgaagaagctttaaaaataaaagctgcgcttgaatctaaaggagaagtagaatttgaagtttgcactctgggcaaatcagttattataaagaaaaacatggtctcaatcagcatcgaaaagaaaaaggagcaccagcgggtctttactccatctgttatcgagccttcctttggtatcggacggattatttactgcctctttgagcattccttctatacaaggccaagcaagtcggaggacgagcaactgaatgtgttcagatttcctcctctcgtagctcctatcaaatgcactgtttttcctctgatcaagagccagcagttcgatgaggtggccaaagtcattgcgagatccctgaggtctgctgggatatctcatattattgacatcactggcacatcgatagggaagcgctacgcaaggacggatgagattggtgttcctttcgcaatcaccgtcgactccacttcaagtgtgacaatacgcgagagagatagcaaggagcaaattcgtgtgagaattgatgaagtggcttctgtggtgaaggaagttacagatggtcaaagcacctgggctgatatcatgtggagattcccaacccattctgcatcacatgttgatgagtgaaggttcaggtcagtccctcagcagtcgatacttctaaaatttagtgactaaacataattccattttgttactgttgtaccgaaactagccg

SEQ ID NO: 3884 - DNA, 2314 bp, Secale cereale
caaaggtagttgaggctgcaaagcgtctccatgtgaaggagcatgaggttttggatggttctggcaatcctgtaaaattagctgctacagttgaatgcaaaggaattgttggtagtgatgacaggcattatattttggatctgatgagagtgacacctcgagattctaactacattggactgcagcaccgtttctgtgtgttgagacctgagcttgtagcctcatttgttgaggctgaatccataaagaaatcccccacgcagaaagttccggatgttcccacagaatcgaatgggcaagaatctgatgaccttgccagtgcttctgatgctacggctgcttctgtggaggaacatgacaagtctgatgaaagccctgcttctacacctgctgaaagtaacgactcaactgctgaaattcttttcaacccaaatgtatttacggagtacaagcttgctggcagtcctgaggagattgaagcagatgaagctttggttaaaaaggttggttcgtatctgctagatacggtgatcccaaagtttgttcaggatctttgctctcttgatgtctcccctatggacggtcaaactttaactgatgtgctgcatagcaatgggataaatgttaggtatctgggcaaagttgcaggcatgatcaagcatttgccacatttgtgggacttattttcggctgagataattgttaggtctgcaaagcatgttgtcaaggacatactgaggcaaagcccggaccataatattgcacctgctgttgctcatttcttgaattgtttttttggcaaagttttggctgcttcaacaaaaggtagtactggcagcccgcagtcgaaaacacagaagggccagaaatcaagtcaatcagcttcttcaagaaagggtcaatctgcatattctcagctaacatctgatggagtttggtctgacattaaggagttcgcaaaacataaataccagtttgaagcgccggatgatgcgagggttggggctaaaagagttgcagttctccgcaatctttgccaaaaggtgggaataacgattgccgctcgcaaatacgatctgcattctactactccattccaaccttcagatatcttgaatctccaaccagttgttaagcactcagttcctacctgtactgacgcaaggaagcttatggaagctgggaaaatccggatggctgagggaactctaaatgaggcgtacgcactattttctgaagctttttcgctacttcaacagatcaatggtcccatgcacaaggatgctgcgaactgttgccggtaccttgctatggttttgtaccatgccggcgacacagcaggagccattgtccagcaacatagagagcttatcataaatgagcgatgccttggtctagaccatcctgatacagcccacagctacggtaacatggctttgttctatcatgggctcaatcaaactgaacttgcgctgcgacacatgtcccgtacactgctgttgctgagtttagcatctggtcctgatcatccggatgttgcagcaactcttataaatgtggcgatgatgtaccaggatgcgagcaatatgagtactgcacttaggtatcttcaagaagcacttaagaagaatgagcgccttttaggcccaggtcatattcaaacagcagtttgctatcatgctctcgccattgcattcagctgtatgggtgcatacaagctttcagttcagcatgaaacgaagacacatgatatactggtaaaacagttagggagcgaggattcacgaacaaaagattcagaaaattggttgaatacatttaaggggcgagaacagcaggttattgcgcagaagcaaaagggccagggaactgccgccccctccactaacgctgttgaattcttgaaggctcatcctggattgttccaagcaatgaaggcagctgcgatccaatctggtggtgatggaccagcaactgtcagcagaggaagaggaagcgatgaacgcgctgctaaggctgccgcagaagcccggaaaacggctgttgccaggggtgttaatctgcgcaacgggcctgctgcgagcgtttctgacatcaatcaaattcttaacctcatcaacactgctgcttctgcgtctgcagcttcttccggcaatgctcaggcaaccgaatctgaagctccacagtccaacggtcctgccttgaatggtgcaaaggaggccaaggatacaagtcggccatccgccaaggccgacggtcaagccccagtaggattaggtgcatcattggagctgaagaagcagaagtcgaagca

SEQ ID NO: 3885 - DNA, 2637 bp, Avena sativa
actgcagcaccgcttctgtgtgttgagaccgagcttgtagcttcatttgttgaggctgagtctgtaaagaaatcccctgcgcagaaagttccagatgtctctgcagaattgaatgggccagaatctaatgataacaatgccagtgcttctgatgctacggctgcttctgtggagggacatgacaagtctgatgaaagccctgctccgacacctgctgaaaagaacgactcaattgatgaaattcttttcaatccaaatgtatttacggagtataagcttgctggcagtcctgaggagattgcagcagacgaagctttggttaaaaaggttggatcatatttgctagacacggtgatcccaaagtttgttcaggatctttgctcccttgatgtctcccctatggatggccaaactttaactgatgtactgcatagcaatgggataaatgttcgctatctgggcaaagttgcaggtatgattaagcatttgccacacttgtgggacttgtttatggctgagataattgttaggtccgcaaagcatgttgtaaaggaaatactgaggcaaagcccagaccataatattgcacctgctgttgcccatttttaaattgttttgtcggcaaagttttggctgcttcaactaaaggtagtgctagcagcacacagtccaaagcccagaagggccagaaattgagttcatcttcttcaaggaaggttcaacctgcatatttgcatctaacatctgaggtaatttggtccaacattaaggagttcgcaaaacataaatatcagtttgaagtgccagatgatgcgagagttggggctaaaagagtctcagttctccgcaatctttgccaaaaggtgggaataacaattgttgctcgcaaatatgatttggattctgctgctccattccaagattccgatatcttgaatctccaaccaattgttaagcactcagttccaacatgtactgatgcacggaagcttatggaagcagggaaaatccggatggctgagggaacgctgaatgaggcgtacgctctattttctgaagctttttcgctacttcaacagatcaatggtcccatgcacaaggatgctgcaaactgttgccggtaccttgctatggttttgtaccatgctggtgatacagcaggagcaattgtgcagcaacatcgagagcttatcataaatgagcgatgccttggtctagatcatcctgatacagcccacagctatggtaatatggctttgttctatcatgggctcaatcaaactgaacttgcgctgcggcacatgtcccgtacactgctgttgctgagtttagcatcaggtcctgatcatccggatgttgcagcaactcttataaatgtggcgatgatgtaccaggatgcgagtaatatgagtactgctcttaggtatctgcaagaagcccttaaaaagaatgagcgccttttaggcccaggtcatattcaaacagcagtttgttatcatgctcttgccattgcattcagttgtatgggtttatacaagctttcagttcagcatgaaaccagcacacatgatatactggtaaaacagttggggagtgatgattcacggacaaaagattcaggaaattggttgaaaacatttaaggagcgagaacagcaggctaacgcccagaagcaaaagggccagacaacaaacccctctgctaccgctctcaatttattgaaggcgcatcctggattgtatcaagcaatgaaggcagctgcgatccaatctggtgacggatcagcaaatgtcaacaaatcacttaatgctgcagtagttggagaaggtgttcctcgaggaagaggtgtggacgagcgagctgctaaggcgactgcagaagtccgtaaaaaggctgctgccagaggtgttactttgcgcaacggacctcctggaaacagtgtcgcggaacttaatcagattctcaaccttatcaactcagcagcttctgtttctgctgcttctcctgctgccaacactcaaacaactgaatctgaagggtcgcagtcgaatggtcctgccctgaatggcgcaaacgaagccaaggatacaaatcccctatccgccaaggttgacagtcaaactccagtaggattaggtgcttcattggagctgaagaagcagaagtccaagcagaaagctcagtaaaaaaaatctacgatggttgttttctcactacaattttggacctctagggtgtttttttacccataggattgtcacgtccacatagtggcagagtcatttttatttattttgggtggggttcttaggatgagtgaaataataataatgatgaaggatgaagtgaagagaattattgtgataggactgctggtgggagaaatgatcaagccctctcagtatctagatcatccttttgagccttaatttctgtaaactggccacactgatttttttggaccagcgaaattaacaggtcgagggttttattgaggcatagcagggtaaatatcttatattttcggtttgctactgtcaggaggggtttgtaccaggaaatatttcgtatcaccatattctggagttgttcagtcaccttaattcgttgttgtcgacagacacttcaaatccagat

SEQ ID NO: 3886 - DNA, 1263 bp, Pseudoroegneria spicata
caccgggaggcgctcgagctctactcggcggcgctggcggcggcccggggccccgcgcagcgcatcgccctgcacagcaaccgcgccgcctgctacctcaagctccatgacttccacaaggctgcagaagagtgcacatctgtcctcgagttggatactgagcatgctggagctctcatgctacgtgcccagactcttgtcactctaaaagattaccagtcggctctatttgatgtaaaccggttaattgagataaatccatcctctgaagtatatcggaaccttcatgcgcgactgaagacacagctgtcactagccccgattccagagtctgaagaggagtccctatatactgaagaagacaaagaagatctgccaccaaaagacaatacaaagaatgagactgtcgttgttaagtctgatcaaccttctgcaaaactgattcttgaaaataaacctgtaacaaaagctctgaaggttgaagtgcctcccaatctgccttcaaaacccgagggtggggggaccatacaaaaaccaaagggccactcagagcttgactacaagaaacctttaacggaagctccgaaggttcaagtgtctcctagtctgccttcaaaaccgggggccatccaaaaaccgaagggccattcagggcttgattactcgaaatgggacaaagttgaggatgattcgagtgaagatgacgaggatgatgacgaagatgacttgccacggtataaattcaaagtcagaaccatcggtgtgcgtaccgtgaagtgaatgggatcatcaataaataagtttactccatggtctgtggatagccgtttgacagcatccctactaactgtggtcccatctgttcggttacatcttgaaatacttggatgaagtgttgccgattggtgtttgtttaactgaaactcaacggtgggtgaagacataagtacccgctgctctcatctcgtgcgctgcagctcaggtttctggatctggaaccttagccgaggaaacaagtgtggagtgaaatcatgttttcagcgcagccgtgggatggagcacggcatgcaaatccttgtagggagcccctttagattcaagctaacaatcttagtccattgttcatcttcgtagattctatagcctaacagtctctgtacatagattgcgcattcatcgtgtataaaacgtttatttgtgtccgccccaagacattgtctcacgatttcagtcagcaaattcgatgctaatatttcatgatcc

SEQ ID NO: 3887 - DNA, 2222 bp, Zea mays
ccgtccacagcaaacggaggagacgtgccggtgccgccgccgcgccggtgcggcccgcccggcatataacaaccacctgcttctcagcagccgctagctccagcctactcaccatgatggctttcttcgtcgtccagcgaggctccagccaactcacgccgctcctcgcgctcgcgctcctcggcctgctgcgctgcgccgccgtctcgtgctcggcggcggcggcggcgacgacgctgctgcaccgcgagagctacgcgggcaagtcggagttcaggacggtgaaccgcaagccgctgggctcctgcgtcgacccgagcccctacctggccatcgatgtcggcgccgcaggcccgatccccgacgaggcgttcctccaggtcaccgtctccggcgtgcaaaggcccgacccctccgactgggtcgccatgatcacgccttccaactccagcgttgctgggtgtcctctgagtgaagtgaactacgtggagaccggcgacctggcgaatctcccgctcctctgccactatcctgtcaaggcccaatacctgacaagcgaccccggatacctgggctgcaagaacgccgggtgcgggaagcgcgacgcgtccggcgcatgcacggcccggacctgcgccgccacgctcaccttccacgtcgtcaacttccgcaccgatgtcgagttcgtgctcttctccggcggcttcaaggcgccgtgcctcctcaagcggtccggcgcgcgccggttcgccaaccccgccagcccgctctacggccacctctccagcaccgactccaaggccacctcgatgaggctcacctgggtgagtggagacgggaatcctcagcgcgtgcagtatggagacggaaagtcatctacttctgaagtcgcaacgttcacgcaggatgacatgtgcagtatatccgtgctgccgagccctgccaaggattttggctggcatgaccccggctatatccactcggccgtcatgactgggcttcagccatctcagtcctacacttaccgctacggaagtgattctgtgggctggagtgacacagttaaatttagaactgcaccagccgctggttcagatgagctatcctttgtgatctatggtgatatggggaaggctccactggacccgtctgtggaacactacattcagcctggatcggtttctgtggccaaggcagtggctaaagagatccaaacaggaaacgtggactccattttccatataggagacatcagctatgccacaggattcctggtcgagtgggacttcttccttcacctcatcacgccactggcctctcaagttccctacatgacagctattggtaatcacgaaagggattacgcgagctctgcatctgtgtatgtgactcctgattcagggggtgaatgtggggttgcctacgaatcatacttccccatgcctgctgttagtaaggataagccatggtattctattgagcaagggaccgttcacttcattgtgatgtccactgagcatgagtggtcggagaagtcagagcagtacaattggatggacgaagatttgtcatcggttgatagatcaagaacaccgtgggtgatcttcattggacatagacccatgtattcctcccatggtggtatactgcccaacgtggattccaactttgttgcctctgttgagccactcctgctcaactaccaggtggatctggttttcttcggccatgtacacaactacgagaggacttgtgcggtataccaaggcaattgcaaaggcatgccaacgacggacaaaagtggaattgacgtttatgacaacagcaactacaccgcacctgttcatgtcattgttggagcaggagggttcagcttggacagcttccctaacaaaggggaggcctggagcttatcaagggtttcggagtttggctatggcaaggtgcatgctacaagaaccgatatgctggttcagtttgtaaactcaagttcgatggaggtacgagaccaatttaggattgtgaagggagctccggcaaacaagtcactgagcctgataattcaataatagctgtcgctcacaacagaaagaagattaactggacctacttctcacctttttttgaagaatactatttatttttgtactgtaaataccatattattgtatagtatagatgttgtgtatctacaacatttacattaataaacgacccttgtt

SEQ ID NO: 3888 - DNA, 2935 bp, Panicum virgatum
cgcccgtcgcgacgacccatcaatgcgcccctcccggcccgtctcgccggacgctggctgtggcggcgcaccgggcgtgcacgtgttccgcccacgcgttcggttgaggcatcgcaaagccggccggagccgcacggttgcagcagctagctctgatcaaacgacacagttaacgctggccgtgcgcgatcccctctttcccgtcgcctcaccggccgccatttatgtcgctcgccgtcgccgtacgatggacggatgatccatcaactggcaacgtacgggggagccgcaaggctggcggtaattaatcggctgggttcattaaggcctctcggatggtgatggcgacggtcgcacagacaagcgagaggggatcggcagatcggcagctccgcccgttcccaccgcgctcgctcggcgccacgtacagcgcacagcgccgcgcggccgctcctctcgtggacgcaggaggcagctggacgcttccctctccgtctctcagtgcctccgctgccctctgcctgcgaccgcgactgcgactgcgagatgcgtccgtcgcggcgacgcctcgctaatcgccgtccacacgggcgcggcgggggaggcgtgccgttggcgttgctgcggccgtcggggtcggggccccgcatataataaccttagttaggctgcccctccaggcacacagttcgcgcgcgcgatacagccgcacgcgtagctgcgatgggtttcttcagctccagcgtcgtcccgccgctgctcgtgctcctcggcctgctgtgcggcggcgcggtctcgtcctcgccgccgccggagatgctgcacgggagctacgcgggcaagtcggagttcaggacggtgaaccggaaggagctccagtcgtgcctcaacccgagcccgtacctggcgatcaatgtcagcaccggcggggcgccgctccccgacgaggccttcgtcaaggtcaccgtcgccggtgtcctcaggcccgacgcctccgactgggtcgccatgatcacgccttccaactccagcgtctctgggtgtcctctgagtggcgtgaactacgtggagaccggtgacctggcgaatctcccgcttctgtgccactaccctgtcaaggcccagtacctgacaagcgaccccggctacatgggctgcaagaacgccggctgcgggaagcgcagcgtggccggcgcctgcaaggcccggacctgcgccgccacgctcaccttccacgtcgtcaacttccgcaccgacgtcgagttcgtgctcttctccggcggcttcaagacgccgtgcctcctcaagcgctccggcgcgctccggttcgccaaccccgccagcccgctctacggccacctctccagcaccgactccaaggccacctcgatgaggcttacatgggtgagcggagacgggaatccgcagcaagttcagtacggagacgggaagtcctctacttctgaagttgcaaccttcacgcaggatgatatgtgcagtatctccgtgttgccgagccctgccaaggatttcgggtggcatgaccccggctacatccattcggtcatcatgactgggctccagccctctcaatcctacacctaccgctatggaagtgattctgtgggttggagtgacacgatcaaattcagaactccaccagctgcaggttcagatgagctatcctttgtgatctatggtgatatgggaaaggctccgctggatccatctgtggaacactacattcagcctggatcgatttctgtggccaaggcagtggctaaagagatccaaacaggaaaggtcgactccatcttccatataggagacatcagctatgctacgggtttcctggtggaatgggacttcttccttcacctaatcacgccacttgcttctcaagtttcctacatgaccgccattggcaatcacgaaagggattacgcgaactctgcatctgtgtatgtgactcctgattcaggtggtgaatgtggagtcgcctacgagtcatacttccccatgcctgctgtcagtaaggacaagccatggtattcgatcaaacaagggagcgttcacttcattgtgatgtctaccgagcatgagtggtcagagaagtcagagcagtacaattggatggacgaagatttgtcatcgattgatagatcaagaacaccatgggtaatcttcattgggcatagaccgatgtattcctcccatggcggtatactgcccaatgtggattccaactttgttgcgtctgttgagccactcctgctcaactaccaggtggatttggttttcttcggacatgtacacaactatgagaggacctgtgcagtataccagggaaactgcaatggcattccaacaaaggatgcaaacggaattgacgtctatgacaacagcaactataccgcaccagttcatgctattgttggagcaggagggttcagcttggataacttccctaacaatggggagacctggagcttatcgagggtttcagagttcggctatgccagggttcatgccacaagagccgacatgcttgttcagtttgtaaactcaagtacgatggaagtccgggaccaatttaggattgtgaagggatcttcagcaaagaagaccccgagcctgataattcaacaatagctgcagcaaagaaaacttgtttattttttttatactgtaaatagttgctgaatcacacattactacgctagtgtatattattctacatatacacgtgtacaatgacaatagacgtcccttttcatattagttccttattgttatgttgaaacagtcaatagccttgcacaaattgtgctgcagtatatcttggacaagaggatctgatattttttctatactaaacagaactgcgcctatatatatatagttaaagatataggtgtacaaaatgcaataagct

SEQ ID NO: 3889 - DNA, 2150 bp, Setaria italica
caggcagcagccacacacgcgcgcgggcagttgcgatggggcgtttcttcagctccggcgtcgtcccgctgcggcttgcgctcctcctcgccctgcactgcgccgcggtctcgtgctcggcgccgccgccggagatgctgcacgggagctacgcggggaagtcggagttcaggacggtgaaccggaaggagctcgagtcgtgcctcaacccgagcccgtacctggcgatcaatgtcagcaccgccggcggcggggcggcaaacctccccgacgaggcgttcctccaggtcaccgtcgccggcgtcctcaagcccagcgcctccgactgggtcgccatgatcacgccttccaactccagcgtttctgggtgtcctctgagcgtagtgaactacgtggagaccggggacctggcgaatcttccgcttctgtgccactaccctgtcaaggcccagtacctgacaagcgaccccggctacatgggctgcaagaacgcgggctgcggggagcgcggcgcgtccggcgcctgcacggcccggacctgcgccgccacgctcaccttccacgtcgtcaacttccgcaccgacgtcgagttcgtcctcttctccggcggcttcgagacgccgtgcctcctcaagcgctccggcgcgctccgtttcgccaaccccgccagcccgctctacggccacctctccagcactgactccaaggccacctcgatgaggcttacctgggtgagcggagacgggaatccgcagcaagttcagtacggagacggcaagtcttctacctctgaagtcgcaaccttcacgcaggatgatatgtgcagtatctccctgttgccgagccctgccaaggatttcgggtggcatgaccccggctacatccattcggccgtcatgaccgggctccaaccctctcagtcctacacttaccgttacggaagtgattcagtgggctggagtgacacgattaaattcagaactccaccagctgcaggttcagatgagctatccttcgtgatctatggtgatatgggaaaggctccatttgacccatcagtagaacactacattcagcctggatcgatttctgtggccaaggcagtggctaaagagatccaaaatggaaaggtcgactccatctttcatataggagacatcagctacgctacgggcttcctggtggaatgggacttcttccttcacctcatcacgccacttgcttctcaagtttcatacatgactgctattggcaatcacgaaagggattacgcgaactctgcatctgtgtatgtcactcctgattcaggtggcgaatgtggagtcgcctatgagtcatacttccccatgcctgctgtcggtaaggacaagccatggtattcgattgagcaagggagcgttcacttcatcgtgatgtctaccgagcatgagtggtcggagaagtcagagcagtacaattggatggacgaagatttgtcatcgattgacagatcaagaacaccatgggtaatcttcatcgggcataggccaatgtattcctcccatggtggtatactgcccaatgtggattccaactttgttgcctctgttgagccactcctgctcaactaccaggtggatttggttttcttcggccatgtacacaactacgagaggacctgtgcagtataccaggaaaactgcaatggcatgccaatgaaggatgcaaatggagttgacgtctatgacaacagcaactataccgcacctgttcatgccattgttggagcaggagggttcagcttggacaatttccctaacaatggggagacctggagcttatcgagggtttcagagttcggctatgccagggttcatgccacaagaaccgacatgctggttcagtttgtaaactcaagtaccatggaggtccgggaccaatttaagattgtgaagggatctacatcaaagaagtcctcaaacctgacaattcaacaatagctgctgcctgcagctcatgagaaagaagattaaactgaagctactcctctcttttttatgttatactgtaaatagttgctgaattacacattagtgtatattctacggatacatgtgtacaatgacatttacatcaatagacgttcctttacatgttagttccttattatg

SEQ ID NO: 3890 - DNA, 2443 bp, Triticum aestivum
ctggctagcgggccccagacgtaggcgtctcgctgcccgcgtcgcatctccaaccccgcacgacccatctctccatgctcctccgcctcctctcgtccgcctctcgcgccatcgcagcaaaacctcacccaccccaaaccctagccgctgctgcagctggcgccacctcaaccacccggaagctcgcagccatggcgggtaaccgggaggcgttccgcgtggcggtggggaacacgctcgagcggcgcctcttctacgtgccgtccttcaagatctacggaggcgtcgcggggctctatgactacgggccgccagggtgcgccgtcaaggcaaacgtcctcgccttctggcgccagcatttcgtgttggaggaagggatgcttgaggtagactgtccatgtgtgacaccagaagttgtcttgaaggcctctggccatgtcgaaaagtttacggacttgatggttaaagatgaaaagacaggcagctgttatcgtgctgatcacttactcaaggacttctgtaaggagaagctcgagaatgacaatacattgtcaccagagaaggtagaagaattaaaccatattcttgctgtcttggatgatctgtcagcagaacaattaggcgctaagattaaggagtatgggattgctgctcctgacacaaagaatccattgtcagatccatacccctttaatctcatgtttcagacttccattggaccatcaggtttgagtgcagggtatatgaggccagagacagcacagggtatctttgtgaacttcaaagacttgtattactacaatggcaacaaactacccttcgctgcagcccaaatcggccaggctttccgcaacgagatatctccccgtcaaggccttctaagagtccgtgaatttacgttggcggagattgagcactttgtggacccagaggacaagtctcatccaaagtttagtgatgtttctgatctagagttcctgatgtttccgagagaagatcaactgacaggaagatctgccactagacttaggctcggtgaagctgtttctgagggaactgtgaacaatgagacccttggcttctttattggaagggtctatctcttcttgacgcagcttgggattgacaaagaccgtctacggttccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgaaaaattcgcagagcccagagaagtggagaagttagttataaccccatcaaagaaggagcttggtcttgcgttcaaaggggaccaaaagatggttctcgaagcattggaagccatgggtgaaactgaagctctgggtatgaaagcagctttagagtctaaaggggatgttgagtttaaggtttgtacccttgggaaggatgttaccataaagagaaatatggtttcaattaacatggagaagaaaaaggaacatcaaaggaagttcactccttctgtcatagagccatcatttggcatagggagaattatttactgcttgttcgaacattgcttctatcaaaggactggcaagacagatgatgagcagttgaatgtgtttcgttttccccctcttgttgctccaattaagtgtactgtgtttccactggtcaaggttgagaaatttgatgttgttgccaagaaaatttcaaaagctttgacaacagcagggatttctcacattatcgacatcacaggcacttcgattggtaagcggtatgcaaggacagacgaaatcggcgtccccctggcgatcacagtcgactcaactacaagtgtgactgtccgtgaccgggacagcaaggatcagatccgtgttgaggtcgacgaggtggctttggttgtgaaggaagtgaccgatgggcagagcacctgggcagacatcatgtggagatacccagcacataccgccttggccaccgatgaggaagaagcttcagaaacctgaagggtacagtcgaagagtcttccatgggttgaatgatgtttggcttcctgagtttccgatgtgtgtcctgttaacagaaatactaatagagcgttgccctgtaatcctagtcctgttttcccttcacgtatggttttcatccgttccctgtcgatatttactgtatctacatgctcatctcgtgtgattaaatggaagagacgtgtgcataattttcttttggtcggattgatattgttcagatttgtcatgtgagtcatcttgatcccacaatagaagtattcctaggtattctttttcgagttaataccacaattagtacataaaattgtcctggtgggaacagtcatagaagaactgaccctcac

SEQ ID NO: 3891 - DNA, 2362 bp, Triticum aestivum
cggccatcgcagcaaaacctcacccaccccaaaccctagccgctgctgcagctggcgccacctcaaccacccggaagctcgcagccatggcgggtaaccgggaggcgttccgcgtggcggtggggaacacgctcgagcggcgcctcttctacgtgccgtccttcaagatctacggaggcgtcgcggggctctatgactacgggccgccagggtgcgccgtcaaggcaaacgtcctcgccttctggcgccagcatttcgtgttggaggaagggatgcttgaggtggactgtccatgtgtgacaccagaagttgtcttgaaggcctctggccatgtcgaaaagtttacggacttgatggttaaagatgaaaagacaggcagctgttatcgtgctgatcacttactcaaggacttctgtaaggagaagctcgagaatgacaatacattgtcaccacagaaggtagaagaattaaaccatattcttgctgtcttggatgatctgtcagcagaacaattaggcgctaagattaaggagtatgggattgctgctcctgacacaaagaatccattgtcagatccatacccctttaatctcatgtttcagacttccattggaccatcaggtttgagcgcagggtatatgaggccagagacagcacagggtatctttgtgaacttcaaagacttgtattactacaatggcaacaaactacccttcgctgcagcccaaatcggccaggctttccgcaacgagatatctccccgtcaaggccttctaagagtccgtgaatttacgttggcggagattgagcactttgtggacccagaggacaagtctcatccaaagtttagtgatgtttctgatctagagttcctgatgtttccgagagaagatcaactgacaggaagatccgccactagacttaggctcggtgaagctgtttctgagggaactgtgaacaatgagacccttggcttctttattggaagggtctatctcttcttgacgcagcttgggattgacaaagaccgtctacggttccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgaaaaattcgcagaacccagagaagtggagaagttagttataaccccatcaaagaaggagcttggtcttgcgttcaaagggagccagaagatggttctcgaagcattggaagccatgggtgaaactgaagctctgggtatgaaagcagctttagagtctaaaggggatgttgagtttaaggtctgtacccttgggaaggatgttaccataaagagaaatatggtttcaattaacatggagaagaaaaaggaacatcaaaggaagttcactccttctgtcatagagccatcatttggcatagggagaattatttactgcttgttcgaacattgcttctatcaaaggactggcaagacagatgatgagcagttgaatgtgtttcgttttccccctcttgttgctccaattaagtgtactgtatttccactggtcaaggttgagaaatttgatgttgttgccaagaaaatttcaaaagctttgacaacagcagggatttctcacattatcgacatcacaggcacttcgattggtaagcggtatgcaaggacagacgaaatcggcgtccccctggcgatcacagtcgactcaactacaagtgtgactgtccgtgaccgggacagcaaggatcagatccgtgtggaggtcgaagaggtggcttcggttgtgaaggaagtgaccgatgggcagagcacctgggcagacatcatgtggagatacccagcacataccgccttggccaccgatgaggaagaagcttcagaaacctgaagggtactggcttcctgagtttcggatgtgtgtcctgttaacagaaatactaatagagcgttgccctgtaatcctagtcctgttttcccttcacgtatggttttcatccgttccctgtcgatatttactgtatctacatgctcatctcgtgtgattaaatggaagagacgtgtgcataattttcttttggtcggattgatattgttcagatttgtcatgtgagttatcttgatcccacaatagaagtattcctaggtattctttttcgagttaataccacaattagtacataaaattgtcctggtgggaacagtcatagaagaactgaccctcactaaagtggccgcttgactatattgttgtaacattttcatactacaaaacagtttgaa

SEQ ID NO: 3892 - DNA, 2294 bp, Secale cereale
gcgtctcgctgcccgcgtcgcatctccaacgcccgcacgactcatctctcaatgctcccccgcctcctctcgtccgcctctcgcgccatcgcagcaaaacctcacccaccccaaaccctagccgctgctgcagctggcgccacctcaaccacccggaagctcgcagccatggcgggtaaccgggaggcgttccgcgtggcggtgggaaacacgctcgagcggcgcctcttctacgtgccctccttcaagatctacggaggcgtagcggggctctatgactacgggccgccagggtgcgccgtcaaggcaaacgtcctcgccttctggcggcagcatttcgtgttggaggaagggatgcttgaggtggactgcccatgtgtgacaccagaagttgtcttgaaggcctctggccatgtcgaaaagtttacggacttgatggttaaagatgaaaagacaggcagctgttatcgtgctgatcacttactcaaggacttctgtaaggagaagctcgagaatgacaatacattgtcaccagagaaggtagaagaattaaaccatattcttgctgtcttggatgatctgtcagcagaacaattaggcgctaagattaaggagtatgggattgttgctcctgacacaaagaatccattgtcagatccatacccctttaatctcatgtttcagacttccattggaccatcaggtttgagtgcagggtatatgaggccagagacagcacagggtatctttgtgaacttcaaagacttgtattactacaatggcaacaaactacccttcgctgcagcccaaatcggccaggctttccgcaatgagatatctccccgtcaaggccttctaagagtccgtgaatttacgttggcggagattgagcactttgtggaccctgaggacaagtctcatccaaagtttggtgatgtttctgatctagagttcctgatgtttccgagagaagatcaactgacaggaggatccgccacgagactcaggctcggtgaagctgtttcggagggaactgtgaacaatgagacccttggcttctttattggaagggtctatctcttcttgacgcagcttgggattgacaaagaccgtctacggttccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgaaaaattcgcagaacccagacaagtggagaagttagttataaccccatcaaagaaggagcttggtcttgcgttcaaagggaaccagaagatggttctcgaagcattggaagccatgggtgaaactgaagctctgggtatgaaagcagctttagagtctaaaggggatgttgagtttaaagtttgtaccctcgggaaggatgttaccataaagagaaatatggtttcaattaacatggagaagaaaaaggaacatcaaaggaagttcactccttctgtcatagagccatcatttggcatagggagaattatttactgcttgttcgaacattgcttctatcaaaggattggcaagacagatgatgagcagttgaatgtgtttcgttttccccctcttgttgctccaattaagtgtactgtgtttccactggtcaaggttgagaaatttgatgttgttgccaagaaaatttcaaaagctttaacaacagcagggatttctcacattatcgacatcacaggcacttcgattggtaagcggtatgcaaggacagacgaaatcggcgtccccctggcgatcacagtcgactcaactacaagtgtgactgtccgtgaccgggacagcaaggatcagatccgtgttgaggttgacgaggtggcttcggttgtgaaggaagtgaccgatgggcagagcacctgggcagacatcatgtggagatacccagcacataccgccttggccaccgatgaggaagaagcttcagaaacctgaagggtacagtcgaagagtcttccatgggttgaatgatgtttggcttcctgagtttcggatgtgtgccctgtaatcctagtcctgttttcccttcacgtatggttttcatccgttccctgtcgatatttactgtatctacatgctcatctcgtgtgattgaaaggaagagacgtgtgcataattttcttttggtcggattgatattgttcagatttgtcatgtgagttatcttgatcccacaa

SEQ ID NO: 3893 - DNA, 2191 bp, Avena sativa
cgcgccaccatcgcagcaaaacctcacccgccccaaaccctagccgctgctgccacctcaaccacccggcttctcgcggacatggcggggaaccgggaggcgttccgcgtggcggtgggcaacacgctggagcggcgcctcttctacgtgccgtccttcaagatctacggcggcgtcgccgggctttacgactacgggccaccagggtgcgccgtcaaggccaacgtcctcgccttctggcgacagcattttgtgttggaggaagggatgcttgaggtggactgtccatgtgtgacaccagaagttgtcttgaaggcctctggccacgtggagaagtttacagacttaatggttaaagatgaaaagacaggcagctgctatcgtgctgatcacttactcaaggacttctgcaaggataagcttgagagagacaccacactgtcaccagagaaaatagaagaattaaaccatattcttgctgtcttggatgatctttcggcagaacaattaggtgctaagatcaaggagtatgggattgttgctcctgatacaaagaatctattgtcagatccgtacccctttaatctcatgtttcagacgtccattggaccatcaggcttgagtgcagggtatatgaggccagagacagcacagggtatctttgtcaacttcaaagacttgtattactacaatggcaacaagctaccttttgctgcagcccaaattggccaggccttccgtaatgagatatctcctcgtcaaggccttttgagagtccgtgaatttacactagcagagattgagcactttgtggaccctgaggacaaatcgcacccgaagtttagtgatgtttctgatctagagttcctgatgtttccaagggagcagcaactgacaggaagatcagccacaaaacttaaactcggcggagctgtatctgagggaactgtgaacaatgagacccttggctattttattggaagggtctatctcttcttgacgcagcttgggattgacaaagaccgtctacggttccgtcaacatctgccaaatgaaatggctcactatgctgctgattgttgggatgcagagattgaatgttcttatgggtggatcgagtgtgttggaattgctgatagatctgcatatgacttgcgtgcccactcggataaaagtggtgttccactcgaagcacatgaaaagtttgcagaacccagagaagtagagaaattagttataaccccatcaaagaaggagcttggtcttgcattcaaagggaatcaaaagatggtcctcgaagcgttggaagccatgggtgagactgaagctttggatatgaaatcaactttggagtctaaaggggaggttgagtttaaggtgtgtacccttgggaaggatgttaccgtaaagaaaaatatggtctcaattaacatcgagaagaaaaaggaacatcaaaggaaatttactccttctgtcatagagccatcatttggcattgggagaattatttactgcttgtttgaacattgcttttatcaaaggactggcaagacagaggatgagcagttgaatgtttttggttttccccctcttgttgctccaattaagtgtaccgtatttccactggtcaagattgagaaatttgatgttgtcgccaagaaaatttcaaaagcattgacaacagttgggatttctcacattattgacatcacaggcaactcaattggtaagcggtacgcaaggacagacgaaattggtgtccctttggcgatcacggtcgactcaactacaagtgtgactgtccgtgaccgggacagcaaggatcaaatccgcgtggaggtcgatgaggtggcctcggttgtgaaggaagtgactgatggtcagagcacctgggcagatatcatgtggaggtacccagcacatactgcctcggctgctgatgaggaagaagcttcagaaacctgaagagtacagtaaaaaagcctccgtggactgatggttgtattctgaatccgatgcatgtcgtgttaacaaaaatgctaatagagcgttgtcctgtaatcctccagctcgcctatgatttttgttctttttatgttaatatttacagtttctgcatgtacattcgtgtgattaaaagtaatgggcgaaacatatgttttctttggtcatattgatatttcttcaaaaa

SEQ ID NO: 3894 - DNA, 2588 bp, Oryza sativa
cacggcaaaaccaggaaggaaagctgcccgcgcccactgagaggtgggccccacacgtcggcgtcacgtcaccccctcgacctcgcatccccaaccccctccacatctcatgctcctctcctccgcctcacgcgcactcgccgccgcaaaaccccgctcgcctgaacccttcgccgccgccgccgcggtcttactccgccgccagctcgccgcaggcatggcggccgcgccggcgtcgtccgcgtccgcggcggggaaccgcgaggcgttccgcgtggcggtgaccaacacgctggagcgccgcctcttctacgtcccgtccttcaagatctacggcggcgtcgcgggcctctacgactacggccctcccggctgcgccgtcaaggccaacgtcctcgccttctggcgccagcatttcgtgttggaggaggggatgcttgaggtggactgcccatgtgtgactcctgaagttgtcttgaaggcctctggccatgtcgacaaatttacagatctgatggttaaagatgaaaagactggcacctgctatcgtgctgatcatttgctcaaggacttctgcaaggataagcttgagaaggacaatacattgtcaccagagaagacagcagaattcaaccatgttcttgctgtcttggatgatctgtctgcagaacagttgggtgctaagatcaaggagtatggcattgttgctccagacaccaagaacccgttgtcagacccatacccctttaacctcatgtttcaaacttccattggaccatcaggcttgagcccagggtatatgaggccagagacagcacaaggtatctttgtaaacttcaaagacttgtattactacaacggcaacaagctaccctttgctgcagcacagattggtcaggccttcagaaatgagatatctcctcgccaaggacttctgagagtccgagaatttactttagcggagattgagcactttgtggacccagaggacaaatcccacccaaagtttcgtgatgtttctgatctggaattttttatgtttccaagagaacaacaactgacaggaaaatcagccatgaaacttaacattggacaggctgtatctgaggggactgttaacaatgagacccttggctactttattggaagggtctatctcttcttgacgcagcttggaattgacaaagatcgtctacggttccgacagcacctgccaaatgaaatggctcattatgctgctgattgctgggatgcagagattgaatgctcttttgggtggattgagtgtgttgggattgctgataggtctgcatatgatctgcgtgctcactcggataaaagtggtgttgcacttgaagcacatgaaaagtttgcagagcctagagaagtggagaagttagttataaccccgtcaaagaaggaactaggtcttgcgttcaaagggaatcaaaggatggttcttgaagcattggaggcaatgagcgagactgaagctttgaatatgaaatcagctttagaatccaaaggggaggttgaatttaaggtgtgtacacttgggaaagatgtcaccataaagaaaagcatggtttcaattaacatggagaagaaaaaggaacatcaaaggaaatttactccttctgtcatagagccatcctttggcatagggagaatcatttactgtctgttcgaacattgcttctatcaaagacctggcaaggcggaggatgagcagttgaatgtattcggtttcccccctcttgttgctcccatcaagtgcactgtctttccacttgtcaagatcgaaaaatttgaagttgttgccaagaaaatttcgaaagcattgacagcagcagggatttctcacataattgatatgacaggtaacacaatcggtaagcgttatgcaaggaccgatgaaatcggtgtccccctggcaatcacggttgacaacaccacgagtgtgactgtccgtgaccgggacagcaaggatcagatccgcgttgaggtcgatgaggtggcctcagtggtgaaggaagtgacggacgggcagagcacctgggcagacatcatgtggaggtacccggcacatactgcctcggccgctgaagaggaggaagcatcagaaacctgaagggggcaagcagtgcagtgcaagccaaaacctctggctggaattgagatggttgttgccatcctgcttttctgatacatgttttaacagaatgctaatgcagcattgagcattgttctgtaatctcgatgatttctctacatatttacagatgattttctcctgtttactgttgatatttggcgtggtctaccacatagttccctgtacttggttttgcacatgaatgtttgtaccgtgtgaatgtgtgattgaaggtcattctagagtatcagtctttacattgtcatattgttgattctctgcgaaaaatactagagctattcatgtcggttttatgtacacaactacttcatgagttccaaaatataaggtgtcaatatttttaggaaaaaacaatatttgtaacctttgactgatataattgaattaagtgtatatatgtttttagtgtcac

SEQ ID NO: 3895 - DNA, 2454 bp, Sorghum bicolor
gcactggaaaatatctggtttcccgtgggcccgggagtacgccaccgatggcccacccaccaggccagcgcgcgtgggcattggggcagcagcggccaccgactagtgggccctacacgtcagccccacgatccgcttcccatctgatgctcctgctccgccgcggcgtcttcgtcctcctctcgtcgccctcgcctcgcgcgccgctcgcaaaacctctcctgccccaacgcccgcccagaaccctagccccgacagcgcggcagctcgtggctatgtctgcgccggcgccgaccccggccccgtcggcgggtggggcggggacgatgagccgggacgcgttccgcgcggccgtgaccaacacgctggagcgccggctcttcttcgtgccctccttcaagatctacggcggcgtcgcggggctctacgactacgggcccccaggttgtgccgtcaaggctaacgtcctcgctttctggcgccagcattttgtattggaggaagggatgcttgaggttgactgtccatgtgtgacaccagaagttgtcttgaaagcctctggacatgttgataaatttacagacttaatggttaaagatgaaaagacaggcaactgctaccgtgcggatcatttgctgaaggacttctgtaaggataagcttgagaaggatcacacattgtcaccagagatggtacaagaatacaatagagttcttgctatcctggatgatctctctgcagaacaattgggtgctaagattaaggagtatgggattgttgctccggacaccaagaacccattatcagatccgtaccctttcaatctcatgtttcaaacttccattggaccatcaggtttgagcccagggtatatgaggccagagacagctcagggtatatttgtgaacttcaaagacttgtattactacaatggcaacaagctgccatttgctgcagcgcaaattggtcaagccttcaggaatgagatatctccccgtcaaggccttctgagagtccgtgagtttactttagcggaaattgagcactttgtggacccagaggacaaatcccatccaaagtttggtgatgtttctgatctagagttcttgatgtttccaagagaggatcaaatggccggaaggtctgccacaagacttaaactcggaaatgctgtgtctgagggaactgtgaacaatgagacccttggctacttcattggaagggtctaccttttcttgacacaacttgggattgacaaagatcgtctccgtttccgtcaacatctgccgaatgaaatggctcattatgctgctgattgttgggatgcagagattgaatgctcctatggttggattgagtgcgttggaattgctgataggtctgcctatgacttacgtgcccactcggataaaagcggcgagaaacttgaagcacatgagaagtttgcagaacccagagaagtggagaaattagttataacgccatcaaagaaggaacttggtcttgcattcaaagggaaccagaagatggttcttgaatcattggaagccatgaccgagactgaagcattggatatgaaagctgtgttggaatccaagggggaggttgagttcaaggtgtgtacgcttgggaaggatgttaccataaagaaaaacatggtttcaattaacatcgagaagaaaaaggaacaccaaaggaaatttactccttccgtcatagaaccatcctttgggattgggcgcattatatattgcctttttgagcactgcttctaccaaagggctggcaagacagaggatgagcagttaaacgtattccgttttccccctcttgttgctccaataaagtgcactgtctttccattggtcaagcttgagaaatttgaggttgttgccaagaaaatttcaaaggccttgacagcagcagggatttcacatattatcgacatgacaggtaatacaataggaaaacggtatgcaaggacggacgagattggtgttcccctggcgatcacagtcgataacactataagcgtgacggtgcgcgatcgcgacagcaaggaccagatccgcgttgaggtggacgaggtggcctcggtggtgaaggaagtgacggacgggcagagcacctgggcagacatcatgtggaggtacccggcgcataccacctcggccgccgacgaggaagacgcggagccctgaagacagcgctggcacaacaccacccaacgatcgttggtccctgatacatttcctcgcttgcttaacagagccagactgcgttgtcgtgtaagcctacagtagtcagatattagcttattttgttatgttggtctcgtaacttctgctgcttcataccatctcgtaaattccttgttttacagtagccagattcctgcacattttgatttccacaaacaaaatagcagcttctttgttagttgacctcgtaaat

SEQ ID NO: 3896 - DNA, 2425 bp, Panicum virgatum
tctcgtcacgaaaatatcttctaccccgtgggcccggaagtatggacccacggccagagcgccgtggacagccttggtcaccgactagtgggccccacacgtcagccccacccaccctgcccccatctgatgctcctgctccgccgcgtctgcttcctccttccgtcgccctcccctcgcgcgccgctcgcaaaacctctcccgctccccctccgcccgcccagaaccctagccccggcggcgcgcccgctcgcttccatggccgcgccggcgggtgggacggcggcgacgagccgggacgcgttccgcgcggcggtgaccaacacgctggagcggcgcctcttcttcgtgccctccttcaagatctacggcggcgtcgcggggctctacgactacgggccccccgggtgcgccgtcaaggccaacgtcctcgccttctggcgccagcattttgtattagaggaagggatgcttgaggtcgactgcccatgtgtgacaccagaagttgtcttgaaagcctctggtcatgtggataaatttacagacttaatggttaaagatgaaaagacaggcaactgctaccgtgcagatcatttgctcaaggatttctgtaaggataagcttgagaaggaccagacattgtcaccagagcaggcagaagaatacaataaaattcttgctatcttggatgatctctctgctgagcaattgggtgctaagattaaggaatatgggattgttgctcctgacactaagaacccgttgtcagatccctaccccttcaatctcatgtttcagacttccattggaccatcaggtttgagtccagggtatatgaggccagagacagcgcagggtatctttgtgaactttaaagacttgtattactacaatggcaacaagctaccttttgctgcagctcaaattggccaggccttcaggaatgagatatctccccgccaaggccttctgagagtccgcgagtttacattagctgaaattgagcactttgtggatccagaggacaaatcccacccaaaatttggtgatgtctctgatctagagttcttgatgtttccaagagaagatcaaatggcaggaaggtcagccacaagacttaaactcggaaatgctgtatctgagggaactgtgaacaatgagacccttggctactttatcggaagggtctaccttttcttgacacaacttgggattgataaagatcgtctacgcttccgacagcatctgccaaatgaaatggctcactatgctgctgattgttgggatgcagagattgaatgctcttatggatggattgagtgtgttggaattgctgataggtctgcctatgacttgcgtgcacactcggataaaagtggtgagaaacttgaagcacatgaaaagtttgcagaacccagagaagtggagaaactagttataaccccatcaaagaaggagcttggccttgcattcaaagggaaccagaggatgattcttgaagcattggaagcaatgggtgagactgaagctttggagatgaaagctgcattggagtccaagggggaggttgagttcaaggtgtgcacccttgggaaggatgttacgataaagaaaagcatggtttcaattaatattgagaagaaaaaagaacaccaaaggaaatttactccttccgtcattgaaccatcctttgggattgggcgcattatatactgcctttttgagcactgtttctaccaaaggcctggcaaggcagaggatgagcagttaaatgtgtttggtttcccccctcttgttgccccaataaagtgcacagtctttccactggtgaagcttgagaaatttgaggttgttgccaagaaaatctcaaaggccttgacagcagcagggatttcacatattatcgacatgacaggtaacacaataggaaaacgctacgcaaggacggacgagctcggcgtgcccctggcgatcaccgttgacaacaccacaagcgtgacggtgcgtgaccgggacagcaaggaccagatccgtgtggaggtggacgaggtggcctcggtggtgaaggaggtgacggacgggcagagcacctgggccgacatcatgtggaggtacccggcgcacactgcctcggtcgccgaggatgaggaggccgaaccctgaagagcacagccaaaacaatatccaacgatcgttggcccctgatagcatttcctgcttaaaagaaacagaatgcgttgtcgtgtaagtctacggtagcctgattcctgcaaatttccacactttatttgtgaattgtgatgtttgacccgtagattctgctgttcgtttcattttttttttcaccttacgaactgcaatgtttgatgaatcttttgtcagattgcaattttcacagtggcgcacaatacgtgactacatgtta

SEQ ID NO: 3897 - DNA, 2205 bp, Pennisetum glaucum
ggcgcgccccatctgatgctcctgctccgccgcgtctcctccctcctgccgtcgctctcccctcccgcgccgctcgcgaaacctctcccgctcctcctccgcccgcccagaactctagcctctgcccccgcaacgcgtccgctcgcatccatggccgcgccggcgggtggggcggcggcggcggcgatgagccgggacgcgttccgcgcggcggtgaccaacacgctggagcggcgcctcttcttcgtgccctccttcaagatctatggcggcgtcgcggggctctacgactatgggccccccgggtgcgccgtcaaggccaacgtcctcgccttctggcgccagcattttgtattagaggaagggatgcttgaggtagactgtccatgtgtgacaccagaagttgtcttgaaagcctctggccatgtggaaaaatttacagacttaatggtcaaagatgaaaagacaggcaactgctaccgtgcagatcatttgctcaaggacttctgtaaggataagcttgagaaggacaacacattgtcaccagagcagacagaagaatacaataaaattctggctatcttggatgatctctctgcagagcaattgggtgctaagatcagggagtatgggattgttgctcctgacaccaagaactcattatcagatccctaccccttcaatctcatgtttcagacttccattggaccgtcaggtttgagtccaggttatatgaggccagagacagcacagggcatctttgtcaacttcaaagacttgtactactacaatgggaacaagctgccctttgctgcagcccaaattggccaggctttcaggaatgagatatctcctcgtcaaggccttctgagagtccgcgagtttacgttagcggaaatcgagcactttgtggacccagaggacaaatcccacccaaagtttggtgatgtttctgatctagagttcttgatgtttccgagagaggatcaaatggcaggaagctcagccacaaaacttaatattggaaatgctgtatctgagggaactgtgaacaatgagaccctcgggtactttatcggaagagtctaccttttcttgacacaacttgggattgacaaagaccgtctacgcttccgacagcatctgccaaatgaaatggctcactatgctgctgattgttgggatgcagagattgaatgctcttatgggtggattgagtgtgttggaattgctgataggtctgcctatgacttgcgtgctcactcggataagagtggtgagaaacttgaagcacatgaaaagtttgcagaacccagagaagtggagaagttagttataaccccatcaaagaaggagcttggccttgcattcaaagggaatcaaaggatggtccttgaagctttagaagccatgggcgagactgaagcattggatatgaaagctgcgttggagtccaaaggggaggttgagtttaaggtgtgcacccttggaaaggatgtcaccataaagaaaagcatggtctcaattaacatcgagaagaaaaaagaacaccaaaggaaatttactccatccgtcattgaaccatcctttgggattgggcgcattatatactgcctttttgagcactgcttctaccaaaggcctggcaagacagaggatgagcagttaaacgtatttggttttccccctcttgttgccccaataaagtgcactgtctttccattggtcaagcttgagaaatttgaggttgttgccaagaaaatttcgaaggccttgacagctgcagggatttcacatattatcgacatgacaggtaacacgataggaaaacggtacgcgaggacggacgagattggtgttcccctggctatcacggttgacaacaccacgagcgtgacggtacgtgatcgggacagcaaggaccagatccgcgtggaggtggacgaggtggcctcggtggtaaaggaggtaacggatgggcagagcacctgggcggacatcatgtggaggtacccggcgcacacttcctcagccgccgatgatgaagacgctgaaccctgaagaacacaaccaatccatttattgttgggcccttgatagcatttcctcaacagaaacagaacgtgttgtgtaaattgtctgcagatagtttccttgtcaattgtgatgttagaccccctctgtgctgcttagttcatctatttc

SEQ ID NO: 3898 - DNA, 2395 bp, Setaria italica
gactagtgggccccacacgtcagtcccaccactctctcacccgcggcgccccatctgatgctcctgctccgccgcgtctccttcctcctgccgtcgccctccttccctcgcgcgccgctcgcaaaacctctcccgctcctcctcctcctcctccacccgcccagaaccccagccccgacagcgcgcccgctcgcttccatggctgcgccggccgcgccggcgggtgggacggcggcgatgagtcgggacgcgttccgcgcggcggtgaccaacacgctggagcggcgcctcttcttcgtgccctccttcaagatctacggcggcgtcgcggggctctacgactacggcccccccgggtgcgccgtcaaggccaacgtcctcgccttctggcgacagcattttgtattagaggaagggatgcttgaggtagactgtccatgtgtgacacctgaagttgtcttgaaagcctctggccatgtggataaatttacagacctaatggttaaagatgaaaagacaggcaactgctaccgtgcagatcatttgctcaaggacttctgtaaggataagcttgagaaggaccacacattgtccccagagcagacagaagaatacaacaaaattcttgctatcttggatgatctctctgcagagcaattgggttctaagatcagggagtatgggattgttgctcctgacaccaagaacccattatcagatccctaccccttcaatctcatgtttcagacttccattggaccgtcaggtttgagttcaggttatatgaggccagagacagcacagggtatctttgtcaacttcaaagacttgtactactacaatgggaacaagctaccctttgctgcagcccaaattggccaggccttcaggaatgagatatctccccgtcaaggccttctgagagtccgtgagtttacgttagcggaaatcgagcactttgtggacccagaggacaaatcccacccaaagtttggtgatgtatctgatctagagttcttgatgtttccgagagaggatcaaatggcaggaaggtcagccaaaagacttaagattggaaatgctgtatctgagggaactgtaaacaatgagacccttggctactttatcggaagggtctaccttttcttgacacaacttgggattgacaaagaccgtctacgcttccgacagcatctgccaaatgaaatggctcactatgctgctgattgttgggatgcagagattgaatgctcttatggatggattgagtgtgttggaattgctgataggtctgcctatgacttgcgtgctcactcggataaaagcggtgagaaacttgaagcacatgaaaagtttgcagaacccagagaagtggagaagttagttataaccccatcaaagaaggagcttggccttgcattcaaagggaatcaaaggatggttcttgaagctttagaagccatgggcgagactgaagcgttagatatgaaagctgcgttggagtccaatggggaggttgagttcaaggtgtgcacccttggaaaggatgttaccataaagaaaagcatggtttcaattaacatcgagaagaaaaaagaacaccaaaggaaatttactccttccgtcattgaaccatcctttgggattgggcgcattatatactgcctttttgagcactgcttctaccaaaggcctggcaagacagaggatgagcagttaaacgtatttggttttccccctcttgttgccccaataaaatgcactgtctttccattggtcaagcttgagaaatttgaggttgttgccaagaaaatttcgaaggccttgacagctgcagggatttcacatattatcgacatgacaggtaacacaataggaaaacgctacgcaaggacggacgagattggtgttcccctggcgatcacggttgacaacaccacgagcgtgacggtgcgcgaccgggacagcaaggaccagatccgcgtggaggtggatgaggtggcctcggtggtgaaggaggtgacggacgggcagagcacctgggccgacatcatgtggaggtacccggcacacaccgcctcggccgtcgatgatgaagaagccgaaccctgaacacagccaaagccatatccaacgatcgttggccttgatagcattacctgcttaacagaaacggaatgcgtggtcgtgtaagcctacggtagcattgattcctgcaaatttccagagatcgtttccttgtcaattgtggtgttggaccgtagattctgctgcttcgttcatctatttcacccttacgaactgcaatgtttgatgaagagaatcctttgcttgttagattggaatgtacagtattcttttttttttatataaaaaaagcacagtacatgttcat

SEQ ID NO: 3899 - DNA, 2304 bp, Saccharum officinarum
tcctcctctcatcgccctcgcctcgcgcgccgctcgcaaaacctctcctgctcctacgcccgcccaaaaccctaggcccgacagcgcggcagctcgtggctatgtctgcgccggccccgtcggcgggtggggcgggagcgatgagccgggacgcgttccgcgcggccgtgaccaacacgctggagcgccggctcttcttcgtgccctccttcaagatctacggcggcgtcgcggggctctacgactacggccccccagggtgcgccgtcaaagctaacgtcctcgctttctggcgccagcattttgtattggaggaagggatgcttgaggttgactgtccatgtgtgacaccagaagttgtcttgaaagcctctggacatgttgataaatttacagacttaatggttaaagatgaaaagacaggaaactgctaccgtgcggatcatttgctgaaggacttctgtaaggataagcttgagaaggatcacacattgtcaccagagatggtagaagaatacaatagagttcttgctatcctggatgatctctctgcagaacaattgggtgctaagattaaggagtatgggattgttgctccggacaccaagaacccattatcagatccgtaccctttcaatctcatgtttcaaacttccattggaccatcaggtttgagcccagggtatatgaggccagagacagctcagggtatatttgtgaacttcaaagacttgtattactataatggcaacaagctgccattcgctgcagcccaaattggtcaggccttcaggaatgagatatctccccgtcaaggccttctgagagtccgtgagtttactttagcggaaattgagcactttgtggacccagaggacaaatcccatccaaagtttggtgatgtttctgatctagagttcttgatgtttccaagagaggatcaaatggccggaaggtcagccacaaaacttaaactcagaaatgctgtatctgagggaactgtgaacaatgagacccttggctacttcattggaagggtctaccttttcttgacacaacttgggattgacaaagatcgtctccgtttccgtcaacatctgccaaatgaaatggctcattatgctgctgattgttgggatgcagagattgaatgctcatatggttggattgagtgtgttggaattgctgataggtctgcctatgacttacgtgcccactcggataaaagtggcgagaaactggaagcacatgagaagtttgcagaacccagagaagtggagaaattagttataacgccatcaaagaaggaacttggtcttgcattcaaagggaaccagaagatggttcttgaatcattggaagccatgactgagaccgaagcattggatatgaaagctgtgttggaatccaagggggaggttgagttcaaggtgtgtacccttgggaaggatgttaccataaagaaaaacatggtttcaattaacatcgagaagaaaaaggaacaccaaagaaaatttactccttccgtcatagaaccatcctttgggattgggcgcattatatactgccttttcgagcactgcttctaccaaaggcctggaaagacagaggatgagcagttaaacgtattccgttttccccctcttgttgctccaataaagtgcactgtctttccattggtcaagtttgagaaatttgaggttgttgccaagaaaatttcaaaggccttgacagcagcagggatttcacatattattgacatgacaggcaatacaataggaaaacgctatgcaaggacggacgagattggtgtccccctggcgatcactgtcgataacactacaagcgtgacggtgcgcgatcgtgacagcaaggaccagatccgcgtggaggtggacgaggtggcctcggtggtgaaggaagtgacggacggacagagcacctgggcagacatcatgtggaggtacccagcgcatacggcctcggccgccgacgaggaagagtcacagccctgaagaggcacagccacagcaccacccaacgatcgttgctccctgatggcctgatacagttccttgcttataacagttaacagaaacagaatgcgttgttttgtaagtctacagtagtcagatagtagcttctttgttatgttggtctcgtaaattctgctacttcataccatctttttttttctcacccttgaatggactgtgatgtttgcctcgtggtcagaaggaaccagaaattcaccactgtaactttgtttgctagcttgaaatttgcacggtcctggattcctgg

SEQ ID NO: 3900 - DNA, 2573 bp, Panicum virgatum
ccttgctaccttgtctcgaaaatatcttccaccccgtgggcccggacccatcagcatcattcttcctcaccgacttgtgggccccacacgtcagccccactcacccgcgccccccatctgatgctcctgctccgccgccgcgtccgcttcctcctcccgtcgtcgctctcgtcccctcgcgcgccgctcgcaaaacctctcccgctccccctccgccacccgcccagaatactagcctcggcggcgcgcccgctcgcgtccatggccgcgccggcggcgatgagccgggacgcgttccgcgcggcggtgaccaacacgctggagcggcgcctcttcttcgtgtcctccttcaagatctacagcggcgtcgcggggctctacgactacggcccccccgggtgcgccgtcaaggccaacgtcctcgccttctggcgccagcattttgtgttagaggaagggatgcttgaggttgactgtccatgtgtgacaccagaagttgtcttgaaagcctctggtcatgtggataaatttacagacttaatggttaaagatgaaaagacaggcaactgctaccgtgcagatcatttgctcaaggatttttgtaaggataagcttgagaaggaccagacgttgtcacctgagcaggcagaagaatacaataaaattcttgctatcttggatgatctctctgcagagcaattgggtgctaagattaaggagtatgggattgttgctcctgacaccaagaacccattgtcagatccctaccccttcaatctcatgtttcagacttccattgggccgtcaggtttgagtccagggtatatgaggccagagacagcacagggtatctttgtgaactttaaagacttgtactactacaatggcaacaagctacctttcgctgcagctcaaattggccaggccttcaggaatgagatatctccccgccaaggccttctgagagtccgtgagtttacattagcggaaattgagcactttgtggacccagaggacaaatcccaccccaaatttggtgatgtctctgacctagaattttttatgtttccaagagaggatcaaatggcaggaaagtcagccacaagacttaaacttggaaatgctgtatccgagggaactgtgaacaatgagacccttggctactttattggaagggtctaccttttcttgacacaacttgggattgataaagatcgtctacgcttccggcagcatctgccaaatgaaatggctcactatgctgctgattgttgggatgcagagattgaatgctcttatggatggattgagtgtgttggaattgctgataggtctgcctatgacttgcgtgcacactcggataaaagtggtgagaaacttgaagcacatgaaaagtttgcagaacccagagaagtggagaaattagttataaccccatcaaagaaggagcttggtcttgcattcaaagggaaccaaaggatggttcttgaagcattggaagcaatgggtgagactgaagctttggagatgaaagctgcgttggagtccaagggggaggttgagtttaaggtgtgcacccttgggaaggatgttacgataaagaaaaacatggtttcaattaatattgagaagaaaaaagaacaccaaaggaaatttactccttccgtcattgaaccatcatttgggattgggcgcattatatactgcctttttgagcactgtttctaccaaaggcctggcaaggcagaggatgagcagttaaatgtgtttggtttcacccctcttgttgccccaataaagtgcactgtctttccactggtcaagcttgagaaatttgaggttgttgcaaagaaaatttcaaaggccttgacagcagcagggatttcacatattattgacatgacaggtaacacaataggaaaacgctacgcaaggacggacgagctgggcgtgcccctggcgatcacggttgacaacaccacaagcgtgacggtgcgtgaccgggacagcaaggaccagatccgtgtggaggtggatgaggtggcctcggtggtgaaggaggtgacggccgggcagagcacctggggcgacatcatgtggaggtacccggcgcacaccgcctccgccgccgaggatgaggaggccgaaccctgaagagcacaaccaaaacaatatccaacgatcgtaggcccccgcataacatttcctgcttaacagaaacagaatgcgttgtcattgtcaattgtgatgttcgacctgtaaatttcatcagatagtttccttgtgagttgtgatgttcgacctgtagatttcatcatttccaccttaggaactgcagtatttgatgaatcctttctcagattgcgatttgcacattatcctttttttgaaaagaaaaatagcacaattcgtgactccatgttaatgctcatttgctcctcagagagcattatagatctcatcagccactaggtgtggaattcaggggcccacctgtcattggtgcagctcaataagctggctagctgaaatgttcaggcccaataaagtatatctaggcccacgtaacacaa

SEQ ID NO: 3901 - DNA, 2659 bp, Triticum aestivum
cagatgagcgagtacatcaagaggctgagggcctgcatccggtggctggtggagctggaagacggctacttggccgagcaggagaagcttcgggggcagatagattcagacaatgctcgtcatgcagagtttgaggctcagctcagtggtgcgctggaagagttgaaagctgcaaacttggaaatgactacacggtgtgactcactggaggagagcttgaacaaggagaaggccgacaggctgcttgctgtggagtcctatgagaaggaaagagaagaaagggaatcggccgaggcttcacgggatgtactgacggtcgatcttgaaagggtcactcatgaggccaaacggttcagtgagcagctaaaaatggtccaagacaccaacaaaagacttcaggaatacaactccagcttgcagcaatacaacagtaatcttcaagctgatacatcgaagaacggagaaatcatttcgaagctgcaaagggagaagagtgcaatgatggaagccatgactaatctgaaagatcttaacaactcaatgaagaaccagttggattcttccatgtcctcccagaaagaagcaattagagtgaaagaagaacttagaaaagaagtagaatgcctcagagctgatttacaacaagttagagaagaccgtgatcagtctgttgctcaactgaataccttgaccgcggaactggccacttacagcgaacaggctagaaagtcttcgaaagactctgaacttttgagaataaaggcggcagcctttgaggaaacatgcagttcacagcaagagcaaattgaaacattgcagaagcagcttgcagttgcaactgagaagctgaagcatgctgatgtgactgcaattgaggcgatgacaggatatgaatcacagaaagagacaatcaaagatctggaagagcgtttggcatatgcagagtttcaaatcattgaagctgacaagctacgaaagaagctgcacaataccatcttggaactaaaaggcaatatcagagtattttgtagggttcgaccttttctgtcggacaccgattctaatggtcaggaagaagccattatttcttatccatcatccgtggaaaatgctgggcgtggtattgatttaatgaatcaaggtcagaaatgttctttttcatatgacaaggttttcgatcacagcgcttcgcaagatgatgtgtttgtggaaatgtcacagctagtccaaagtgcgcttgatggatacaaggtatgcatatttgcatatggtcaaacagggtcaggtaaaacttatacaatgatgggtaagccaggccgtgatcagaaaggtatcatacctcgatctttggagcaaattttcaagaccagtcagtctctagaatctcaaggatggaagtattgtatgcaggcgtcaatgttggaaatatacaatgagacaattcgtgacttgttagcaccaggacgctccagtagtgagatgcctggcggtaaacaatacacaataaagcatgattcccagggaaacacaacagtctccgatcttacaactactaatgtgttcagcactgctgatgtgacgtctcttctagagaaagcatctcatagcaggtctgtaggtaagacccaaatgaatgagcaatcttccaggagccattttgtcttcacactaaagatatttggatcaaatgagagcacaggccaacaagtgcaaggtgtgctgaacttgattgatttggctgggagtgaacggcttactaaaagtggcgcaacaggtgaacgcttgaaggaaactcaggccatcaacaagagcctgtcagctctcagcgatgttatctttgcgattgcgaaaaacgatgaccatgtgccctttaggaactcgaagctcacgtacctcttgcagccttgccttggtggggactcgaagacgctcatgttcgtcaacgtttcgcccgaggcgtcctcagccggggagactctctgctccctgaggttcgcgtcgagggtgaacgcgtgcgagatcggggtggcgagacggcagacacagtccaagtcctcctcggataacagtaacaggctgagctacgggtgaactctgtcatgcctgttaacggccatcgtggcctgatgttgatgtgatactgctgcataacgagctgctaggctagcagctccgtgggccaacttggccacgagcgtgctggcgacgcggcgcggctggcctctggtattagcaacatgtacagtcagtagggagagtggcagagcatgcgctgtggtattgagagcaggagagaacctctgcttccagccatgatgattcgtcttctgtttgtagtagctgattgatttgagatttattgagtaatgttaactggcgctatattctttctgtgtgacttcaagaatgaatccatgtgctgataatatgattgtgcgtccatcagtgtgtctgcgactctgttttataaggggcggaaccaggatttggccttagtgggaggaactctgttttaggtttctttgagacctctcttcttttttatgaagaacaacatatatatgggagttcctggatgcattgttccagagtgactggtgagtccatgtttgtgtcaatgagtacatgtttaaaccttatacaagaaaagtaatagtaa

SEQ ID NO: 3902 - DNA, 3418 bp, Brachypodium distachyon
tagctccgccgcctcgtccctttctgcctccccccttccttctccgagcttatcgggcttctcgctcagatccgagcacacggccgcgagaaatcgaagtaatccctggcgtgtgggattgctccgagcgagctcgccgtttagcctcgatccagattgcgcggttttgtcggcggcgcttccaagccacgccgtcccacgagagattgattcttctgccttcgagttcactccaccccgtcccaagaaagctcccctttccccctcaccaccaaccaccaccaccaccaccgctgaggagagatcgaccgaacactgactgactgactgactgactgactattagccccctaatcccccactagtaataatccccccaccctccgcccatggcgtcttccctcacgccgcgcagcccttacccgaaggagaacttggggaacgtgcggcgggggatggggttcaaggtggcgccgcgccgcaacgtgctgtcggcaatcaacaacgacggggtgaacggcgagccggcaatggcgccgtcggaaggtggcagcgtcggggaggtgccgaccgcgcctgcggttgagttcagcggcagggaggatgtggagcggcttcttaatgaaaagatgaaggggaagtccaagaacgactacaaggggagaacggagcagatgagtgagtacatcaagaggctgagagcctgcatccggtggtacgtggagctggaggacggctacttggccgagcaggagaagctaagggggtcgattgatgcagagaatacaaggcatgcagagttcgaaatgcagctcagttctgcgattgaagagctgaatgctacaaactcagacatgataagacggtgtgcctcgctggaggagagcttggacaaagagatggccgacaagttgattgctgtagagtcttatgagaaggaaagacatgaaagggaatcagctgaggcttcacgggatgtactgacggttgacctcgaaagagtcactcatgaggctaaacggtttagtgagcagttaaaaatggtccaagacacgaacaaaaggcttctagaatacaacactagcttgcagcaatacaacagcaatcttcaagctgataccacaaagaatggcgagattatttcaaaactgcaaaaagagaagagtgcaatgatggaagccatgactaatctaaaagaaactaacaactcaatgaagaaccagttggattcttcaatgacttctcagaaagaagcaattagagtgaaagaggatcttagaaaagaagttgagtgtctcaggactgagttgcagcaagttagagatgaccgtgatcaatcagttgctcaactaaatagcttgagtgcagaacttgctatttacagcgaacaggctggaaagtcttcaaaagaatgtgaagttttgcgcgttaaagtgctagcctttgaggaaacatgcaattcacagcaagaacagattcagacattgcagaagcagcttgcagttgcaactgagaagctgaagcatgctgatgtgactgcaattgaggcgatgacaggatatgaagcacagaaggagaaaataaaagatcttgaagagcgtttggcgtatgcagagttcaaaattattgaagccgacaagctacgaaagaaacttcacaataccattctggaactaaaagggaatatcagagtattttgtagggttcggccacttctgtctgatggtgattctaatagtcaggacgaagccatgatttcgtatccaacatcagtggaaaatgctggacgtggtattgatttaatgaaccaaggtcagaaagtttctttctcatatgacaaggttttcaatcatggtgcttcgcaagaagacgtgtttgtggaaatgtcacagctagttcaaagtgcacttgatggatataaggtatgcatatttgcatatgggcaaactgggtctggtaaaacttatacaatgatgggtaaaccaggccgtgatcagaaaggcattatacctcgttctttggagcaaattttcaagactagccaatctctagaatctcaaggatggaaatattgtatgcaggcatcaatgttagaaatatataatgagacaatccgtgacttgttagcaccaggccgctccaacaatgtggagatgtctgcaagcaaacaatatacaataaagcacgatgcacatggaaacacaacagtctccgaacttacaattgctgatgttttcagtactgctgatgtgacgtctcttctagagaaagcatcccatagcaggtctgtcggtaagacccaaatgaatgagcaatcttctcggagccattttgtgttcactctaaagatatttggatcaaatgagagtaccggccaacaagtacaaggtgtccttaacttgattgatttagctgggagtgagcgtcttgctaaaagtggttcaacgggtgatcgcttgaaagaaactcaggcaatcaataaaagcctgtcagcccttagcgatgtcatctttgcaatcgcgaaaaacgatgaccatgtgcccttcaggaactcgaaacttacatacctcttgcagccttgcctcggcggagactcgaagacgctcatgttcgtcaacatctcgccagaggcatcgtcagtgggggagacgatctgttctctgcggtttgcctcgagggtgaacgcctgcgagatcggggtaccaagacggcacacacaggcccgatcctttgattccaggctgagctacgggtgaaagttccattccacaaatggcccttgccataacgtgtgatgataacataaatgagttagctttcattggctcacttggccacacaaagctgacgacgattgcgcggctggtgcctcttcttagcaacatgtacagtaagtagggagagatcggagagagatatgcatatgcaagcgccggggatgttggctgtgagcaggagaatagagaggcagagagatataaagcctggatatggatgattcctgccccggttgtttgaatcattttttttgttgtagctgattggagtaataatgtttaactgtattcttctcggagaaaaggaagaagcagaaccaaacgagtgtatcttcttcagctgctgctgctgatattacatcatatgctcatacggtgcagtgcacgtaatctggtggtgccatctggtcttgcacctgattgtgcaattgtcgaatcattgttatccgattcatcagaggaagccagaacgacattttcaggccagcacacgttgctgatctccagaagatatatagagtttcgcaagtgtcccgtgacgtggatccgtgaagcgctccgtcctcttctgctatttgaccagctcaagctttcgagcatgatacgctactagctttaaagcgagttctcatctgataagc

SEQ ID NO: 3903 - DNA, 2432 bp, Triticum aestivum
gggggcagatagattcagacaatgctcgtcacgcagagtttgaggctcagctcagtggtgcgcttgaagagttgaaagcggcaaacttggaaatgacaacacggtgtgactcactggaggagagcttgaacaaggagaaggccgccaggctgcttgctgtggagtcctatgagaaggaaagagaagaaagggaatcagccgaggcttcacgggatgtactgacggtcgatcttgaaagggtcactcatgaggctaaacggtttagtgagcagctaaaaatggtccaagacaccaacaaaagacttcaggaatacaactccagcttgcagcaatacaacagtaatcttcaagctgatacatcaaagaatggagaaatcatctcgaagctgcaaagggagaagagtgcaatgatggaagccatgactaatctgaaagatcttaacaactcaatgaagaaccagttggattcttccatgtcctcccagaaagaagcaattagagtgaaagaagaacttagaaaagaagtagagtgcctcagagctgatttacagcaagttagagaagaccgtgatcagtctgttgctcaactgaataccttgaccgctgaactggccacttacagcgaacaggctagaaagtcttcgaaagactctgaacttttgagaataaaagcggcagcctttgaggaaacgtgcagttcacagcaagaacaaattgaaacattgcagaagcagcttgcagttgcaacagagaagctgaagcatgctgatgtgactgcaattgaggcgatgacaggatatgaaacacagaaagagacaattaaagatctggaagagcgcttggcatatgcagagtttcaaatcattgaagctgataagctacgaaagaagctgcataacaccatcttggaactaaaaggcaatatcagagtattttgtagggttcggccctttctgtcggactctgattctaatggtcaggaagaagccattatttcttatccatcatccgtggaaaatgctgggcgtggtattgatttgttgaatcaaggtcagaaatgttctttttcatatgacaaggttttcgatcacagcgcttcgcaagatgatgtgtttgtggaaatgtcacagctagttcaaagtgcgcttgatggatacaaggtatgcatatttgcatatggtcaaacaggctcaggtaaaacttatacaatgatgggtaagccaggccgtgatcagaaaggtatcatacctcgatctttggagcaaattttcaagaccagtcagtcgctagaatctcaaggatggaagtattgtatgcaggcatcaatgttggaaatatacaatgagacaattcgtgacttgttagcacctggccgctccagtagtgagatggctggcggtaaacaatacacaataaagcatgattcccagggaaacacaacagtctccgatcttacaactactaatgtgttcagcactgctgatgtgacatctcttctagagaaagcatcccatagcaggtctgtaggtaagacccaaatgaatgagcaatcttcccgcagccattttgtcttcacactgaagatatttggatcaaatgagagcacaggccaacaagtacaaggtgtgctgaacttgattgatttggccgggagtgagcggcttactaaaagtggcgcaacaggcgatcgcttgaaggaaactcaggccatcaacaagagcctgtcagctctcagcgatgttatctttgcgattgccaaaaatgatgaccatgtacccttcaggaactcgaagcttacatacctcttgcagccttgccttggcggggactcgaagacgctcatgttcgtcaacgtctcgcccgaggcgtcctcggccggggagactctctgttccctgcggttcgcgtcgagggtgaatgcgtgcgagattggggtggcgagacggcagacacagtccaagtcctcctcagataacagtaacaggttgagttacgggtgaactatgtcctgcctgtcaacggccatcgtgacctgatgatactgcctacataacgagctaagctagcagctctgtgggccgacttggccacgagcgtgctagcgacgcggcgcggctggcctctggtattagcaacatgtacagtcagtagggagagtggcagagcatgcgctgtgtggcattgagagcaggagagaacctctgcttcctgccacgatgattcgtcttctgtttgtagtagctgattgatttgagatttattgagtaatgttaactggcgctatattctttctgtgtgacttcaagaatgaatccatgtgctgataatatgattgtgcgtccatcagtgtgtctgtgactccggttttataaggggtggagccaggatttgaccgtcaggggaggaaactctgttttaggtttctttgagac

SEQ ID NO: 3904 - DNA, 3293 bp, Oryza sativa
ggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccaccgccaccactgaggaggagagaaccctaactataacccctaatcctgccactaatcccagttcatggcctcctccctcacgccccgtagcccttacccgaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttggaggcccagcttagcagtgatctggaagagctgaaagctgcacacctgaacttgacgcggcagtgcgattcgttggaggaaagcttcaacaaggagaaggccgacaggatgcttgctgtggagtcctacgagaaggagaggcagcaaagggaatcggctgaggcgtccctcgacttgctgtcggtggacctggaaagagtcagccatgaagcaaaacggtttagtgagcaactgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctaggacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggaaacatgtagtatgcaacaagaacagattcaaactttgcagaaacaacttgcagttgcaacaaataaactgaagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtcagagattttccttctcatatgacaaagttttcgatcacggtgcttcacaagaagatgtgtttgtggaaatgtcacaactagttcaaagtgcacttgatgggtacaaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtctgtgggtaggacccaaatgaatgaacaatcttcccggagccattttgttttcacactgaagatatctggatcaaatgagaacactgggcaacaagtccaaggtgtccttaacttgattgatttagctggcagtgaacgccttgctaaaagtggctccacgggtgatcgtttgaaggaaactcaggcaatcaataaaagcttgtcagctcttagcgatgttatctttgcaattgcgaaaggagacgatcatgtgcccttcaggaactcaaaacttacataccttttgcagccttgccttggaggtgattccaaaacgctgatgtttgtcaacatttctccggaggcatcatccgttggggagacgatttgttcactgaggttcgcttcaagggtaaatgcttgcgagatcggaataccaagacggcacacacaagcccggtccttcgattccaggctgagctatggctgaagttgctgtggccatcatgatgtgatgataatcgatcagcattggggatatcatttggctgaagctgatgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaa

SEQ ID NO: 3905 - DNA, 1063 bp, Triticum aestivum
gcctcgtgaatctttcatccgcctgacatcatcagccctccggatcagaacaggatcctttgtggctctcttctcgctgccacaatcacacggccacacagcgcgcgcagacaaaaaccagagaggggaatctcaatctggttctcgaacctaccgctaataatcatcctcctccaccattttttccgtagaaaaagaaagaaccccctggaagcactcagaacgcaagccaatcaaacgagctgctgggttggttttctccattcattccgctcaacatggctcttcaggtgtggatggttggggagaacggcgaggacctcaagaaccacagggagctcctgcctctctccaagctccaagagattggtgtgttatattggcatttggacccaaagaagtctgaaagcgaagaagagctagcgaagatccgcaaggacagaggatacaactacatggattatctcgatatatgccctggaaagttggcaaactttgaggagaagctcaagaacttcttcacagagcacatgcatgccgacgaagagatccgctactgcttggaaggcggcgggtactttgatgtgcgcgacaaggatgacaagtgggttcggatctggataaaagaaggggatatgatcgtgctgccggctggaatttatcatcggttcaccctcgacgccgccaaccatgtgaagctcatgaggctcttcctgggagaaccagtgtggaccgcgcacaaccggcctcaggaggaccatccggtgcggcaagagtatgtcaagaggctcacggacgacaatgctggtcttgctctggcagcacactgaagtttgtttgtgattcctcagctatgtattataaacacccatggacatatacatacacttggatgaaactgtgctgtaatcttgaaaccagatagatatgctacctacgtacctgttaatattcactaggtaattgcctgtgctatactgccatatcaaattattgactgtttaaacccagttttgattttaatcctctgtattcagattctaattagtagttcattaaccgg

SEQ ID NO: 3906 - DNA, 821 bp, Pseudoroegneria spicata
  misc_feature (6)..(6): n is a, c, g, or t
  misc_feature (222)..(222): n is a, c, g, or t
  misc_feature (285)..(285): n is a, c, g, or t
  misc_feature (334)..(334): n is a, c, g, or t
  misc_feature (691)..(691): n is a, c, g, or t
cctccnttcattccgctcaacatggctcttcaggtgtggatggttggggagaacggcgaggacctcaacaaccacagggagctcctgcctctctgcaagctccaagagattggtgtgttatattggcatttggacccaaagaagtctgaaagtgaagaagagctagcgaaaatccgcaaagacaggggatacagctacatggattatctcgatatatgcccnggaaagttagcaaactttgaggagaagctgaagaacttcttcacagagcacatgcatgccgangaagagatccgctactgcttggaaggcggcgggtactttgatgttcgcnacaaggatgacaagtgggttcggatctggataaaagaaggggatatgatcgtgctgccggctggaatttatcatcggttcaccctcgacgccgccaaccatgtgaagctcatgaggctcttcctcggagaaccagtgtggacggcgcacaaccggccccaggaggaccatccggtgcggcaagagtatgtcaagaggctcacggacgacagtgctggtcttgctctggcagcacactgaagtttgtttgtgattcctcggctatgtatgtattataaccacccatggacatatacatacatttggacgaaaccatgttgtaatcttgaaaccagatagacatatatgctacgtactngttattattgactaagtaattccccgtgcgttgcaacaggagcataaatattcagtggttcaacactcatcgtgtcaaacatatatttttataattctggtggacattttcttcttctgcaaaaaaaaaa

SEQ ID NO: 3907 - DNA, 844 bp, Secale cereale
gtagaaaaagaacacagaacgcaagccaatcaaacaagctgctgggttggtttcctccattcattccgcctcaacatggctcttcaggtgtggatggttggggaggacggcgaggacctcaacaaccacagggagctcctgcctctctccaagctccaagagattggtgtgttatattggcatttggacccaaagaagcctgaaagcgaagaagagttagcgaagatccgcaaagacagaggatacaactacatggattatctcgatatatgccccggaaagttggcaaacttcgaggagaagctgaagaacttcttcacagagcacatgcatgccgacgaagagatccgctactgcttggaaggcggcgggtactttgatgtgcgcgacaaggatgacaagtgggttcggatctggataaaagaaggggatatgattgtgctgcctgctggaatttatcatcggttcacccttgatgccgccaaccatgtgaagctcatgaggctcttcctcggagaaccagtctggactgcgcacaaccggcctcaggaggaccatccggtgcggcaagagtatgtcaagaggctcactgacgacaatgctggtcttgctctggcagcacactgaagtttgtttgtgattcctcagctatgtattataaacacccatggacatatagaattatactagatacacttggatgaaactgtgttgtaatcttgaaaccagatagatatgctacctacgtacgagtacttgttaatattcactaggtgcctgtgctatactgccatatcaaattctcaaactgtttaaacccagttttgattttaatcgttacgca

SEQ ID NO: 3908 - DNA, 900 bp, Secale cereale
acggccacacagcgcacacagacaaaaaccagagaggggaatctgggctctcgaacctaccgctgcgctaatcatcctcctccacgaccacgatttctctgtagaaaaagaaagaaccccttggaagcactcagaacgcaaagccaatcaaacaagctgctgggctggtttcctccattcattccgcctcaacatggctcttcaggtgtggatggttggggaggacggcgaggacctcaacaaccacagggagctcctgcctctctccaagctccaagagattggtgtgttatattggcatttggacccaaagaagcctgaaagcgaagaagagttagcgaagatccgcaaagacagaggatacaactacatggattatctcgatatatgccctggaaagttggcaaactttgaggagaagctgaagaacttcttcacagagcacatgcatgccgacgaagagatccgctactgcttggaaggcggcgggtactttgatgtgcgcgataaggatgacaaatgggttcggatctggatcaaagaaggggatatgattgtgctgcctgctggaatttatcatcggttcaccctcgacgccgccaaccatgtgaagctcatgaggctcttcctcggagaaccggtctggactgcgcacaaccggccgcaggaggaccatccggtgcggcaagagtatgtcaagaggctcatcgacgacaatgctggtcttgctctggcagcacactgaagtttgtttgtgattcctcagctatgtattataaacacccatggacatatagaattatactagatacacttggatgaaactgtgttgtaatcttgaaaccagatagatatgctacctacgtacttgttaatacttaatattcactaggtgcctgt

SEQ ID NO: 3909 - DNA, 862 bp, Secale cereale
cctcctccacgatttctctgtagaaaaagaacacagaacgcaagccaatcaaacaagctgctgggttggtttcctccattcattccgcctcaacatggctcttcaggtgtggatggttggggaggacggcgaggacctcaacaaccacagggagctcctgcctctctccaagctccaagagattggtgtgttatattggcatttggacccaaagaagcctgaaagcgaagaagagttagcgaagatccgcaaagacagaggatacaactacatggattatctcgatatatgccccggaaagttggcaaacttcgaggagaagctgaagaacttcttcacagagcacatgcatgccgacgaagagatccgctactgcttggaaggcggcgggtactttgatgtgcgcgacaaggatgacaagtgggttcggatctggataaaagaaggggatatgattgtgctgcctgctggaatttatcatcggttcacccttgacgccgccaaccatgtgaagctcatgaggctcttcctcggagaaccagtgtggacggcgcacaacaggcctcaggaggaccatccggtgcggcaagagtatgtcaagaggctcatcgacgacaatgctggtcttgctctggcagcacactgaagtttgtttgtgattcctcagctatgtattataaacacccatggacatatagaattatactagatacacttggatctttgtcaaaaaaaaaagatacacttggatgaaactgtgttgtaatcttgaaaccagatagatatgctacccctacgtacgagtacttgttaatattcactaggtgtctgtgctatactgccatatcaaattctcaaagtc

SEQ ID NO: 3910 - DNA, 890 bp, Secale cereale
gtacagtcaggacccttgttggctcacctctccgctaccacaaacacaccacggccacacagcgcacacagacaaaaaccagagagggaagtctggcttctcgaacctacagctaatcatcctcctccacgatttctctgtagaaaaagaacacagaacgcaaagccaatcaaacaagctgctgggttggtttcctccattcattccgcctcaacatggctcttcaggtgtggatggttggggaggacggcgaggacctcaacaaccacagggagctcctgcctctctccaagctccaagagattggtgtgttatattggcatctggacccaaagaaggctgaaagcgaagaagagttagcgaagatccgcaaagacagaggatacaactacatggattatctcgatatatgccccggaaagttggcaaacttcgaggagaagctgaagaacttcttcacagagcacatgcatgccgacgaagagatccgctactgcttggaaggcggcgggtactttgatgtgcgcgacaaggatgacaagtgggttcggatctggataaaagaaggggatatgattgtgctgcctgctggaatttatcatcggttcacccttgacgccgccaaccatgtgaagctcatgaggctcttcctcggagaaccagtctggactgcgcacaaccggcctcaggaggaccatccggtgcggcaagagtatgtcaagaggctcatcgacgacaatgctggtcttgctctggcagcacactgaagtttgtttgtgattcctcagctatgtattataaacacccatggacatatacacacacttggatgaaaccatgttgtaatcttgaaaccagatatatatgctactaccttgttaatattcact

SEQ ID NO: 3911 - DNA, 780 bp, Secale cereale
gctgggttggtttcctccattcattccgcctcaacatggctcttcaggtgtggatggttggggaggacggcgaggacctcaacaaccacagggagctcctgcctctctccaagctccaagagattggtgtgttatattggcatctggacccaaagaagcctgaaagcgaggaagagctagcgaagatccgcaaagacagaggatacaactacatggattatctcgatatatgccccggaaagttggcaaacttcgaggagaagctgaagaacttcttcacagagcacatgcatgccgacgaagagatccgctactgcttggaaggcggcgggtactttgatgtgcgcgacaaggatgacaagtgggttcggatctggataaaagaaggggatatgattgtgctgcctgctggaatttatcatcggttcacccttgacgccgccaaccatgtgaagctcatgaggctcttcctcggagaaccagtctggactgcgcacaaccggccgcaggaggaccatccggtgcggcaagagtatgtcaagaggctcatcgacgacaatgctggtcttgctctggcagcacactgaagtttgtttgtgattcctcagctatgtattataaacacccatggacatatagaattatactagatacacttggatgaaactgtgttgtaatcttgaaaccagatagatatgctacctacgtacttgttaatacttaatattcactaggtgcctgtgctatactgccatatcaaattctcaactgtttaaaccc

SEQ ID NO: 3912 - DNA, 1046 bp, Triticum aestivum
tcaaagtcgatagcctcacgcctgacatcatcagctctccagatcagatcaggatcctctgtggctctctcttctcgctaccacaatccacacaatgcacgcagacaaaaaccagagaggggaatctcgaacctaccgctaataatcatcctgcttcaccatttttccgtagaaaagaaagaaccccctggaactggaagcactcagagcacaagccaatcaaacgagctgctgggttggtttcctccattcgttccgttcaacatggctcttcaggtatggatggttggggaggacggcgaggacctcgacaaccacaaggagctcctgcctctctccaagctccaagagattggtgtgttatactggcatttggacccaaagaagtctgaaagtgaggaagagctagcgaagatccgcaaagacagaggatacaactacatggattatctcgatatatgtcctggaaagttagcgaactttgaggagaagctgaagaacttcttcacagagcacatgcatgccgacgaagagatccgctactgcttggaaggcggtgggtactttgatgtgcgcgacaaggatgacaaatgggttcggatctggataaaagaaggggatatgattgtgctgccggctggaatttatcatcggttcaccctcgacgccgccaaccatgtgaagctcatgaggctcttcctgggagagccagtctggaccgcgcacaaccggcctcaggaggaccatccggtgcggcaagagtatgtgaagaggctcacagacgacaatgctggtcttgctctggcagcacactgaagtttgtttgtgattcctcggctatgtatgtattataaccacccatggacatatacatacacttggatgaaaccatgttgtaatcttgaaaccaacatacatgctacatacttgttattattgactaggtaattccccatgcgttgcaacaggagcataaatattcagtggttcaacacttatcgtgtcaaacatatatgtttataattctcgtggcattttcttcttct

SEQ ID NO: 3913 - DNA, 847 bp, Secale cereale
cagaacgcaagccaatcaaacaagctgctgggctggtttcctccattcattccgcctcaacatggctcttcaggtgtggatggttggggaggacggcgaggacctcaacaaccacagggagctcctgcctctctccaagctccaagagattggtgtgttatattggcatttggacccaaagaagcctgaaagcgaagaagagttagcgaagatccgcaaagacagaggatacaactacatggattatctcgatatatgccctggaaagttggcaaactttgaggagaagctgaagaatttcttcacggagcacatgcatgctgacgaagagatccgctactgcttggaaggcggcgggtactttgatgtgcgcgacaaggatgacaaatgggttcggatctggataaaagaaggggatatggtcgtgctgcctgctggaatttatcatcggttcaccctcgacgccgccaaccatgtgaagctcatgaggctcttcctcggagaaccagtctggactgcgcacaaccggcctcaggaggaccatccggtgcggcaagagtatgtcaagaggctcatcgacgacaatgctggtcttgctctggcagcacactgaagtttgtttgtgattcctcggctatgtacgtatgtattataaccacccatggacatatacatacacctggatgaaaccatgttgtaatcttgaaaccaacatatatgctacgtacttgttattattgactaggtaattccccatgcgttgcaacaggagcataaatattcagtggttcaacacttatcgtgtcaaacatattattttataattttcatgtctattttcttctta

SEQ ID NO: 3914 - DNA, 908 bp, Secale cereale
cacggccacacagcgcacacagacaaaaaccagagaggggaatctggcttctcgaacctacagctaatcatcctcctccacgatttctctgtagaaaaagaacacagaacgcaagccaatcaaacaagctgctgggttggtttcctccattcattccgcctcaacatggctcttcaggtgtggatggttggggaggacggcgaggacctcaacaaccacagggagctcctgcctctctccaagctccaagagattggtgtgttatattggcatttggacccaaagaagcctgaaagcgaagaagagttagcgaagatccgcaaagacagaggatacaactacatggattatctcgatatatgccccggaaagttggcaaacttcgaggagaagctgaagaacttcttcacagagcacatgcatgccgacgaagagatccgctactgcttggaaggcggcgggtactttgatgtgcgcgacaaggatgacaagtgggttcggatctggataaagagggatatgattgtgctgcctgctggaatttatcatcggttcacccttcgatgccgccaaccatgtgaagctcatgaggctcttcctcggagaaccagtctggactgcgcacaaccggcctcaggaggaccatccggtgcggcaagagtatgtcaagaggctcactgacgacaatgctggtcttgctctggcagcacactgaagtttgtttgtgattcctcagctatgtattataaacacccatggacatatagaattatactagatacacttggatgaaactgtgttgtaatcttgaaaccagatagatatgctacctacgtacgagtacttgttaatattcactaggtgcctgtgctatactgccatatcaaattctcaaactgtttaaaccc

SEQ ID NO: 3915 - DNA, 883 bp, Secale cereale
aaaagaaagaaccccttggaagcactcagaacgcaaagccaatcaaacaagctgctgggctggtttcctccattcattccgcctcaacatggctcttcaggtgtggatggttgggggaggacggcgaggacctcaacaaccacagggagctcctgcctctctccaagctccaagagattggtgtgttatattggcatttggacccaaagaagcctgaaagcgaagaagagttagcgaagatccgcaaagcagaggatacaactacatggattatctcgatatatgccctggaaagttggcaaactttgaggagaagctgaagaacttcttcacagagcacatgcatgccgacgaagagatccgctactgcttggaaggcggcgggtactttgatgtgcgcgataaggatgacaaatgggttcggatctggatcaaagaaggggatatgattgtgctgcctgctggaatttatcatcggttcaccctcgacgccgccaaccatgtgaagctcatgaggctcttcctcggagaaccggtctggactgcgcacaaccggccgcaggaggaccatccggtgcggcaagagtatgtcaagaggctcatcgacgacaatgctggtcttgctctggcagcacactgaagtttgtttgtgattcctcagctatgtattataaacacccatggacatatagaattatactagatacacttggatgaaactgtgttgtaatcttgaaaccagatagatatgctacctacgtacttgttaatacttaatattcactaggtgcctgtcagcctgtgctatactgccatactacaaattcctacaaacttgtttaaaaccccgtttttagatttttaactccttttgtattcagta

SEQ ID NO: 3916 - DNA, 1107 bp, Triticum aestivum
accacaatccacacaatgcacgcaaaacaaaaaccagagaggggaatctcgaacctaccgctaataatcatcctgcttcaccatttttccgtagaaaagaaagaaccccctggaactggaagcactcagagcacaagccaatcaaacgagctgctgggttggtttcctccattcgttccgttcaacatggctcttcaggtatggatggttggggaggacggcgaggacctcgacaaccacaaggagctcctgcctctctccaagctccaagagattggtgtgttatactggcatttggacccaaagaagtctgaaagtgaggaagagctagcgaagatccgcaaagacagaggatacaactacatggattatctcgatatatgtcctggaaagttagcgaactttgaggagaagctgaagaacttcttcacagagcacatgcatgccgacgaagagatccgctactgcttggaaggcggtgggtactttgatgtgcgcgacaaggatgacaagtgggttcggatctggataaaagaagggggcatgatcgtgctgccggctggaatttatcatcggttcaccctcgacgccgccaaccatgtgaagctcatgaggctcttcctgggagaaccagtgtggacggcgcacaaccggcctcaggaggaccatccggtgcggcaagagtatgtcaagaggctcatggacgacaatgccggtcttgctctggcagcacactgaagtttgtttgtgattcctcagctatgttttataaacacccatggacatatacatacacttggatgaaaccgtgttgtaatcttgaaaccagatagatatgctacctacgtacagtacttgttaatattcactaggtaattgcatgtgctatactgccatatcaaactctcaagtgcttaaacccagttttgattttaatcctttgtattcagattctaattagtagttgcattaaccggacagtaatttttcagtccacacatcaatctatgatcttaggaccaaagtagaaggttacccttgaagtgaagacagatcgaattcttggtcaaatcttcattctccactccttttcctttggctgaggaa

SEQ ID NO: 3917 - DNA, 1052 bp, Triticum aestivum
catggccacacagcgcgcgcagacaaaaaccagagggggagatccggcttctcgaccctaccgccgccaatcatcctcctccaccattttttccgtagaaaaagaaagaaccgccttggaagcactcagaacgcaaagccaatcaaaccagctgctgggttggtttcctccatccatcccgctcaacatggctcctcaggtgtggatggttggggaggacggcgaggacctcaagaaccacggggagctcctgcctctctccaagctccaagagattggtgtgttatactggcatttggacccaaagaagcctgaaagcgaagaagagctagcgaagatccgcaaagacagaggatacaactacatggactatcttgacatacgccctggaaagttggcaaactttgaggagaagctcaagaacttcttcacagagcacatgcatgccgacgaagagatccggtactgcttggaaggcggcgggtactttgatgtgcgcgacaaggatgacaagtgggttcggatctggataaaagaagggggcatgatcgtgctgccggctggaatttatcatcggttcaccctcgacgccgccaaccatgtgaagctcatgaggctcttcctgggagaaccagtgtggacggcgcacaaccggcctcaggaggaccatccggtgcggcaagagtatgtcaagaggctcatggacgacaatgccggtcttgctctggcagcacactgaagtttgtttgtgattcctcagctatgttttataaacacccatggacatatacatacacttggatgaaaccgtgttgtaatcttgaaaccagatagatatgctacctacgtacagtacttgttaatattcactaggtaattgcatgtgctatactgccatatcaaactctcaagtgcttaaacccagttttgattttaatcctttgtattcagattctaattagtagttgcattaaccggacagtaatttttcagtccacacatcaatctatgatcttaggaccaaagtagaaggttacccttgaagtgaagac

SEQ ID NO: 3918 - DNA, 567 bp, Leymus cinereus x Leymus triticoides
gcacgaggcttccattcattccgctcaacatggctcttcagatgtggatggttggggagaatggtgaggacctcaagaaccgcaaggagttcctgcctctctccaagctccaagagattggtgtgttatattggcatttggacccaaagaagtctgaaagcgaagaagagctaacgaagatccgcaaagacagaggatacagctacatggattttctcgaaatatgccctggaaagttggcaaactttgaggagaagctgaagaactttttcacagagcacatgcatgccgacgaagagatccgctactgcttggaaggcggcgggtactttgatgtgcgcgacaaggatgacaagtgggttcggatctggataaaagaaggggatatgatcgtgctgccggctggaatttatcatcggttcaccctagacgccgccaaccgtgtgaagctcatgaggctcttcctcggagaaccagtgtggaccgcgcacaaccggcctcaggaggaccatccggtgcggcaagagtatgtcaagaggctcacggacgacaatgctggtcttgctc

SEQ ID NO: 3919 - DNA, 1008 bp, Festuca arundinacea
  misc_feature (37)..(37): n is a, c, g, or t
  misc_feature (39)..(39): n is a, c, g, or t
  misc_feature (41)..(41): n is a, c, g, or t
  misc_feature (47)..(48): n is a, c, g, or t
  misc_feature (50)..(50): n is a, c, g, or t
  misc_feature (52)..(52): n is a, c, g, or t
ggcacgagggcctcctccacaagtttttataagtccngnangaggcnnancncaagccaatcaagctgttggatttcctagttctcaccccattaattctgctcaacatggctcttcaggtatggatggtgggggagaatggagaggacctcaagaaccctaaggagttcctccccgtctccaagctcgaagagattggtgtgttatactggcatttggatccaaagaagtcagaaagtgaagaagaactatcgaaaatccgcaaagacagaggatacagctacatggatcttcttgagatatgccctggcaagttggaaaactatgaggaaaagctgaagaacttcttcagagagcacatgcatgccgacgaagagatccgctactgcttggagggtggtgggtactttgatgtacgcaacaaggatgacaagtggattcggatttggataaaagaaggagatatgatcgtgctgcctgccggaatttatcatcggttcacccttgacactgcgaaccatgtaaagctcatgagactcttcatcggggagccagtctggaccgcgcacaaccggcctcaggaggaccatccggtccggcaagaatatgtcaagaacctcacggacaatgctggtcttcctctcgcagcacactgaagtttacgatccggggggtcgccactcggctatgtacaattactgtggacacatatacggtcacgcactttgacgaaataatgttgtattgccatgcatcatgatgccagatagataagtgctaccaattattaattatacatagacctatcacttgtggtacttgcagtgtggtgaagttacagtatagtcaaatggctgtttgctactgtattatatatcctgtcgagtggttgctatgttgcctgtaatagcagtggtttatctgtagtctgtgcatcaggattgatcctgtgaatgcatggtagtaatgaaaagtgcatgtgatcagcccatcggcagttttctgggt

SEQ ID NO: 3920 - DNA, 1256 bp, Brachypodium distachyon
cggagccgagtggagaatctagcgtcatgcatggcgtcagctccaaatcagagcttcaattgcttgtggctctctttccattaggaaactccaccacatacacacggcccacacgccgtgacaaaacgaaggaagaacaatctggattccagaagttccagacccacctcccggatttttatacagaacccctgaaagcctgcagagcacaagtcaagctctcggatttcctaattgctatcccattcatcgaattccgctcgacatggttctccaggtatggatggtgggggagaatggagaggacctcgagaacgccaaggagttcctgcccctctccaagctagaagagattggtgtgttatattggcatttggatccaaagaagtctgaagctgaagaagagctaatgaaaatccgcaaagacagaggatacagctacatggatcttctcgaaatatgccctgataagttggaaaactatgaggagaagctgaagaacttcttccgagagcacatgcacgcagacgaagagatccgctattgcttggaaggtggggggtactttgatgtccgtgacaaggatgacaaatggattcggatttggataaaagaaggagatatgatcatcttgcccgccggaatttatcatcgcttcacccttgacggtgctaaccgcgtgaagctcatgaggctcttcattggggaaccagtctggactgcgcacaaccggcctcaggaggaccatccagtgcgtcaagagtatgtcaagaatctgacggacaatactggtcttgctctcgcagcacactgaagtttgctatctgggggttcgccactcagctatatattataactagctcagacacattacactatacacatggatgaaatcatgcagtgttaccacaaatcatgaaaccatattgatatgctactgattattacttatacatagaattattgcctgtggtactatgtcatctgatgaagccacaatactccacaaggcttccagagttagccttggatatattttaggctgtgtgtgtgtcaaaaggaagcattctgctacagttccgggtgacgtggccctcgcgagcgtctgccccagtcgctacgccttaatggtttagatgttgggctgtgtacactcgtgatcagttgtttcttcgggtaaccgaggcacgagaccacgagaccgaatttttcaaattaatatcggtttttaataagtaatgacgaaattattgacc

SEQ ID NO: 3921 - DNA, 2147 bp, Triticum aestivum
gctgctctgcctctgctgcttgctgtagccatagctgcacggcggcaatggcgatctgaaggccctcctccgccggaagctcgacgagaatggagcggatcctcaagtccgccagggagtccggctccctcaacctctccaaccgctccctcagcgaggtgcctggggaggtgtacaacaacttggacacgggcagcctggatgacaaatggtgggagggagtcgaccttcagaagctcatactggctcataacaacctggaagtattgagagaagaccttaggaatctgtcttctcttgtcgtgttaaacataagccacaatcagatatcttcccttcctgcagctattggagaccttcctttgttgaaatcactggatgcctcattcaatcaaataaaacttatacccgaagaagttggcttggctactgctttagtcaaggttgacttctcaaataattgcctcactgagctgccagctagccttggcagatgcttgaacttgtcagaactcaaggcatcaaacaacaacatatccagattaccagatgaacttgctggttgctgcaagctgagtaaatttgatctggagggaaacaagcttgtgctacttccagaaaatatgttcacatcatggacactgctcacagagctgaatgctgcgaaaaatcaacttacggccattccggctagtatcggagcactttcaaaattagttcgaatggacctgcaccagaacaagataacttcgattccttcttccataaagggatgctcttctctagctgagttctacatgggaaataatttattgtcgacaataccagatgatattggcatgctatcaaaattaggaacacttgatcttcactccaatcagctgaaggagtatcctgtgggagcttgcaaactcaagctcagttttcttgatctgtcaaacaacgcattatccggcctgccacccgaactaggtacaatgacaaccctaagaaagcttctgcttagcggaaatcctatgagggcacttcgtagttctttggtttctggaccaacatcaacattgatgaagtatctgcgaagccgcctttcgtctgaggaggaagcatcagggtctagaaccaccccaacaaaagatgaccagatttctgcagcaagacgattatctgtatcttcaaaggagttgaatttgagtggtcttggtgtgcccaatgtaccccctgcagcttgggagacaagtgatgtggtgaaacttgatctttctaagaatttgatagaagatctgccaaatgagttgtccctgtgctcatcacttcaagctttgattctgtctaataacaagataaaaaagtggcctggcatggttgtttcctcccttcccagtctcactaccttgaagctggacaataatcctctagcagagatatcgtccactgatcttgtgtctctatcaaaacttgaagttctggatttaagtggcaatgcatcctcattcagtgaatcttctgtggtttcttcattaccacaactgcatgaactctatcttaggcgaatgaaacttcaggaatttcctattgggcttgtacaattaaaacatctacggattcttaacctcagtcaaaataatctctcaaccataccagagggtatcaaggattttagtgctctcatcgagctagatctttcagacaacaatataacaaggcttccagctgagctgggtctgcttgagcctagcctgcaagtgctcaaacttgatggaaatcccctcaggagcataaggcggactgttctggagcgaggaacgaaagctgttctcagctatctcaaagaaaagcttccgtccaactgaataataccatcatcaagtgcaaattctggctggacttattcccttggtttcccctgttgaataagtttcctgtggttatgtactgaattgaccgtgtggttgaagtgtactgaattgaccctgtgtgtgcgcgcgcgagaatggagatggtttgccacatgcatattccaatacttataaggtggacacaagattatgtgatttgtgttttataatttgatgatgttgcttggctgaaatccctagagatttttcttctgttgtgttaaaattatattgctttgctgttgatcattt

SEQ ID NO: 3922 - DNA, 2063 bp, Secale cereale
gccgtagcttcaatggcgatctgaaggccgtcctccgccgccgctcgccggaaggtcgacgggaatggagcggatcctcaagtccgccagggagtccggctccctcaacctctccaaccgctccctcagcgaggtgcccggggaggtgtacaacaacttggacacgggcagcttggacgacaaatggtgggagggagtggacctccagaagctcatactggcccataacaacctggaagtgttgagagaagaccttaggaatctgtcttctctcgtcgtgttaaacataagccacaatcagatatcttcccttcctgcagccattggagaccttccgttgttaaaatcattggatgtctcgttcaatcaaataaaacttgtacccgaagaagttggcttggctactgctttagtcaaggttgacttctcaaataattgcctcactgagctgccagctagccttggcagatgcttgaacttgtcagaactcaaggcatcaaacaacaacatatccagattaccagatgaactttctggctgctgcaagctaagtaaatttgatctggagggaaacaagcttgtgctacttccagaaaatatgttcacatcatggacactgctcacagagctgaatgctgcgaaaaatcaacttacgaccattccggctagtattggagcactttcaaaattagttcgaatggacctgcaccagaacaagataacttcgattccttcttccataaagggctgctcttctctagctgagttctacatgggaaataacttattgtcgacaataccagatgatattggcatgctatcaaaattaggaacacttgatcttcattccaatcagctgaaggagtatcctgtgggagcttgcaaactcaagctcagttttcttgatctgtcaaacaacgcattatccggcctgccacccgaactaggtacaatgacaaccctacgaaagcttctgcttagcggaaatcctatgagggcacttcgtagttctttggtttctggaccaacatcaacattgatgaagtatctgcgaagccgcctttcgtctgatgaggaagcatcagggtctagaaccatcccaagaaaagatgaccagatttctgcagcaagacgattatctgtatcttcaaaggagttgaatttgagtggtcttggtgtgcccaatgtaccccctgcagcttgggagacaagtgatgtggtgaaacttgatctttctaagaacttgatagaagatctgccaaatgagttatccttgtgctcatcacttcaagcattgattctgtctaataacaagataaaaaagtggcctggcatggttgtttcttcccttcccagtctcacttccttgaagctggacaataatcctctagcagagatatcgtccactgatcttgagtctctatcaaaacttgaagttctggacttaagtggcaatgcgtcctcattgagtgaaccttctgtggtttcttcattgccacaactgcaggaaatatatcttaggcgaatgaaacttcaggaatttcctattggtcttgtacaattaaaacatctacggattcttagcctcagtcaaaataatatctcaaccataccagagggtatcaaggattttaatgctctcattgagctagatctttcagacaacaatataacaaggcttccagctgagctgggtctgcttgagcctagcctgcaagtgctcaaacttgatggaaatcccctcaggagcataaggcggactgttctggagcgaggaacgaaagctgttctcagctatctcaaagaaaagcttccatccaactgaataataccatcatcaagtgcaaattctggccggagttattcccttggtttcccacctgctgtgttgaataagtttcctgtggttgtgtactgaattgaccatgtggttggaagtgtactgaatcgaccgtgtgtttgcgcgcgccagaacggagatggtttgccacatgcatattccaatatttataagctggacacaagattatgtgatttgtgttttataattcgatggtgtttgt

SEQ ID NO: 3923 - DNA, 2130 bp, Triticum aestivum
ctgctctgcctctgctgcttgctgtagccatagctgcacggcggcaatggcgatctgaaggcccgccttccgccggaagctcgacgagaatggagcggatcctcaagtccgccagggagtccggctccctcaacctctccaaccgctccctcagcgaggtgcccggggaggtgtacaacaacttggacacgggcagcctggatgacaaatggtgggagggagtcgacctccagaagctcatactggctcataacaacctggaagtattgagagaagaccttaggaatctgtcttctcttgtcgtgttaaacataagccacaatcagctatcctctgttcctgcagccattggagaccttcctttgttgaaatcactggatgcctcattcaatcaaataaaacttatacccgaagaagttggcttggctactgctttagtcaaggttgacttctcaaataattgcctcactgagctgccagctagccttggcagatgcttgaacttgtcagaactcaaggcatcaaacaacaacatatccagattaccagatgaacttgctggttgctgcaagctgagtaaatttgatctggagggaaacaagcttgtgctacttccagaaaatatgttcacatcatggacactgctcacagagctgaatgctgcgaaaaatcaacttacggccattccggctagtatcggagcactttcaaaattagttcgaatggacctgcaccagaacaagataacttcgattccttcttccataaagggatgctcttctctagctgagttctacatgggaaataatttattgtcgacaataccagatgatattggcatgctatcaaaattaggaacacttgatcttcactccaatcagctgaaggagtatcctgtgggagcttgcaaactcaagctcagttttcttgatctgtcaaacaacgcattatccggcctgccacccgaactaggtacaatgacaaccctaagaaagcttctgcttagcggaaatcctatgagggcacttcgtagttctttggtttctggaccaacatcaacattgatgaagtatctgcgaagccgcctttcgtctgaggaggaagcatcagggtctagagccaccccaacaaaagttgaccagatttctgcagcaagacgattatctgtatcttcaaaggagttgaatttgagtggtcttggtgtgcccaatgtaccccctgcagcttgggagacaagtgatgtggtgaaacttgatctttctaagaacttgatagaagatctgccaaatgagttgtccctgtgctcatcacttcaagctttgattctgtctaataacaagataaaaaagtggcctggcatggttgtttcctcccttcccagtctcacttccttgaagctggacaataatcctctagcagagatatcgcccactgatctcgagtctctatcaaaacttgaaattctggatttaagtggcaatgcctcctcattgagtgaaccttctgtggtttcttcattaccacaactgcaggaactatatcttaggcgaatgaaacttcaggaatttcctattgggcttgtacaattaaaacatctacggattcttaacctgagtcaaaataatctcacaaccataccagagggtattaaggattttagtgctctcatcgagctagatctttcagacaacaatataacaaggcttccagctgagctgggtctgcttgagcctagcctgcaagtgctcaaacttgatggaaatccactcaggagcataaggcggactgttctggagcgaggaacgaaagctgttctcagctatctcaaagaaaagcttccgtccaactgaataataccatcatccagtgcaaattctggctggacttattcgctcggttttactccctctgtgttgaataagtttcctgtggttgaagtgtactgaattgacgtgtgtgtttgaagtgtggactgaattggccgtttgtgtgcgcgcgcgcgcaagaacggagatggtttgccacatacatattccaatatttataaggtggactcaacattatgtgatttgtgttttataattcgttggtgtttgttggctgaaatctctagagatttttcttctgttg

SEQ ID NO: 3924 - DNA, 1921 bp, Secale cereale
gggaggtgtaacaacaacttaggacacgggcgagcgttggacgacaaagtggtgggagggaggtggacctccagaagctcatactggcccataacaacctggaagtgttgagagaagaccttaggaatctgtcttctctctcgtgttaaacataagccacaatcagatatcttcccttcctgcagccattggagaccttccgttgttaaaatcattggatgtctcattcaatcaaataaaacttgtacccgaagaagttggcttggctactgctttagtcaaggttgacttctcaaataattgcctcactgagctgccagctagccttggcagatgcttgaacttgtcagaactcaaggcatcaaacaacaacatatcgagattaccagatgaactttctggctgctgcaagctaagtaaatttgatctggagggaaacaagcttgtgctacttccagaaaatatgttcacatcatggacactgctcacagagctgaatgctgcgaaaaatcaacttacgaccattccggctagtattggagcacttcaaattagttcgaatggacctgcaccagaataagataacttcgattccttcttccataaaggctgctcttctctagctgagttctacatgggaactaatttattgtcgacaataccagatgatattggcatgctatcaaaattaggaacacttgatcttcactccaatcagctgaaggagtatcctgtgggagcttgcaaactcaagctcagttttcttgatctgtcaaacaacgcattatccggcctgccacccgaactaggtacaatgacaaccctaagaaagcttctgcttagcggaaatcctatgagggcacttcgtagttctttggtttctggaccaacatcaacattgatgaagtatctgcgaagccgcctttcgtctgatgaggaagcatcagggtctagaaccatcccaagaaaagatgaccagatttgtgcagcaagacgattatctgtatcttcaaaggagttgaatttgagtggtcttggtgtgcccaatgtaccccctgcagcttgggagacaagtgatgtggtgaaacttgatctttctaagaacttgatagaagatctgccaaatgagttatccttgtgctcatcacttcaagcattgattctgtctaataacaagataaaaagtggcctggcatggttgtttcttcccttcccagtctcatttccttgaagctggacaataatcctctagcagagatatcgtccactgatcttgagtctctaccaaaacttgaagttctggacttaagtggcaatgcgtcctcattgagtgaaccttctgtggtttcttcattgccacaactgcaggaatatatcttaggcaatgaaacttcaggaatttcctattggtcttgtacaattaaacatctacggattcttagcctcagtcaaaataatatctcaaccataccagagggtatcaaggattttaatgctctcattgagctagatctttcagacaacaatataacaaggcttccagctgagctgggtctgcttgagcctagcctgcaagtgctcaaacttgatggaaatcccctcaggagcataaggcggactgttctggagcgaggaacgaaagctgttctcagctatctcaaagaaaagcttccatccaactaatcatcaagtgcaaattctggccgtctggccggagttattcccttggtcccccctgccatgttgaataagtttcctgtggttgtgtactgaattaaccgtgtgtggttggaagtgtactgaatcgaccgtgtttgcgcgcgccagaaccgacatggtttgccacatgcatattccaatatttataagctggacacaagattatgtgatttgtgttttataattcgatggtgtttgttgg

SEQ ID NO: 3925 - DNA, 2415 bp, Brachypodium distachyon
gccacctatagctgtacccctctcctgctctctcagaaaaaaagaaaaactgtacctcgcgccgccactcatcccgctgccgagcgcccgagtcccctagctcgtcttcctcctcgctcgagcgcctccactgcaggttgatctccacttcgattctctcgctcccaaccgtttctcctcccatcaccccacgggcccacgaacggattccgccctttagatccccgtttcataatcttccccaattcgtaactgaggcaaaaatcaaggtagggcgggcgccctaccttgccctactgggtcctccgcccgtgaggttcgacgagcatggagcggatcctcaagtccgccagggagtccggctccctcaacctctccaaccgctccctcagggaggtgccgggggaggtgtacaacaacttggacacgggcagtcaggacgataaatggtgggagggagtggatcttcagaagctcatattggcacataacaacctggaagtgttaagagaagaccttagaaatttgtcttctcttgttgtgttaaatataagccacaatcagatatattcccttcctgcagccatcggagaccttcctttgctaaaatcgctggacatatcgttcaatcaaataaatactgtgcctgaagagattggcctggctgcagctttagtgaaggttgacttttcaaataactgccttactgagctgccagctagccttgccggatgcttgaacttgtcagaactcaaggcatcaaacaacaaaatatccagaataccggatgaacttgccggttgttcaaagttaagtaaattggatctggagggtaacaagctcgagatgctttcagaaaacatgttctcatcgtggacaatacttacagagctaaatgctgctaagaatatacttacaactattccggctagtattggagcactttcaaaattaattcgcctggacctgcatcagaacaaaataaccttgattccttcttccataaagggctgttcttctctagcagagttttatatgggaaataacttattgttgtcaataccagccgatattggcatgctatcaaaattaggaacacttgatcttcattctaatcagctaaaggagtatcctgtgggagcttgcaaactcaaactctctttccttgacctctcaaacaacacgttatctggtctgccacctgaactaggtacaatgacgaccttaagaaagcttctgctcagcggaaatcctatgaggacacttcgtagttctttggtatctggaccaacgtcaacattattgaagtatctgcgcagccgcctttcatctgacgaggaagcatcagggtctggaagaactccaacgaaagatgatcaagttgctgccgcaagacgtttgtctttatcttcaaaggaattgaacttgagtggtcttggtgtgaccagtgtaccccctgcagcatgggagacaagtgatgtggtgaaacttgatctttctaagaattcaatagaagatctgccaaatgagttgacattatgctcatcacttcaagctttagttttgtctaataacaagataaaaaagtggcctggcatggtagtttcctcccttcccagtctttcttccttaaagctggacaataatcctctggcagagatatcgtccactgatcttgaggtcctatcaaaacttgaagtattggatttaagtggcaatgcatcttcattaaccaaaccttctgcactttcatcattgccacagctgcaggaactctaccttagacgagtgaaactccatgaatttcctattggcttgttgggcttaaaactgctgcggattcttgacctgagtcagaattatcttacaactataccagagggtatcaaggaatttactgctctcattgagctgaatctgtcagacaataatataacagcactcccagccgaactgggcttgcttgagcctaacctgcaagtgcttaaacttgatggaaatccgctcaggagcataaggcggactgttctggatcgaggaacgaaagctgttcttcagtacctcaaagacaagcttccgtcccactgaattacttcatcaaaaacaaattctggctcgagttatgatccatgagttcattttctcttttggtttcgataattttcctgtgagttgtgcttgcctgcttggtcagtaagctatactgaatagtatcttgtgcgagaacggatggacattcaaaacggagatgacatagactccggaacgtagaccgtggttgttgtaatggatagtatgaatccaggaggcatgtttgtagttgattcgtggataaactttcattggacgtattatgttcctttttttgaacaaattcattatatgcatcaaggtttaaaatttcgctttggacaa

SEQ ID NO: 3926 - DNA, 2523 bp, Sorghum bicolor
ttttgagacttatcagttcaacttggtttttcgaaagtgttcatacagatagaagagtacgttcataaaggtaagtgtgcgatcgtgttcattaacattgtgtttataactagatctcgcaaaaaaaagtggcgttgggccgtgtgacaaggcccagcccaagacaaaactctgtttgtccctctctatctacctctcgtcttcttccttgcagtcggtccaggtcggcagctccagctccagctccacagtgcgggtgcggtgggcaggctggatcattaggaaacatctgtgaatggaatcaaataaaaaaaaaagaagggttaggaaacatggatctgaatcactgaggagaggagaggggggtcgttacgaggaccgggacttcaggagggagaggagagctgtcctgtcgctgctctctgcccgcatccatctccacctatctcccaagctcgatctcatcgcatcaatggccatctgaatcaaccaagccatctggaagctttcagtcccatggaacggatcctcaagtccgccagggagtcgggctccctcaacctctccaatcgctccctcagggagatacccaaagaggtgtacaacaacttggacacaggcagccaggacgaaaaatggtgggagggagtggacctccaaaagctcattctggctcacaataaccttgaggtgttaagagaagaccttagaaacttgtcttctcttgttgttttaaatataagccacaacaacatatcttcccttccagcagctattggagatctcccgttgctaaaatcactggacatatctttcaatcaaataaacactctgcctgaagagattggcctggctactgctttagtcaaggttgatttctcaaataatttccttactgagcttccacctagccttgccaaatgcccggacttgtccgaactcaaggcatcgaacaacaacatatccagaatacctgatgtacttgctggctgttccaagttaagtaaattggatctagagggtaacaagcttgtgatgctttctgaaaacatgtttgtgtcatggacaatgctcacagagttgaatctcgcaaaaaacctgcttacagccatcccaagtagcatcggagcacttccaaaactaattcgcctggacatgcatcagaataaaataacatcaattcctccttccataaagggttgctcttcgctagccgagttctacatgggaaataacctattgtcttcaataccagctgatattggtatgctatcaaaattaggcatacttgatctccattctaatcagctaaaggagtatccagttggagcctgcaacctcaaattatctttcctcgatctatcgaataactcattatctggtctgcccgctgaactaggtaaaatgactaccctaagaaagcttttgcttactggaaatcctatgaggacacttaggagttcattggtttctggaccaacgacaacattgctgaagtatctgcgcagtcggctttcgtctgatgaggaagcatcaggatctggaagcaccccgacaaaagatgaccaaattgctgcagcaaggcgattgtccttatcttcaaaggaactggacttgagcggtcttggtgtgaccagtgtaccagctgctgcgtgggagacaagtgatgtggtgaaactggatctttctaaaaattcaatagaagatctaccaaacgagttgtcattatgctcatcacttcaatccttagttttgtctaataacaagataaaaaagtggcctcgcacagtggtttcctctcttcccagcttgtcttccttaaagctggacaataaccccttggtagagatatcatccactgatcttgtgcctctgtccaaacttgaagtacttgatctaagtggcaatgcttcagcacttcctgaaccttctgcagtttctgcattaccacagctgcatgagctctacctaagacgaatgaaactccatgaatttcctaatggtttgttgggcctaaaacagcttcggattcttgacctgagtcagaatagccttacaactgtgcccgagggcatcaagaatttcactgctctcattgagcttgatctgtcagacaacaatataacagcactcccagcagagctgggattacttgaagctaacttgcaagtgttgaaactggatggaaatccactaagaagcataagacgaactctgttggagcgaggaacaaaagcaattctcaagtacctcaaagaaaaattgcctgctgaataatatttatagagcaaattattgtggagtcatgcaataaaatgtttttttttggctactgtatcttgtgttattccttttcaatattctggacttaattttatggaaaaaaaatctggatcttgtgtgagaagggagctttgtgatcgtttgtgtgtttgcatcctgatattatccacatgtttttattggagcaacatttttttttctgagagctacgtatcattttataaagaagaaaaacggggg

SEQ ID NO: 3927 - DNA, 2456 bp, Setaria italica
caccccaaatcaaatctcaatggcgatctgagccaaccttcgagaaccatctggaagcttcttccgcaaggcaccggggcctccatggaccggatcctcaagtccgccagggagtccggctccctcaacctctccaatcgctccctcagggagatacccaaggaagtgtacaacaacttggacacaggcagccaggatgagaaatggtgggagggagtggacctccagaagctcatactggctcacaataatcttgaggtgttaagagaagaccttagaaatttgtcttcacttgttgtgctaaatataagccacaacaagatatcttcccttccagcagctatcggagaccttccattgctaaaatcgctggatgtatcttttaatcaaataaacactctgcccgaagagattggtctggctactgctctagtcaaggttgatttctcaaacaattgccttactgagcttccatctagccttgccaaatgtccggacttgttggaactcaaggcatcgaacaacaacatatcaagaataccagacatacttggctgttccaagttaagtaaattggatctagagggtaacaagcttgtgacggtttctgaaaacatgtttgcgtcatggacaatgctcacagagctaaatcttgcaaaaaatctacttacaaccaccccggatagtattggagcactttcaaaacttattcgcctggacatgcatcagaataaaataacatcaattcctccttccataaagggttgctcttctttagctgagctctatatgggaaataacttgttgtcttcaataccagctgatattggcacactatcaaaattaggaatacttgatctccattctaatcagctaaaggagtaccctgttggagcatgcaacctcaaactatctttccttgatctatcgaataactcattatctggtctaccagctgaactaggtaaaatgactaccctcagaaggcttctgcttactggaaatcctatgagaacacttagaagttcattggtttccggaccaacaactacattactgaagtttctgcgaagtcggctttcatctgatgaggaaggatctggaagcacaagcactccaacaaaagatgaccaaattgctgcagcgaggcgattgtccttatcttcaaaggagttgaacttgagcagtcttggtgtgaccagtgtaccagctgtggcgtgggagacaagtgatgtggtgaaactggatctttctaaaaattcaatagaagatctgccaaacgagctgtcattatgttcatcacttcaatccttagtgttgtcaaataacaaaataaaaaggtggccgcacacagtgatatcctcccttaccagtctgtcttccttaaagctggacaataattccttggcagagatatcatccactgatcttttgtctctgtcgaaacttgaagtgcttgatttaagtggcaatgcttcagcactacctgaaccttctgcagtttctgcgtcgccacagctgcaggagctctacctaagacgaatgaaactccatgaatttcctaatggtttgttgggcttaaaacagctccggattcttgacctgagtcagaataacctcacaactgtaccagagggtataaagaatttcactgctctgattgagcttgacctgtcagacaacaatataacagcgctcccagcagagctgggattgcttgagcctaaccttcaagtgttgaaacttgacgggaatccgctaagaagcataagacgaactctgttggagcgaggaacgaaagcaattctcaagtacctcaaagaaaagttgcctgctgaataatgtctcgagagcaaattgttgcaggagtcgtgcaacaatgtcatatgtttcttggccactgcatgttatatttaacccttgcgattttccggtgtggaatttggatctcgtatgagaagtgaggtttgccttgtgcgttttgtgatcatttgtgtggttttgcattcttcgttgtgtgtgctgcatgtttcctcattgaagcctagtctctgcccactctttatgaatcggtgatacaataagacacaacagaagacaagaagagacgttgcagattagacgagatggcagacgcgagacggcatgaagtctgaaaggtgcactgcagagccgtgtcttcattctacagagtttgagcaggccaatattttacagcctttgcggagtgaaaagcatgtgtttttcagctggtgtatgtcagcattttctgggattttgaacggcttctagtgtatgttgtattggaactggtaaccagatgttcttgaatccccttttcttctcatcttcagatacgaggacatgcctccattttattttgtaatactctacaatctatatatttgctgttttatacattgtcggtcatcaggtttgtgatgacagaaactgaa

SEQ ID NO: 3928 - DNA, 2410 bp, Panicum virgatum
cagcgcaatacaattctccgtttctcggcttctcgcagcggctggctagagatctgtttggatcgtgatgaaaggacggatcgctgctccgcctcctactccaattccaattcttccgtagcatccacaaatcaaacctcaatggcgatctgaaccaaccttccagaaccatctggaagttcatggatcggatcttcaagtccgccagggagtcgggctccctcaacctctccaatcgctccctcagggacatacccaaggaggtgtacaacaacttggacacaggcagccaggatgagaaatggtgggagggagtggacctccagaagctcatactggctcacaataaccttgaagtgctaagagaagaccttagaaatttgtcttcacttgttgtgttaaatataagccacaacaagatatcttcccttccagcagctattggagacctgccattgctaaaatcgctggatgcatctttcaatcaaataagcactctgcctgaagagattggtctggccactgcattagtcaaagttgacctctcaaataattgtctttctgagcttccagctagcctcgccaaatgttcagacttgtcggaactcaaggcttcaaacaacaccatatcaagaataccagatgcacttgctggctgttccaagttaagtaaattggatctagagggtaacaagcttgtgactatttcggaaaacatgtttccatcctggacaatgctcacggagctaaatcttgcaagaaatctgcttacaaccaccccggatagtatcggagcacttcataaacttattcgcctggacatgcatcagaataaaataacatcaattcctccttccataaagggttgctcttctcttgctgagctctatatgggaaataacttattgtcatcaataccagctgatattggcacactatcaaaattaggaatacttgatctccattctaatcagctaaaggagtaccctgttggagcatgcaacctcaaactatctttcctcgatctatcgaataactcattatctggtctaccagctgaactaggtaaaatgactaccctcagaaagcttctgcttagtggaaatcctatgagaacacttaggagttcattggtttctggaccaacaactgcattactgaagtatctgcggagtcggctttcatctgatgaggaaggatctggaagcacaagcaccccgacaaaagatgaccaaattgctgcagcgaggcaattgtccttatcttcaaaggaattggacttgagcggtcttggtgtgactagtgtaccagcagtggcgtgggagacaaacgatgtagtcaaattggatctttctaaaaattcaatagaagatcttccaaatgagttatcaatatgttcatcacttcaatccttggtgttgtcgaataacaagataaaaaggtggccgcacacggtgatctcctcccttaccagtctgtcttccttaaagctggacaataatcccttggcagagatatcattcactgatctagtgtctctggccaaacttgaagtacttgatttaagtggcaatgcttcagcactacctgaaccttctgcagtttctgcgctaccacaactgcaggagctctacctaagacggatgaaactccatgaatttcctaatggtttgttggacttaaaacagctccggattcttgacctgagtcagaataacctcacaactgtaccagagggtataaagaatttcactgttctgatcgagcttgacctgtcagacaacaatataacagcgctcccagcagagctgggattgcttgagcctaacctgcaagtgctgaaacttgacgggaatccgcttagaagcataagacggactctgttggagcgaggaacaaaagcaattctcaagtatctcaaagaaaaattgcccgctcaataatgtctcgagaacaaactgttgcgggactcgggcaataatatgtttcttggccaccgtatcttttatttaagccttacaattttcctgcgaattctatggaatttggatcttgcgcgagaagtgagcgagatgccttatgcgtgttgtgatcatttgtgtgtgtttgcatcattgaaaccagtgtcgtctctgtccactcggtggtacaatgagacgcaacagaagacgagaagagacgttgcagatgagatggagacggcatgattctgaaaggtacacggcagagtcgtgtctatttcatcattctacaaacttgagcacgccagtgtttttcatgtgttgcgcggtgaaaaagcatatgtttttcaggtgttgtacgtcaacattattgtggaatttgaacggcttctagtacatgtttgggaattgttaacctgatgttcacttctgaatccccttctcatctt

SEQ ID NO: 3929 - DNA, 2345 bp, Panicum virgatum
gagatctgtttggatcgtgatgaaaggacggatcgctgctccgcctcctactccaattccaattcttccgtagcatccacaaatcaaacctcaatggcgatctgaaccaaccttccagaaccatctggaagttcatggatcggatcttcaagtccgccagggagtcgggctccctcaacctctccaatcgctccctcagggacatacccaaggaggtgtacaacaacttggacacaggcagccaggatgagaaatggtgggagggagtggacctccagaagctcatactggctcacaataaccttgaagtgctaagagaagaccttagaaatttgtcttcacttgttgtgttaaatataagccacaacaagatatcttcccttccagcagctattggagacctgccattgctaaaatcgctggatgcatctttcaatcaaataagcactctgcctgaagagattggtctggccactgcattagtcaaagttgacctctcaaataattgtctttctgagcttccagctagcctcgccaaatgttcagacttgtcggaactcaaggcttcaaacaacaccatatcaagaataccagatgcacttgctggctgttccaagttaagtaaattggatctagagggtaacaagcttgtgactatttcggaaaacatgtttccatcctggacaatgctcacggagctaaatcttgcaagaaatctgcttacaaccaccccggatagtatcggagcacttcataaacttattcgcctggacatgcatcagaataaaataacatcaattcctccttccataaagggttgctcttctcttgctgagctctatatgggaaataacttattgtcatcaataccagctgatattggcacactatcaaaattaggaatacttgatctccattctaatcagctaaaggagtaccctgttggagcatgcaacctcaaactatctttcctcgatctatcgaataactcattatctggtctaccagctgaactaggtaaaatgactaccctcagaaagcttctgcttagtggaaatcctatgagaacacttaggagttcattggtttctggaccaacaactgcattactgaagtatctgcggagtcggctttcatctgatgaggaaggatctggaagcacaagcaccccgacaaaagatgaccaaattgctgcagcgaggcaattgtccttatcttcaaaggaattggacttgagcggtcttggtgtgactagtgtaccagcagtggcgtgggagacaaacgatgtagtcaaattggatctttctaaaaattcaatagaagatcttccaaatgagttatcaatatgttcatcacttcaatccttggtgttgtcgaataacaagataaaaaggtggccgcacacggtgatctcctcccttaccagtctgtcttccttaaagctggacaataatcccttggcagagatatcattcactgatctagtgtctctggccaaacttgaagtacttgatttaagtggcaatgcttcagcactacctgaaccttctgcagtttctgcgctaccacaactgcaggagctctacctaagacggatgaaactccatgaatttcctaatggtttgttggacttaaaacagctccggattcttgacctgagtcagaataacctcacaactgtaccagagggtataaagaatttcactgttctgatcgagcttgacctgtcagacaacaatataacagcgctcccagcagagctgggattgcttgagcctaacctgcaagtgctgaaacttgacgggaatccgcttagaagcataagacggactctgttggagcgaggaacaaaagcaattctcaagtatctcaaagaaaaattgcccgctcaataatgtctcgagaacaaactgttgcgggactcgggcaataatatgtttcttggccaccgtatcttttatttaagccttacaattttcctgcgaattctatggaatttggatcttgcgcgagaagtgagcgagatgccttatgcgtgttgtgatcatttgtgtgtgtttgcatcattgaaaccagtgtcgtctctgtccactcggtggtacaatgagacgcaacagaagacgagaagagacgttgcagatgagatggagacggcatgattctgaaaggtacacggcagagtcgtgtctatttcatcattctacaaacttgagcacgccagtgtttttcatgtgttgcgcggtgaaaaagcatatgtttttcaggtgttgtacgtcaacattattgtggaatttgaacggcttctagtacatgtttgggaattgttaacctgatgttcacttctg

SEQ ID NO: 3930 - DNA, 2083 bp, Zea mays
ctctctaacaatactaatactactgcatcaatgtttgtatgtatagagagagcgcaccttatattataggtatagaataaaaagtggttacgccttatattatgggacagagggagtatctagctagctagttagttattgtgtgtgttgctcacctcagtacttctgcctgttcctttgccgccttgctctgcagggagatacccaaggaggtttacaacaacttggacactggcagccaggatgagaaatggtgggagggagtggacctccaaaagctcattctggctcacaataatcttgaggtgttaagagaagaccttaggaacttgtcttcgcttgttgttctaaatataagtcacaacaagatatcttcccttccagcagctatcggagatctcccgttgctaaaatcactggacatgtctttcaatcaaataaacactctgcccgaagagattggcctggctactgctttagtcaaggttgacttctcaaacaattgccttactgagcttccacctaacctcgccacatgcccggacttgtccgaactcaaggcatcaaacaacaacatatccagagtaccagatgtacttgctggctgttccaagttaagtaaattggatctagagggtaacaagcttgtggcactttctgaaaacatgtttgtgtcatggacaatgctcacagaattgaatctcgcaaagaatctacttacagccatcccaggtagcattggagcacttccaaaactaatccgcttggacatgcatcagaataaaataacatcgattcccccttccataaaaggttgctcttcgctagccgagttgtatatgggaaataacttattgtcttcaataccagctgatattggcacgttatcaaagttaggcatacttgatctccattctaatcagctaaaggagtatccagttggagcctgcaacctcaaattatctttccttgatctatcaaataactcattatctggtctaccagctgaactaggtaaaatgactaccctaagaaagcttctgcttactggaaatcctatgaggacacttaggagttcattggtttctggaccaacaacaacattgctgaagtatctgcgcagccggctttcatccgatgaggaagcatcaggatccagaagcaccccaactaaagatgaccaaattgctgcagcaaggcgcttgtccttatcttcaaaggaactggacttgagtggccttggagtgaccagtgtaccagctgccgcgtgggagacaagtgatgtggtgaaactggatctttctaaaaattcaatagaagatctaccaaatgagttgtcattatgctcatcacttcaatccttagttttgtctaataacaagataaaaaggtggcctcacacagtggtttcctcccttccctgtctgtcttccttaaagctggacaataaccccttggtagagatatcatccactgatcttgtgcctctgtccaaacttgaagtacttgatctaagtggcaatgcttcagcacttcctgaaccttctgcagtttctgcattaccacagctgcaagagctttacctaagacgaatgaaactccatgaatttcctaatggtttgctgggcctaaaactgcttaggattcttgacctgagtcagaatcaccttacaactgtgccggagggcatcaagaatttcactgcactcattgagcttgatctgtctgacaacaatataacagcactcccagcggagctgggattgcttgaagctaacctgcaagtgctgaaactggatggaaatccgctaagaagcataagacgaactctgttggagcgaggaacgaaagcagttctcaagtacctcaaagaaaaattgccgtctgaataatatttatagaacaaactattgttggagtaatggaataaaatgtttttttgccactgtatctcagttttctggactgaattttgtgcaaaagtatctggaccttgtgtgagaagagagctttgtgagtgtgttgttggatatactggttatagtccacatgttttattggaacaaaaatattttctctgttc

SEQ ID NO: 3931 - DNA, 859 bp, Secale cereale
tcagacacaccaacaagcttccctgtcttcttcttccctgctcaaatcttccatacaccatgggctccctgagaagcagtggcagcggcgcggcggtgccggtggagagtgtggacccggaggcggcgtgcgcactgctggcctcggggcagtacgggtacgtggacgtgcgcatgtgggaggacttcgacaagggccatgtcgccggagcacgcaacgtgccctactacctctctgttacacccaacggcaaggagcataaccctcacttcgtcgaccaggtcgccgcgctccactccaaggaggaccggttcctcgtcggctgccgctccggggtgcggtcaaggctcgccaccgcagaccttgtagccgctggattcacgaatgtgaagaacctcgagggcggctatctctccttgctcaagagcgcaagctacccgcagccgacatcaagcaaccactgatccatcaatcccatatctagaataagtgcaacgatgtagtattacccaacgtcttacgaagaataagaggaggaattaatttccatggaaaaagaaggcactatgtatggatatgcatcatgagttcttggcatggactttgttccaaccaatagtgctactagctgaatactgatttccccttttatgaatgtatcttgcaaaaagaaaacccaaagaaaatgctttattcctgaggtctagaaaatgtcaacaatcgtaacctcctaaataattttaagggttatttagtgcatatgacgttgacaaagtgatcatgtgctactgtcgttatctaattaccatgcattgtaatcgcacagcatgcattggacaagtagtatatgtgggtaaag

SEQ ID NO: 3932 - DNA, 754 bp, Secale cereale
gcccccggagtcagacacaccaacaagcttccctgtcttcttcttccctgctcaaatcttccatacaccatgggctccctgagaagcagtggcagcggcgcggcggtgccggtggagagtgtggacccggaggcggcgtgcgcactgctggcctcggggcagtacgggtacgtggacgtgcgcatgtgggaggacttcgacaagggccatgtcgccggagcacgcaacgtgccctactacctctctgttacacccaacggcaaggagcataaccctcacttcgtcgaccaggtcgccgcgctccactccaaggaggaccggttcctcgtcggctgccgctccggggtgcggtcaaggctcgccaccgcagaccttgtagccgctggattcacgaatgtgaagaacctcgagggcggctatctctccttgctcaagagtgcaagctatccccagtcgacatcaagcaaccactgatccatcaattccatatctagaataagtgctacgatgtagtattacccaacgtcttacgaagaataagaggaggaattaattcccatggaaaaagaaggcatgtatggatatgcatcatgagttcttggcatggactttgttccaaccaatagtgctactagctgaatactgatttccccttttatgaatgtatcttgcaaaaagaaaaccaaagaaaatgttttattcctgaggtctagaaaatgtcaacaatcgtaacctcctaaataattataagggt

SEQ ID NO: 3933 - DNA, 614 bp, Secale cereale
atgggctccctgagaagcagtggcagcggcgcggcggtgccggtggagagtgtggacccggaggcggcgtgcgcactgctggcctcggggcagtacgggtacgtggacgtgcgcatgtgggaggacttcgacaagggccatgtcgccggagcacgcaacgtgccctactacctctctgtcacaccccacggcaaggagcataaccctcacttcgtcgaccaggtcgccgcgctccactctaaggaggaccggttcctcgtcggctgccgttccggggtgcggtcaaggctcgccaccgcagacctcgtagccgctggattcacgaatgtgaagaacctcgagggcggctatctctccttgctcaagagtgcaagctacccccaatcgacatcaagcaaccactgatccatcaattccatatctagaataagtgctacgatgtagtattatccaacgtcttacgaagaataagaggaggaattaatttccatggaaaaagaaggcactatgtatggatatgcatcatgggttcttggcatggacttcgttccaaccaatagtgctactagctaaatgctaattttccctttatgaatgtatcttgcaaaaagaaa

SEQ ID NO: 3934 - DNA, 872 bp, Secale cereale
tcttctacttcttctttcctgctcaaatcttccatacaccatgggctccctgagaagcagtggcagcggcgcggcggtgccggtggagagtgtggacccggaggcggcgtgcgcactgctggcctccgggcagtacgggtacgtggacgtgcgcatgtgggaggacttcgacaagggccatgtcgccggagcacgcaacgtgccctactacctctctgtcacaccccacggcaaggagcataaccctcacttcgtcgaccaggtcgccgcgctccactccaaggaggaccggttcctcgtcggctgccgctccggggtgcggtcaaggctcgccaccgcagacctcgtcgccgctggattcacgaatgtgaagaacctggagggtggctacctctccttgctcaagagcgcaagctacccgcagacgacggccatacactattgatccatcaattccgtatctataataagtattttcggacggagaaagtagtattatccaacgtcttacgaggaataagaggaagaagcgttcagacccgaggaggaattaatttccatggaaaaagaaggcactatgttctatgtatgtatatgcatccggagttcttggcatggacgttgttccaacctatagtgctactagctgaatactgatttccccttttatgaatgtatcttgcaaaaagaaaacccaaagaaaacgttttattcctgaggtctagaaaatgtcaacaatcgcaacctcctaaataattttaagggttatttagtgcatatgacgttgacaaagtgatcatgtgctactgtcgttatctaattaccatgcattgtaatcgcacaacatgcatttggacaagtagtatatgtgg

SEQ ID NO: 3935 - DNA, 876 bp, Secale cereale
caccaacaagcttccctgtcttcttctacttcttctttcctgctcaaatcttccatacaccatgggctccctgagaagcagtggcagcggcgcggcggtgccggtggagagtgtggacccggaggcggcgtgcgcactgctggcctccgggcagtacgggtacgtggacgtgcgcatgtgggaggacttcgacaagggccatgtcgccggagcacgcaacgtgccctactacctctctgtcacaccccacggcaaggagcataacactcacttcgtcgagcaggtcgccgcgctccactccaaggaggaccggttcctcgtcggctgccgttccggggtgcggtcaaggctcgccaccgcagacctcgtagccgctggattcacgaatgtgaagaacctcgagggcggctatctctccttgctcaagagcgcaagctacccgcagccgacatcaagcaaccactgatccatcaatcccatatctagaataagtgcaacgatgtagtattacccaacgtcttacgaagaataagaggaggaattaatttccatggaaaaagaaggcactatgtatggatatgcatcatgagttcttggcatggactttgttccaaccaatagtgctactagctgaatactgatttccccttttatgaatgtatcttgcaaaaagaaaacccaaagaaaatgctttattcctgaggtctagaaaatgtcaacaatcgtaacctcctaaataattttaagggttatttagtgcatatgacgttgacaaagtgatcatgtgctactgtcgttatctaattaccatgcattgtaatcgcacagcatgcatttggacaagtagtatatgtggtaagagcattcttctaacta

SEQ ID NO: 3936 - DNA, 1293 bp, Triticum aestivum
cgatgagaaagtgatggatgcggctacccggacgtgaaggcatcaaccgctgcctcctctcctataaataaacacctgttggcagcactatctttccatcaaggcatcacccaatccgctccacagcccccggagccaaacacatcaacacgcccccctgtcttcttcttccctgctcaaatcctccatacaccatgggctccctgagaagcagcggcagcggcgcggcagtgcccgtagagagtgttgaccccgaggcggcatgcgcactgctggcctcggggcagtacgggtacgtggacgtgcgcatgtgggaggattttgaccgcggccatgtcgccggcgcacgcaacgtaccatactacctctccgtcacccctcacggcaaggagcacaaccctcacttcgtcgaccaggtcgccgcgctccacgccaaggaggaccggttcctcgttggctgccgctccgggatccggtcaaggctcgccaccgcagacctcgtcgccgccggattcacgaatgtgaagaacctggagggtggctacctctccttgctcaagagcgcaagctacccgcagccggcagccagccaccactgatccatcaattccgtatctagaataagtactacgatgtagtattatccaacgtcttacgaagaataagaggaggaattaatttccatggaaaaagaaggcactatgcatgtatatgcatcctgagtttttggcatggactttgttccaaccaaaagtgctactagctgaatactgatttccccttttatgattgtagcttgcaaaaggaaacctaaagaaaatgttttattcctctggtctagaaaatgtcaactatcataacctcctaaataattttaagggttattagtgcatatgacgttgacaaagtgatcatgtgctactgtcgttagttaattaccatgcattgtaatcgcacagcatgcatttgaactagtatatgtggggtaagagcaggatgcggacaccctggcctgactggctcaccgatagattgtccaagtgcctagtgtgtgccacacagataggcaacaaaatcctgttgttcgacagtgatccaattccttttaatccttctcatcggagcaaatccttgaggacgtcaaaaggtttgcatcctttggcttgggctcctgctctccccttctacttatcctcctatgtataagcacatatacacattcgagtatgttcactcaattattctctcatgtaaagctcactctcggcaacaaggatgacaatggccaccaat

SEQ ID NO: 3937 - DNA, 1403 bp, Triticum aestivum
cgatgagaaagtgatggatgcggctacccggacgtgaaggcatcaaccgctgcctcctctcctataaataaacacctgttggcagcactatctttccatcaaggcatcacccaatccgctccacagcccccggagccaaacacatcaacacgcccccctgtcttcttcttccctgctcaaatcctccatacaccatgggctccctgagaagcagcggcagcggcgcggcagtgcccgtagagagtgttgaccccgaggcggcatgcgcactgctggcctcggggcagtacgggtacgtggacgtgcgcatgtgggaggattttgaccgcggccatgtcgccggcgcacgcaacgtaccatactacctctccgtcacccctcacggcaaggagcacaaccctcacttcgtcgaccaggtcgccgcgctccacgccaaggaggaccggttcctcgttggctgccgctccgggatccggtcaaggctcgccaccgcagacctcgtcgccgccggattcacgaatgtgaagaacctggagggtggctacctctccttgctcaagagcgcaagctacccgcagccggcagccagccaccactgatccatcaattccgtatctagaataagtactactctctctgtaaactaatataaaagtgtttagaacactaaaatagtgatctaaacgctcttatattagtttacggagggagtactatgtagtattatccaacatcctatgagttatgaagaataagaggaagaagcgtgttcagaactgaggaattaatttccatggaaaaagaaggcactatgcatgtatatgcatcctgagtttttggcatggactttgttccaaccaaaagtgctactagctgaatactgatttccccttttatgattgtagcttgcaaaaggaaacctaaagaaaatgttttattcctctggtctagaaaatgtcaactatcataacctcctaaataattttaagggttattagtgcatatgacgttgacaaagtgatcatgtgctactgtcgttagttaattaccatgcattgtaatcgcacagcatgcatttgaactagtatatgtggggtaagagcaggatgcggacaccctggcctgactggctcaccgatagattgtccaagtgcctagtgtgtgccacacagataggcaacaaaatcctgttgttcgacagtgatccaattccttttaatccttctcatcggagcaaatccttgaggacgtcaaaaggtttgcatcctttggcttgggctcctgctctccccttctacttatcctcctatgtataagcacatatacacattcgagtatgttcactcaattattctctcatgtaaagctcactctcggcaacaaggatgacaatggccaccaat

SEQ ID NO: 3938 - DNA, 827 bp, Triticum aestivum
agcccccggagccagacacaccaacaagcttccctgtcttcatcttcttcttcttccctgctcaaatcttccatacaccatgggctccctgagaagcagtggcagcggcgcggcggtgccggtggagagtgtggacccagaggcggcgtgcgtgctgctggccacgcagcagtacgggtacgtggacgtgcgcatgtgggaggacttcgacaaggggcacgtcgcgggtgcacgcaacgtaccgtattacctctccgtcacccctcacggcaaggagcgcaaccctcacttcgtcgaccaggtcgccgcactccacgccaaggaggacaggttcctcgttggctgccgctctggtgtccgttcaaggctcgccaccgcggacctcttggccgcagggtttaccaatgtgaagaaccttcagggcggctacctctccttgctcaagagcgcaagctactcgcagccaacagccagccaccagtgatccatcaattccatatctagaataagaagcgtgttcagagctccctgtggaggggacgcgtcgagcggacactacaaaggcggtaaccacgacggttgctaaactaagcagagattattaggatcacagttaatccttaacacccctaatctatgcttgtctttgtgaatgctccattatcttgataaagactcctccagacatgtttatcattaagtatgttcagcatcttcaacttgagaatgtctcatcgaaaaaccctgtgggaaaatatgaggagataggcccccgcgaatgaatgcgagtgggagcagtttgcaatagcatcaaagtttgcaataac

SEQ ID NO: 3939 - DNA, 462 bp, Secale cereale
catggctccctgagaagcagcggcagcggcgcggcagtgcccgtagagagtgttgaccccgaggcggcttgcgcactgctggcctcggggcagtacgggtacgtggacgtgcgcatgtgggaggacttcgacaagggccatgtcgccggcgcgcgcaacgtaccatactacctctccgtcacccctcacggcagggagcacaaccctcacttcgtcgaccaggtcgccgcgctccacgccaaggaggaccggttcctcgttggctgccgctccgggatccggtcaaggctcgccaccgcagacctcgtcgccgccggattcacgaatgtgaagaacctggagggtggctacctctccttgctcaagagcgcaagctacccgcagccggcagccggccaccactgatccatcaattccgatctagaataagtactacgatgtactagtattatccaacatctt

SEQ ID NO: 3940 - DNA, 911 bp, Triticum aestivum
gtccggctacccgggtgtgatatgttccaccgctgccatggcatcatcttatcctataatagcacctacctttccatcagccaatccactccacagcctctggagaccacctcacacagaagcagaggccccttcttccccgctgctcgatcctccatagatgggctccctgcgaagcagcacgagcgcggcggtggagagcgtggacgcggaggcggcgtgtgggctgctggcctcggagcagtacgggtacgtggacgtgcggatgtgggaggacttcgaaaagggccatgtcgccggtgcacgcaacgtgccctactacctctccgtcacaccccatggcaaggagcgcaacccggacttcgtcgaccaggttgcggcgctccactccaaggaggaccggttccttgtgggctgccgctctggggtccggtccaggctcgccaccgcagacctcgtcgctgctgggttcgcgaacgtgaagaacctgcaaggcggttacctctccttgctcaagagtaccagttacccgcagccgcaagcagcaagccaccaatgatcaatcaattgattctttggagtttggaaagtttgttagtgacctgtttgtgtgctatgtatctatcatccttggtcttaacaagaggaagcaagtccttcaggcagctgggattgaattaatttcaaagggaaaacaaagcattatgtatgcaggtacgtatattggacttggactttggactaaccaatttccaagaaataaaaatgtttgggcgcacagctgagtacatgtttgaccaagtcagattaattgtagtacttgttttttttccttcatcatacaattaattaatttggaaaaattgcatttttccactccagaatttgagggattacatactttataaaat

SEQ ID NO: 3941 - DNA, 882 bp, Triticum aestivum
tccttccatcatccaatccactccacagcctctggagaccacctcacacagaaacagaggccccttcttcctagctgctcaatcctccatagatgggttccctgcggagcagcacaagcacggcggtggagagcgtggacgcagaggcggcgtgcgggctgctggccttggagcagtacgggtacgtggacgtgcggatgtgggaggacttcgaaaagggccatgttgccggtgcacgcaacgtgccctactaccactcagtcacgccccatggcaaggagcgcaacccggacttcgtcgaccaggttgctgcgctccactcaaaggaggaccggttccttgttggctgccgctctggggtccggtccaggctcgccaccgcagacctcgtcgctgctgggttcatgaacgtgaagaacctggaaggtggttacctctccttgctcaagagtaccagttacccacagccccaagcagccagccaccaatgatccatcaattgattcttgtgagagtttcgaaaaagttcgttagtgacctgtttgtgtactgtgtttctatcacccttcgtcttcttcttctgaagaagaagaagaagaagaagaagaagcaagtccttcagctgaggcggacatctgggatttaattactatcaaagggaaaacaaagccgtatgtatgtaggtacgtatattggacatggactttggaccaaccaattcccaagaaataaaaatgtttgcgtgtacagctgagtacctgtttgactgtttcaccgactcagctcaattatacttgttttttccttcgtcatacaattaattgatttggaagaatttcatttttgcactacagaatttgagggattacctacttattaaat

SEQ ID NO: 3942 - DNA, 869 bp, Hordeum vulgare
gataacccaatccactccacggcctctggagaccaccacacacggaaccggaagccctttcctccccggtgctcaatcctccatagatgggctccctgcgaagcagcacgagcacggcagtggacagcgtggacgcggaggcggcgtgcgcactgctggccttggagcagtacgggtacgtggacgtgcggatgtgggaggacttcgaaaagggtcacgttgccggtgcacgcaacgtgccctactacctctccgtcacgccccatggcaaggagcgcaacccggacttcgtcgatcaggttgcggcgctccactccaaggaggaccggttccttgttggctgccgctctggggtccggtccaggctcgccaccgcagaccttgtcgccgctggattcgcaaacgtgaagaacctcgaaggcggctacctctccttgctcaagagcgcaagttaccaagcagccagccaccaatgatccatcaattgattctttggagtttggaaagtttgttagtgacctgtttgtgtactatgtatctgtcatccttcgtcttatgaagaagaagaagaagaagaagaagaagaagcaagtcctttcgctgaggtgcacggctgggattgaatgtacttcaaagggaaaacaaagcattatgtatgtaggtacgtatattggacctgtttgtgtactatgtatctgtcatccttcgtcttatgaagaagaagaagaagaaaaaagtcctttagctgaggtgcacggctgggattgaatgtacttcaaagggaaaacaaagcattatgtatgtaggtacgtatattggacatggactttggaccaaccaattttcaagaaataaaaatgtgtgcgtgt

SEQ ID NO: 3943 - DNA, 1157 bp, Hordeum vulgare
agattcttatacaccatgtcatttcatagaaaacaaacacaacaagcacgtatatatgtagttgacatttccatgtatctaatttatgtaaggtaggcgactttagacgatcatgaagtgatggatgcggctacccgggccgtgatatgttcgaccgctgccaagtcatcatattttcctataaatgacaccagtaggtagcacctatctttccataacccaatccactccacggcctctggagaccaccacacacggaaccggaagccctttcctccccggtgctcaatcctccatagatgggctccctgcgaagcagcacgagcacggcagtggacagcgtggacgcggaggcggcgtgcgcactgctggccttggagcagtacgggtacgtggacgtgcggatgtgggaggacttcgaaaagggtcacgttgccggtgcacgcaacgtgccctactacctctccgtcacgccccatggcaaggagcgcaacccggacttcgtcgatcaggttgcggcgctccactccaaggaggaccggttccttgttggctgccgctctggggtccggtccaggctcgccaccgcagaccttgtcgccgctggattcgcaaacgtgaagaacctcgaaggcggctacctctccttgctcaagagcgcaagttaccaagcagccagccaccaatgatccatcaattgattctttggagtttggaaagtttgttagtgacctgtttgtgtactatgtatctgtcatccttcgtcttatgaagaagaagaagaagaagaagaagaagaagcaagtcctttagctgaggtgcacggctgggattgaatgtacttcaaagggaaaacaaagcattatgtatgtaggtacgtatattggacatggactttggaccaaccaattttcaagaaataaaaatgtgtgcgtgtacacctgagaacctcttttgcaaagtaagattaaccatgtttggtttatctcatcatacaattaatcgatttggaagaattgcatttttgcactccagaatttgagggattacctactcgtcccataatataagagcatttttgatactagtgtagtgttaaaaacacttttgtattatggaatggaggaagtactttttaaataatactaataacgtgc

SEQ ID NO: 3944 - DNA, 985 bp, Hordeum vulgare
gcgtcgaccattctctctctataaataagacacgtatgtaacacttatctttcaccaaaccactccacagcccccggagccagacccatcctgcatacctcccctccttcttcatcaccatcatcatcatcatcttcttcttctcttcgcacgtctatcatccatgggctccctgggaagcagagacggcgagaagcgacacgcggtggagagcgtgggcacggaggcggcgtgcgcactgctggtgtcggagcagtacgggtacgtggacgtgcgcatgtgggaggacttcgaccgcggccatgtcgccggagcgcgcaacgtgccttactacctctccgtcaacccccacggcaaggagcgcaacctggactttgtggaccaggttgccgcgctccactctaagcacgaccggctcctcgtcggctgtcgctccggggtgcggtccaggctcgccaccaccgaccttgtcgccgccgggttcacgaaggtgaagaacctggagggtggctacctctccttgctcaagagcgtcagttacccacagcaggcagcagcagccatccaccactaatacagccgggatgattttcctttgtttttcaaggctctcaggaacaagtttggtaatctattatttacgatgtacagaggaaattgccaaggaaaagaaggcattttgtatgtataaaactatataggcatctgagacttggacttgggccaaccaatagtactactgctaccagatttttgattggttttctttgagaatgtatggacaagaagggaaaaaaatgtttgcaggcgcagttggttacccacccatttgggtgtctatgctcatagtacttagtagttctctacctgttctttcctttcatacagctggtcaaattggaagaaatgcatttttataccacagaaattgggacattaaatttttagataagagtgcgtcgatacaacccctaattgtttctta

SEQ ID NO: 3945 - DNA, 699 bp, Secale cereale
ctggagaccaccacacacagaaccagaagccttttccttcccgctgctcaatcctccatagatgggctccctgcgaagcagcacgagcgccgcggtggagagcgtggacgcagaggcggcgtgcggcctgctggccctggagcagtatgggtacgtggacgtgcgtatgtgggaggacttcgaaaagggccatgttgccggtgcacgcaacgtgccctactacctctccgtcacgccccatggcaaggagcccaacccggacttcgtccaacaggttgcggccctccactccaaggaggaccggttccttgttggctgccgctctggaatccggtccaggctcgccaccgcagaccttgtcgctgctggcttcgcgaatgtgaagaacctggatggaggctacctctccttgctcaagagcaccagttacccacagccgcaagcagcaagccaccaatgatccatcaatttattcgtgcgagtttggaaaaagttcggtagtgacctgtttgtgtactgtgtatctatcgtccttcaaagaagaagaagaagaagaagaagaagaagtccttcagctgaggcagacagctgggatttatttactttcaaagggaaaacaaagcattatgtatgtaggtaagtgtattggacatggactttggaccaaccaattcccaagaaataagaatgtttgcgtct

SEQ ID NO: 3946 - DNA, 729 bp, Secale cereale
cacagcctccggagaccaccacacacagaaccagaagccttttccttcccgctgctcaatcctccatagatgggctccctgcgaagcagcacgagcgccgcggtggagagcgtggacgcagaggcggcgtgcggcctgctggccctggagcagtatgggtacttggacgtgcgtatgtgggaggacttcgaaaagggccacgttgcgggtgcacgcaacgtgccctactacctctccgtcacgccccatggcaaggagcgcaacccggacttcgtcgaacaggttgcggctctccactccaaggaggaccggttccttgttggctgccgctctggaatccggtctaggctcgccaccgcagacctcgtcgctgctggcttcgcgaatgtgaagaacctggatggaggctacctctccttgctcaagagcaccagttacccacagccgcaagcagcaagccaccaatgatccatcaattgattcgtgcgagttcagaaaaagttcggtagtgacctgtttgtgtactctgtatttatcgtccttcaaagaagaagaagaagaagaagaagaagaagaagaagaagaagaagtccttcagctgaggcagacagctgggatttatttactttcaaagggaaaacaaagcattatgtatgtaggtaagtgtattggactttggaccaaccaattcccaagaaataagaatgtttgcgtctacagctgagtacc

SEQ ID NO: 3947 - DNA, 717 bp, Secale cereale
ccccacacacagaaccagaagccttttccttcccgctgctcaatcctccatagatgggctcccttcgtggcagcacgagcacggcggtggagagcgtggacgcagaggcggcgtgcgggctgctggccttggagcagtacgggtacgtggacgtgcggatgtgggaggacttcgaaaagggccacgttgcgggtgcacgcaacgtgccctactacctctctgtcacgccccatggcaaggagcgcaacccggacttcgtcgaacaggttgcggccctccactccaaggaggaccggttccttgttggctgccgctctgggatccggtccaggctcgccaccgcagacctcgtcgctgctggcttcgcgaatgtgaagaacctggatggaggctacctctccttgctcaagagcaccagttacccacagccgcaagcagcaagccaccaatgatccatcaattgattcgtgcgagtttggaaaaagttacggtagtgacctgtttgtgtactgtgtatctatcgtccttcaaagaagaagaagaagaagaagaacaagaagaagaagaagaagaagaagaagaagaagtccttcagctgaggcagacagctgggatttatttactttcaaagggaaaacaaagcattatgtatgtaggtaagtatattggacatggactttggaccaaccaattcccaagaaataacaatgtttgcgt

SEQ ID NO: 3948 - DNA, 2908 bp, Brachypodium distachyon
ccagtagcttctgaagcttcgtcctgccctctcgttctcactcgctcagacactcgccaatcctgctgctctctatgctccctgggctatacttccctttgtagccttggctccttatcttcctccatggatccgcgctaaattaatgcaccgggagctcgcaaattcctagcatttcacctggcaccgtctgccgcaagatgtaatctgggtctctcgttcaacacctagctggtggccatctgaatatactctctggaatctggattcctttgagagaaagcgaagctgaggcctcccttttggggaaatggaggagagcttcgtgcccctccggggcatcaagaatgacctccgcgggaggctcacctgctacaagcaggattggaccggaggcttccgtgccggtatcaggatcctagcgccaaccacttacatattctttgcctcggcgataccggtgatatccttcggagagcaactggaaaggagcactgatggagtcctcacagcagtgcagacattggcatcaactgccctctgtggcataatccactccattgtgggagggcagccgctgctcatcctcggcgttgccgaaccgacagtgatcatgtacacattcatgttcagctttgccaaggacaggcccgacctcggtcccaacttgttcctcgcttgggccggctgggtctgtgtgtggactgccatattgctgttcctgctggcagtactaggtgcctgctcaatcataaaccggttcacccgtatcgctggcgagctgttcgggctcctgatcgcgatgcttttcatgcagcaagctatcaagggacttgttgacgagtttggcattcctgagagggaaaacataaaggcacgacagtttgtcccatcatggaggttcgccaatggaatgtttgctattgtattgtcgtttggccttttgctcaccgcactgaagagcagaaaggcgcgatcatggcgctatggagcaggttggttgcgtggcttcatcgccgactatggtgttccactgatggtgctagtgtggacaggtatttcttacataccatatgacagtgtgccgaaaggaatcccgcgacgccttttcagtcctaatccgtggtcccctggtgcatatgacaactggacagtcatcaaggatatgccccatgtgccactcatgtacatcattggtgccttcatacctgcaacaatgattgctgttctctactactttgatcacagtgtcgcatcccagcttgcacagcaggcagaattcaatttgaggaagcctccatctttccactacgatttgcttctcctaggcttcctgacattgttgtgcggcttaatcggtatccctccatccaatggtgtcattccacagtcgccgatgcatacaaagagcttggctactctcaagcaccagatactccgtaaccgactagtagcaacggcacgacagagcatgcgccagaatgcgagcttgagccaactgtatggcagcatgcaggatgcctatcagcagattcagacaccactgatctaccagcaacagtccgtcaaaggcttaaatgagcttaaggactcaactgtccagttagcatcaagcatgggtaacattgatgcaccagttgatgagacgatctttgacatagagaaagaaattgatgacctgcttcccatggaggtcaaggagcaaaggttgagtaacttgctgcaggctgcaatggttgggggctgtgtcgccgctatgccgttgctcaagaagatccctactgctgtcctctggggctactttgccttcatggcgattgagagcttgccaggtaaccagttttgggagaggatcttgctgctcttcactgctcccagcagaagatacaaggtgctagaagagtaccacacaacatttgttgagactgtgccattcaaaacgatagccatgttcacgctcttccagactacgtatctgctggtctgcttcgggatcacatggataccaatagctggagttcttttccccctcatgattatgctcctggttccagtgaggcagtatatcctccccaagctcttcaaaggtgcacatctgaatgacctggacgcagcagagtatgaggaatcaccagctataccgttcaaccttgctacgcaagatattgatgttgcattgggacgcacccagagcgcagagatccttgatgacatggtcaccagaagccgcggtgagatcaagcgcctgaatagtcctaagatcaccagttcaggtggtactcctgttgcagagctgaaaggcatccgcagtccttgtatttctgaaaaggcgtacagccctcgcgtcaccgagctgaggcatgaacgcagccctctaggggagagagacagtccaagaaccggtgagaccagggcatccaagttgggtgaaggctcggcaccaaagtgaagcaataatattttccccatataagctatgcaactactggaaataaaatatatggatgatttgagtacggatgctaatatatgatgtgtactcatgaagtatgatgccacataagatgtctactaatggtgtactgatgaagcgtgatgccgctatatggtgtgtactgatgaagtatggaaaatataggctaattgagtgtatatctgtagcctattatctttgttcttttcttctccttgtgcatcctggtctatataaggtgcaccatgtaatccatgaagtagcagaatattacagtgactactttgaaacttttttagtttcactttgctatattcctgtcaagaacttggagactagcattcattgttactgcaaactgttcataataattgaattttacatggaattggtgaatcatgagcaccatttatactctgttgttaccaaattgcc

SEQ ID NO: 3949 - DNA, 2976 bp, Elaeis guineensis
aactcctttcatggtagaatctctaatgcaagcaaaaggggtgccttctcttggcttggatgatgggatgctcttggtccttcttagtttgccttagtattcttattgtggacattgaatcttgcagctgagctctgtgttttcgggcctgaaagatgtaattttgctttacattaactgtgagttctggtgtttggtttgtttctcgatatgaaaaaagccatcctcacctgggaattttccttatcttgctgcctcatgtgttatttaaatatcagtttcttcatggatctcccttagccaagcggaacctaaggctcttttccagacttgaccgttggtaccttgtatttttgtagttgagtcagttcccaaatcatgtagtcatagttttcttgattctatcattctatagctgcatcgtttttttgggcagaatattcattgtgagcgcctttgtcacgtcttcttcatgcattctttctttcggacgtaattgagatagagaacattcattttcactgttcaacatgagtatagaggaaacatttgtacctttccgcggaatcaagaatgacctccaagggaggttgatgtgttacaagcaagattggactagtggcttccgcgcaggaatcaggattttagctccgactacatatatattctttgcatcggcaatcccagtcatatcatttggtgagcaattggagagaaacactgatggggtcataacagcagtacaaacattggcatctactgcactctgtgggatcatacattcgataattggaggtcagcctctgctgattcttggagttgcagagcctacagtgcttatgtacacattcatgtttaactttgccaaggatagagctgatttgggtcgaaagctgtttttagcatggaccggatgggtatgcgtttggactgccttcttgctgttcttactggctattttaggtgcatgttcgattatcaatagattcactcgtgtagctggcgagctatttggtcttcttattgctatgctgtttatgcaacaggctattaaggggcttgttgatgagttccgcataccaaaaagagaaaacccaaagtctttggagtttgttccatcatggaggttcgccaatgggatgtttgctattgtcctgtcatttggtctgctgctcactgcactaagaagtaggaaggcacgatcctggcgctatgcaactggctggttacgaggtttgattgcagactatggggtacccctaatggtccttgtgtggactggaatttcttatataccctctggtagcattcctaaaggaattcctaggcgccttttcagcccaaatccatggtcacctggagcatatgaaaactggacagtcattaaggacatgctgaatatacccttcctgtacatacttggagcttttatacctgctacaatgatagcagtcctttattattttgatcacagtgtagcatctcaacttgctcagcagaaggagttcaatttgagaaagccgccatcatttcattatgatttacttctcttgggctttttgaccctactatgtgggcttatcgggatccccccatcaaatggtgtcataccacaatctccaatgcacacaaagagtttggctactctcaaacatcagctccttcgcaatcgactagtagccgctgcacaccaaagtatgcgtcaaaattcaagcttgagccaactttatgaaaatatgcaagatgcttatcggcaaatgcagactccattgatttatcaagagcagtctgatcgaggattgaaggaattaaaggattccacaatccaattagcatcaagcatgggaaatattgatgcaccggttgatgagtctgtatttgatattgaaaaagaaattgatgaccttttaccagttgaggtcaaagaacagcgactaagcaacctgcttcagtctatgacggtagcagggtgtgttgcggccatgccatttcttaagaaaatcccaacctctgttctctggggttactttgccttcatggccatagaaagcttacctggaaaccagttctgggagaggattctcttgctcttcaccgcaccaagcagaagatacaaagtgcttgaagagtaccatgccaccttcgtggagactgtacctttcaagacaattgctgcttttacccttttccagaccgcttacttgctattgtgctttggaataacatggattcctatagccggggtcctctttccattgatgatcatgcttttggttcctgtgagacagtatgttcttcccaagctcttcaaaggagctcatcttacagatttggatgcagcagaatatgaagaattgccagctataaaatttgacctggaaacggagattgagtcgggcataagacactccttcgccgaggacagggagattttagatgagttagtcacaagaagccggggtgaaattaagcatatctgtagtcctaaagtgacaagttcaagtggaacaccagccactgaaatcaagagctttcagagcccccggttatcatcggagaaggcatatagcccccgtgtgagtgaactcagacaggagcatagtcctcgtctcagcggaagagggccatccagtccaagaacaggtgaaatcagaccatccaagttgggagagggtgctcggctctccacttcaaagtaataagagggaatggatttacagtgtgtctccccggccgcttccaatggtgctcacatgttcatataactatgcttgtgcctctgctggacaatatattaccattttctatttcaccatgtaggctgctgtagactgcaatgcattgtgtaaaatctctagcctccaatttccctctatcctccaagtagatcgcttcttgtaatcttggaattgccctaatagtacaagagttgtttccaattcagcatgtagttttctttgtctatgaatgataaaa

SEQ ID NO: 3950 - DNA, 2545 bp, Elaeis guineensis
aatattcattgtgagcgcctttgtcacgtcttcttcatgcattctttctttcggacgtaattgagatagagaacattcattttcactgttcaacatgagtatagaggaaacatttgtacctttccgcggaatcaagaatgacctccaagggaggttgatgtgttacaagcaagattggactagtggcttccgcgcaggaatcaggattttagctccgactacatatatattctttgcatcggcaatcccagtcatatcatttggtgagcaattggagagaaacactgatggggtcataacagcagtacaaacattggcatctactgcactctgtgggatcatacattcgataattggaggtcagcctctgctgattcttggagttgcagagcctacagtgcttatgtacacattcatgtttaactttgccaaggatagagctgatttgggtcgaaagctgtttttagcatggaccggatgggtctgcgtttggactgccttcttgctgttcttactggctattttaggtgcatgttcgattatcaatagattcactcgtgtagctggcgagctatttggtcttcttattgctatgctgtttatgcaacaggctattaaggggcttgttgatgagttccgcataccaaaaagagaaaacccaaagtctttggagtttgttccatcatggaggttcgccaatgggatgtttgctattgtcctgtcatttggtctgctgctcactgcactaagaagtaggaaggcacgatcctggcgctatgcaactggctggttacgaggtttgattgcagactatggggtacccctaatggtccttgtgtggactggaatttcttatataccctctggtagcattcctaaaggaattcctaggcgccttttcagcccaaatccatggtcacctggagcatatgaaaactggacagtcattaaggacatgctgaatatacccttcctgtacatacttggagcttttatacctgctacaatgatagcagtcctttattattttgatcacagtgtagcatctcaacttgctcagcagaaggagttcaatttgagaaagccgccatcatttcattatgatttacttctcttgggctttttgaccctactatgtgggcttatcgggatccccccatcaaatggtgtcataccacaatctccaatgcacacaaagagtttggctactctcaaacatcagctccttcgcaatcgactagtagccgctgcacaccaaagtatgcgtcaaaattcaagcttgagccaactttatgaaaatatgcaagatgcttatcggcaaatgcagactccattgatttatcaagagcagtctgatcgaggattgaaggaattaaaggattccacaatccaattagcatcaagcatgggaaatattgatgcaccggttgatgagtctgtatttgatattgaaaaagaaattgatgaccttttaccagttgaggtcaaagaacagcgactaagcaacctgcttcagtctatgacggtagcagggtgtgttgcggccatgccatttcttaagaaaatcccaacctctgttctctggggttactttgccttcatggccatagaaagcttacctggaaaccagttctgggagaggattctcttgctcttcaccgcaccaagcagaagatacaaagtgcttgaagagtaccatgccaccttcgtggagactgtacctttcaagacaattgctgcttttacccttttccagaccgcttacttgctattgtgctttggaataacatggattcctatagccggggtcctctttccattgatgatcatgcttttggttcctgtgagacagtatgttcttcccaagctcttcaaaggagctcatcttacagatttggatgcagcagaatatgaagaattaccggctataaaatttgacctggaaacggagattgagtcgggcataagacactccttcgccgaggacagggagattttagatgagttagtcacaagaagccggggtgaaattaagcatatctgtagtcctaaagtgacaagttcaagtggaacaccagccactgaaatcaagagctttcagagcccccggttatcatcggagaaggcatatagcccccgtgtgagtgaactcagacaggagcatagtcctcgtctcagcggaagagggccatccagtccaagaacaggtgaaatcagaccatccaagttgggagagggtgctcggctctccacttcaaagtaataagagggaatggatttacagtgtgtctccccggccgcttccaatggtgctcacatgttcatataactatgcttgtgcctctgctggacaatatattaccattttctatttcaccatgcaggctgctgtagactgcaatgcattgtgtaaaatctctagcctccaatttccctctatcctccaagtagatcgcttcttgtaatcttggaattgccctaatagtacaagagttgtttccaattcagcatgtagttttctttgtctatgaatgataaaaaattg

SEQ ID NO: 3951 - DNA, 2648 bp, Musa acuminata
atccattgatggcagtgaactgatgcaagaaaagcctcaaagcttctcttggacccttctcagcttttgttgatactggagattcatagtccttgattcatttgttgcatgtgtcttctccaaactccatgagatcatcgatatcaatgtccttgagctgcattcttccttgagcaagcagatcactcagcatcaatttaagcttccatgcctcgtttgtttttccatccattcgatataaagttgttttagagagcatatttggccaaatccaatacaagcatggaggagaccttcgaaccttttcacggaatcaagaatgaccttcgagggagattgatgtgctacaagcaggactggagtagtggcttcaacgcaggcatcaggatcttggctcccactacatacatattctttgcatcagcaatcccagtcatatcatttggagaacagttggagaggaacacagatggtgttctaacagcagttcaaactctggcatcgactgcactctgtggcatcatacactccatcataggaggacagcctctgctgattcttggagtcgcagagcccaccgtgctcatgtacaccttcatgttcaacttcgtcaaagatcgtgccgatctcggtcgaaacatgttcctggcatggacgggatgggtatgtgtttggactgcgttcttgctcttcctgttagccattttaggtgcttgttctatcatcaatagatttactcgtttagctggggagctttttggcctcctgatcgcaatgctgttcatgcagcaggccatcaaggggcttgttgatgagttccggataccgaaaagagaggacccaagagatgtagcgttgatgtcgtcttggaggtttgccaatggcatgtttgctctggttctgtcgtttgggcttctgctcaccgcgctgcgaagcaggaaggcacgatcatggcgctacggcaccggatggctgcgaggtttcatcgcggattacggcgtgccgctcatggtgctcgtgtggaccggagtttcgtatatgccggcaggtggtgttccgagagggattccgagacgcctcctcagcccaaatccatggtcacctggtgcctatcagaactggactgacatgttgaacgtgcccttcctctacatccttggagctttcataccggccaccatgattgcagttttgtattacttcgatcacagcgtggcatctcagcttgctcagcagcaggagttcaatctaagaaagccaccatcgttccactatgacctgcttcttctgggttttttgacgttgctatgtggtctgatcggaattccgccttccaatggtgtcatcccacaatctcccatgcacaccaagagtctggccactctcaagcatcaactgcttcgtaatcggctggtagccactgcacgccagagtatgagtcagaactcaagcttaagtcagctctatggaagcatgcaggacgcgtatcggcaaatgcagacgccattgatctaccaaggacagtcagctcgaggattgaaggagctaaaggactctacggttcagctggcttcgagcatggggagcatggacgcacctgtcgatgattcggtgttcgatatcgacaaggaaatcgatgaccttcttccggttgaggtcaaagagcagcgtctaagcaacctgttacaggccatgatggtagcagggtgtgttgcggccatgccgctcctcaagaagatccccacgtctgttctgtggggatacttcgcgttcatggccatcgaaagcctgcctggaaaccagttctgggagaggattctgctgctcttcactgcaccaagcagaagatacaaagtgctcgaggactaccacgcgaccttcgtggaaagcgtacctttcaaggcgatcactgccttcacaatcttccagaccgcgtacttgctcgtatgcttcgggataacgtggattcccatcgcaggggttctctttcccctcatgatcatgcttctggtgccggtgcggcagtacattctccccaagcttttcaaaggtgcccaccttaccgatctggatgcagcagagtacgaagaatcaccagccataaccttcaacttgcccacggaagtcgacatgggaagaggatactccttctcagagaccagagaggtcctggatgagatcgtgacgaggagccgaggcgagatcaaacacatgaacagtcctaaagtgacgagctcgggaggtacaccagcgacagacgtcaggggcctcagtagtccacggttgtcggagaaagcttacagccctcgggtgggcgaactgaggccggagcgcagtcctcgggttggtggcagaagggcattcagtccaaggatgggagagatcaaaccttccaagctaggagaaggtggtctgaattctccaatgaagtagaagaagagatggaatgtagttttcttttgtgtggattgctatatcttgccatcatatatgtgaaatattgtatcctcaacttctctccctctccatatagaggagattatgtagtgtttcagcaaactataaacgagtctttatatttctccaaattctatcaaatcgactgccctgcttctttgcacagcctgtttgattcgatgtcacaatga

SEQ ID NO: 3952 - DNA, 3281 bp, Theobroma cacao
gccagagttacaggactctaaacaagcctggacaaaacgaaaaacagcagcaaaggttgaaacgcgccccccatgctgacaagataactgacccacctttgctgataagaatgtatcatgtgttttaactctttaaaaccttaatcaaacatattgataagataattgagccacctttgtcgataagaatatctgtgtttcactgctaaaaaccttaatcagtgggatccccgggtaccgagctcgaattcgccctataatttaatattgtgtgtacctccaatgaccagcttctacataccataatggcactatgaatgttgtatctttgcaacaacttctaaacttctagcaccatagttccagaattcaagagagcgcttagttgtcttagttctcataacaaacaatggaagagagctttgttccatttcgtggaatcaagaatgaccttcgagggagactgaagtgctacaagcaagactggactggtggtttcggggcaggtttcaggattttggcccccaccacatatatatttttcgcatcagcaattcctgttatttcatttggagaacagttggaaagagatacagatggggttctcacagcagtccaaacgttggcctccactgcactgtgtggaataatacactctatcataggaggtcagcctttgctgatccttggagttgcagagccaactgtaattatgtacacatttatgttcaattttgccaagaataggctggatttgggatcagagctctttcttgcatggactggatgggtgtgcgtgtggactgcgatcttgctgttcctgctggctatcttaggagcttgctccattatcaacagatttactcgtcttgctggggagttgtttggccttcttattgcaatgctcttcatgcagcaagctattaagggccttgttgatgagtttcgcatacctgaaagagaaaatccaaagttggttgagtttcaaccttcatggagatttgcaaatgggatgttcgctttggttttgtcatttggccttctgcttactgcattaagaagccgaaaagcacgatcttggcgatttggatctggatcattgcgaggcttcatagcagactatggtgtgccattgatggttctggtctggacagctatttcttatgtaccagcaggaactattccaaaaggaattccaaggcgcctcttcagtcccaatccatggtcaccaggtgcatatgagaactggactgtcatcaaggatatgctaaaggttccagtgctttacataattggagctttcattccagcaacaatgatcgccgtcttgtattattttgaccacagtgtagctgctcaactcgctcagcagaaggaattcaatttgagaaagccaccttcttttcattatgatttacttcttctgggattcttgacaattttatgtggtcttattggcatccctccagcaaatggtgtcattccacaatctcctatgcatactaaaagcttagctacattgaagcaccagttgcttcgaaacagactagtagcaacagcccgcaaatgtatgcgtaagaatggaagcttgggacaagtgtacgaaagcatgcaagaagcatatcaacagatgcagactccactaatctaccaagaaccttctgcccggggattaaaggaactgaaagagtcaaccattcaaatggcttcaaacatgggaaatattaatgccccggttgatgagacagtatttgatgttgagaaggaaattgatgatctgctgcctgttgaggtaaaagaacagcggctcagtaacttgcttcaagctacaatggttggaggatgtgttgcagcaatgcctttcattaaaaagatcccaacctcagtgctttggggctattttgcattcatggccattgaaagcttgccagggaaccagttctgggagcggatattgttgctcttcacagctccaagtagaagatataaagtactggaggagtaccatgccacttttgtggaaactgtacctttcaagacaattgcagtattcacgatcttccagactgcttacttgtttgtttgttttgggattacttggatcccaattgctggggttcttttcccattaatgatcatgcttttggttcctgtgagacaatacattttacccaagtttttcaaagggccacaccttcaagatttggatgccgcagagtatgaagagtcaccagctgtaccattcaaccttgtaactgaaggagagctggttaggacagcttcatttgctgatgatgaagagattttagatggaatgatcacacgaagcaggggtgagatcagacgaatgtgcagcccaaaggtaacaagctccactgcaacaccatccaaagaatttaagagtctgcagagcccacgtttctcagagaaggtgtacagccccagagtaagcgaactgagagaggagcaaagtcccgggaaagttggaagagggtcattcagtccgagaactcatgaaggcaagccatcaaatttaggaaaaagtggttaggaatatgacataaataggcaagtattgtaccaagctgccacaaagaaaaaaatatataagtagaaaatagttttatgagcatgcaggaagtctgcaacatttccctcactttcacttttttttttttttttttaattttgaagctcttaatcttggctatcacttttgtaaaatatactaccttgctctccattaacggaaggaatcagatattcagttaataatagaaggccaatcctctgtttcactttaattttccagacaattccccctgagatggaaaaaggaaattctgcttttgttaacagattcatgactattagctgatccggaggacaaacgcttctgtcaaatctaatagcacaagttggtcacgaaaccatcctctaaaagctcctttttcattagtcttggaaaagtattaaattctatcattttgtccaccatgaaagacaacaagcaacctcaaaagcgacctgggtttagttcatgttcatgtagccaaacgccttagaagggacaatttcctcgagagtaacaaaagtcaataccctttcaatatcagaactgtgaaatgtgtagttatctcagggtttgaaagctttcactgttccattcatctccatgctagattagactgtaaaccaccacgaggagtaaaataaatggcaggcactttttccgggaatcattgttgatgcttgaagcttggaaccgaacaatgattcta

SEQ ID NO: 3953 - DNA, 2253 bp, Manihot esculenta
aaggaatcatggaagagagctttgtaccatttcgtggaatcaagaatgatcttaaggggagattgatgtgttacaagcaggattggacgggtggtttcaaggcaggcttcaggattttggcaccaaccacgtacatattttttgcatcagcaattccagttatttcttttggagaacagttggaaagagatacagatggggttcttacagcagttcaaacattggcttctactgcactatgtggaattatacattccattattggaggtcagcctttgctgatcctaggagttgctgagccaactgtaattatgtatactttcatgttcaattttgctaaaagtagacctgacttgggatcaaagctcttcctcgcatggactggatgggtatgcgtgtggacagcgatattgttgtttctactggctattttaggagcctgctccatcatcaataggtttactcgtcttgcaggagaattgtttggtcttctgattgctatgcttttcatgcaggaagctatcaaaggacttgttgatgaattttgcatacctgatagagaaaatccaaagtcaattcagtttgaattctcatggagatttgcaaacgggatgtttgctttggttctgtcatttggccttctgttgacagcattgaaaagcagaaaagcaaggtcatggcgctatggttctgggtcacttcggggctgcatagcagattatggtgtgccattgatggtgctggtttggactgctgtttcctatattccatcaggaagtattccaaaaggaatcccaaggcgtcttctcagtccaaatccatggtcaacaggcgcatatgagaactggactgatatgctaaatgtgccggttctttatgtaattggagcttttgttccagctacaatgattgcagtgctctactattttgaccacagtgtagcatctcaacttgctcagcagaaggaattcaatttgagaaaaccgccttctttccattatgatttactgcttttaggattcatggtcatattgtgtggtcttattggaatccctccatcaaatggtgttattccgcaatctcccatgcatactaagagtttggctacactgaagcaccaattactccgtaatcgacttgtggcaacagcacgcaaatgtatgagtgagaattcaagcttgggtcaagtgtatgaaagcatgcaagaagcctatcagcagatgcaaaccccattgatttatcaggaaccctctgctctgggattaaaggaattgaaagatttaactattcagattgcctcagttgggaatattgatgctccagtggatgagacagtatttgatgttgagaaggagattgatgatttgttgcctgtggaggtgaaagaacaacgggttagtaacttgcttcaagctataatggtaggaggatgtgttgcagccatgccttttataaaaaagatcccaacatcagttctctggggttattttgctttcatggccattgagagtttaccgggtaaccagttctgggagcgaatcttactgcttttcacggctccaagcagaagatacaaagttctggaggaataccatgctacttttgtggaaactgtgcctttcaagacaattgcaatatttacagtctttcagactgcttacttgcttgtctgttttggcattacatggattccaattgccggggttcttttccctttaatgatcatgcttttggttccagtgagacaatacattttgcccaagtgtttcaaaggagcccacctccaggatctggacgctgcagagtacgaagaagctccagctttatcattcaatttagcaactgagatagagatgagtagatcagcctcatttgctgatgatggagaaattttagatgggatgatcactcgaagcagaggtgaaataaaaagcatacgcagccccagggttgcaagctccacttcaacaccatccaaagaatttaagaccattcacagcccacggttttcagataaagtatatagccctcgagttagtgaactgaaaggagagctaagtcctcgacaaggtggaagaggaccatttagtccaagaacaggagaagcaagaccatccaatttgggaaaaactggttagaaatgggatatcatgaccgactattgatgaccagttgctgttcgtcaaccagaaaaaagagatcacaggtcatggatagttctgtgaacatgcaggaagatgtgttgcgggaatt

SEQ ID NO: 3954 - DNA, 2962 bp, Prunus mume
ctccattattcccttctgacccgcaatgctgtctgcatcaaatctgcccttccccttttattttccaacccccttttgaatctccctttatatatttacagtacacctcccaaaccaaaccacaacccacttcaaatttaagctttcccttggcctgcatgctctcagtttcccttccaaattaccactgctgctgactttgttttgctctgttccaaaaaacccttcaatttgctctttcttgtgctgagtctctacattacattgtttcaattttctagaaattcccagatcatgtagtttaggtggtttagttcttacttgggttgccacttcttcaaattgtggcaatctcttgcacccagcagcttactgcaaactactagcaacacccattagggcccgggcagggtacagcagagcaaagtgttgttcttaagagaaggaagcatggaagagacatttgtgcctttccagggaatcaagaatgatctcagaggaaggttgctgtgctacaagcaagattggactggtggcttcaaagcaggattcaggattttggctccaaccacttacatattttttgcttcagcaatcccagtcatttcatttggcgagcagctggagcgaaatactgatggagttttgacagcagtgcaaaccttagtttctacggcagtttgtgggatcatacactccatcataggaggtcaacccttgctgattttaggtgtggccgagcctactgtaattatgtacaccttcatgttcaattttgccaaagaacgagcagacttgggtccaaagctctttctagcatggagtggatgggtatgcgtgtggacagctgccttgctgttcttattggctatattgggcgcttgttccataatcaataggttcacccgagtagccggagagttgtttggtttacttattgctatgctcttcatgcagcaagccattaaaggacttgtggatgagtttcgcttaccgcaaagagaagatactagtttaccacaatttgtaccttcatggaggtttgcaaatgggatgtttgctttggtcttgtcatttggccttcttctcactgcattgaaaagtaggaaagcaaggtcatggcgctatggctctggttggcttagaggctttgtagcagactatggtgtgccacttatggttctagtgtggactggtgtatcttacataccaactagtaccgttccacatggaatcccaaggcgcctttttagcccaaacccatggtcacctggtgcatatgataattggactgtcattaaggacatgctcaatgttcccatcctctatatcattggagctttcattccagcaacaatgatcgcggtgctttactattttgatcacagtgtagcatcccaactatctcagcagaaagagttcaatttaagaaaaccatcttcttaccattatgacttgcttcttttggggtttctgactttaatgtgtggtctgctcggaattcctccatcaaatggagtcatcccacagtcaccaatgcatacaaagagtttggctactctcaaacatcaattgcttcgtaatcgacttgtagcaacagcacgcaaaagtatgagaaagaatgctagcttgggacagctgtatggaaatatgcaagaagcctatcgacaaatgcagacgcctttgatttaccaagaggcctcagctcggggactgaatgaattaaaagaatcgaccattcaggcagcttcaagtatgggaaattatattgatgcgccagttgacgagacagtgtttgacgtcgagaaagagattgatgatctattgccggttgaggtgaaagaacagcgtcttagtaacttgcttcaagctatactggtgggaggatgtgttgcagctatgcccatcctaaaaaagatcccaacttcagtcctttggggctactttgccttcatggccattgaaagcttacccggtaaccaattttgggaaaggatcttattgctgtttactgctccaagtagaagatacaaagtcctcgaggagtatcatgccacttttgtagaaactgtgcctttcaagtcaatcgcgctgtttacagttttccaaactctgtacttgcttgtatgttttgggcttacttgggttccaattgctggggttatgtttccattgatgatcatgctcttggttcctgtaagacaatacgttctgcccaagtttttcaaaggagcacatcttcaagacttggatgcagcagagtatgaagaggctcctgctttaccatttaaccttgcaacggaggcagagctgggagctggagcatcctatgcaggggatgcagagatattagatgaggttatgaccagaagccgaggtgagtttagacatgttagcagtccaaggatcacaagctctacttcaacaccaggaaatgcccctaaaatcctcgagagcccacattccttcagtcctcgtgtgaacgagctaagaggagaacgaagtcctcgttctggtggaagagggccaaacagtccaaggacacccggatcttcttcaattctgggcaagagtcctagtaacaacacaacatcatgatacctgtgtatttcggcaaacctttaattaagaagttatagactgctttgatcaccattttcattccaccggtttgctttgttttctttagtttggcttctttgtaaaaaaaggttttccttttgctttcccaggtgggaatcgtaatcatagcacattagcattgtgtttatttcttgtaacattaattataccagtgaatgtcttcgatctgactcatgtacgttcctccctcatcaatcgaaaatgccataatttatttgtttctttcacttgcctcatacacacgaacaatgggtgatgcatgtgtgatcaaacctccacttcctatacgtatgtacttgtatttgaaaatatacaaatc

SEQ ID NO: 3955 - DNA, 1779 bp, Sorghum bicolor
tcttaccccaacgcaatcgaatctagcctctgcagccctgcacggctgcacgccctctccggctctgcataaacgtcgcccagcttcccgcccgctcgcctatccggcgccccaaagccccaaaccatttgaaatcacgccgcgttggcgtgtaatcgacgattcggcggcggcggggcggcgatggaggtgggcgaccttcacaaggtgtgggaggtccgtgcgctcaagaccaagcccgacgcggccgccgcccgggcgacgctcgaccgagtcgccaggcaggtccagcccatcatgcgccgccacaagtggcgcgtcaaggtcctctccgagttctcgccgcggaacccgaggctgctggggctcaatgtcggcggcggcgtcgaggtcaagctgcggctgcggcgcgccggccgtgaccatgacttcatcccctacgaggaggtgctcgacaccatgctccacgagctctgccacaaccagcgcgggccccacgatgcgcagttctacaaactctgggacgagctccgcaaggaatgcgaagaacttgtttcaaagggtatcactggaacaggacaagggtttgatggtacaggaaggcgagtaggtggatttacagtacatccaccaccaccatctctgcggcaagctacgttagctgctgcacagaagcgggcaaggaacggagctctattgccttctggaccaagaaagttggggggaaacagtgaaattatgagtgcacttagtccagtacaagctgctgcaatggctgctgaaaggagaatgtatgatgatttgtggtgtggatcgcatgatcaatctggtattgatgattcagatgatgttattattcttcaagaaccgccaaatttggtgacaagggatggaaaacacacgaaggctagctgctccaacacttttgcagagcccagcacttcttctggaattcacatagcagcacgagatgataggacaagtgatgcacttgatagttcaaagtgggaatgtggtgcttgcactcttcttaaccagcccctggcaccaatctgtgaagtttgtggtacagcaaaacctaaaattgcaaaggcaaagtacatgacttggtcttgtaaattttgtactctagagaacagcactaagcttgacaaatgctcggcatgcgatcaatggagatactcatatgggccacctgtagccacacatggcccaagctatgattgaggtaacaatggaggctaaagtagtacagatgacacttctgagcaggcatctgctgaattgtcgatataagttgtcttatctgcaacagttcctgctctattaccactcatatcatatcaggtttcataggtctggagaaatctgatacctgttaaactggtagtactacctaagccaccctcttttgtgaacgttgcttggagcaatgcacggatttggtaaaaaagaaacaatcgtagtccatggctggtaacgtttgccccaagcccggggcatgcagcctctgagcccgtgtctcgccgtctcggtgacaagtaacagctcgcacctagggcacactggcgaattggtctttatctattccgatgtcgtctgctcatgatgcagtttgggtgactgggtgagaaaatttattacattaatgtaaatgttaatacaagcatctgcaatgctcttttaaaagaaatttgcctgctcgtcagatctaacccagaaaatccagagccaaagcttttacatttgctcatccatgccgtcacccttacggctttg

SEQ ID NO: 3956 - DNA, 1811 bp, Zea mays
gcggccagtctggcagtcccgctgtcctccaaacgtcgcctatcttcccgcgcccgctcgtgtatccgtctctaagccaactccagcaacaccgtcaccgtgtgtgtttagactgatacattgtttgtagagagaattttgaaatagaaagtttgataaagagtgaaatagagagtcgctggagataatagtcgcccgcaacccatttgaaaatcacgccgtgttggcgtgtaatcggcgattcggcggccgccgggcggtggcgatggaggtgggtgacctgcacaaggtgtgggaggtccgtgcgctcaagatcaagcccgacgcgaccgccgcgcgggcaaccctcgaccgcgttgccaggcaggtccagcccatcatgcgccgccacaaatggcgcgtcaaggtcctctccgagttttcgccgcggaacccgaggctgctggggctcaatgtcggcgcgggcgtcgaagtcaagctgcggctacggcgcgccggccgcgaccatgacttcatcccgtacgaggaggtgctcgataccatgctacacgagctctgccacaacgagcgcgggccccacgatgcgcagttttacaagctctgggacgagctccgcaaggaatgcgaagaacttgtttcaaagggtatcactggaacaggacaagggtttgatggcacgggaaggcgagttggtggatttactgtacatccaccaccaccatctctgcggcaagctacgttagctgctgcacagaagcgggcaaggaatggagctctattgccttctggaccaagaaagttgggtggaaacagtgaaattatgagtgcacttagtccagtacaagctgctgcaatggcggctgaaagaagaatgtatgatgatttgtggtgtggatcacatgatcaatctgctattgatgattcggatgatgttattattcttcaagagtcgccaaatttgacaagggatgaaaaagacaagggtagctgctccaacacttctgcacagcccagcacttcttctagaattcacatagcagcacgagatgataggacaacaagtgatgcacttgatagttcaaagtgggaatgtggtgcttgcacacttctgaaccaggcaagttttatacctctggcaccaatctgtgaagtttgtggtacaacaaaacctaaaattgcaaaggcgaagtacacaacttggtcttgtaaattttgtactctagagaacagcactaaacttgacaaatgctcagcatgtgatcaatggagatactcatatgggccacctgtagccacatatggcccaagctatgattgagataacagtgaaggccacaatagcacagacgacacttctgagcaggcatctgctgcattgtcgatataagttgtgttatctgcaacagttcttgctctattactactcatgtcatatcaggtttcataggtctggaaaaatctgatacctgttaaactggtagtactatttaagcgaccctcttttgtggacgttgcttggagcaatccacggattggtaaaatgaaacaatcgtagtccatgtctgttaacgttagccccaagcccagggcatgcagcattgcagcctctgaactcgtgtttcgtgtctcgccgtctcggtgacaggtaacaactcgcacctagggcacaccggcgaattggtctttatctgttccgacgtcgtcgactcatgttgccgtggggtgaggaaatttattacgtcaattaatgtaaggtttattacaagtatctgcaatgctctttttaaaagaatttgcctgcttgttagacc

SEQ ID NO: 3957 - DNA, 1888 bp, Oryza sativa
ctttcctttcgtcgtgagaaaaccgaaaagtcgctccactttgcttttgcacccaccggtttcaaaaactcgccccccaaaattcctcctccttcctctcgaaggcggcgaaccccatcgattcctcttcctcctccgccgcacgcgccccaatccgattcaaccgccggcggcggcggcggcggcggcggtggcggcgatggaggtcggggacctgcacaaggtgtgggagatccgcgcgctcaagagaaagcccgacgagcccgccgcccgcgcgctcctcgaccgcgtcgccaagcaggtccagcccatcatgcgccgccgcaagtggcgcgtcaaggtcctctccgagttctcgccgaagaacccgaggctgctggggctcaacgtcggcgggggagtcgaggtgaagctgcggctgcggcacgcgggacgggactacgacttcatcccctacgaggaggtgctcgacaccatgctccacgagctctgccacatcgcgcggggcccccacgacgcgcagttctacaagctctgggatgagctccgcaaggaatgtgaagaacttgtttccaagggtatcactggatcaggccaaggatttgatggtacaggtcggcggttaggtgggtttacagtacacccaccgccaccatctttaaggcaagcaacattagctgcagcacagaaacgggcaaggaatggagctcttttgccatccggtcctagaaagcttggtggaaataatgatattatgagtgctcttagtccaatacaagccgctgcaatggctgctgaaaggagaatgtatgacgatttgtggtgtggatcgcacgatcaatctggcattgatgattcagaagacgttgttattcttgaggatacacctaacttgccaacgcagcttgggaaaagcacaaaggatggcttttctagcagttctgagaatcccagcacatcttcgggatttcccacagcagcacagaatggatcctcttcttgtaggataacaaccgatgcaggagatagttctctatgggagtgtgttgcttgcacacttctaaatcagcctctggcaccaatctgtgaagtttgtagcgcagctaaacctaaaaccacgaaggccaaatatgcaacctggtcctgtaaattctgtactctagaaaacagtactaagattgacaaatgttcagcatgcgatcaatggagatattcacatggaccacctgcagccacatattgtccaagctatgattgatctacattgaagcttgcattaatatggactacagaattttggacagccatctgctgaattgtggatacacaaattcgttcccatcagcagttctatctgttaccccattgcacttctgcataacgaatcagatgtgtaatttactatctaaagcattccctctttcgtggatcacatcatgtgtatagagagaaccacctattggaaacatctgacatatcccaagctccctctgggagcagctaacgcttgaaccattttcaatccttcctgctcctgaagtcctgaagcatgaccgagcacgctggtactatcatgagtcgctgttgctgcagttgagcgatataagctgtcacttcattctaatcaactaaggtcgttgactttttattcgtcctcgtctaatttctccatttggcagctttgggtttgctcttggttgggtgccaactgccaatgacttgacaagttgacattgtatggtcaaagcccaatgggggagtgagctttatcacttgtgtaacgattaacaaatttcttaaaatcattcccgtggtagaatctcgagcgaaaccaacactggctccttttgaaacaaaggaattttacatgttcataggaatttgattc

SEQ ID NO: 3958 - DNA, 1536 bp, Secale cereale
cccccaaatcgatttcaaatcgcgcggcgcccgatcggcggcggcgatggaggtgggcgacctgcacaaggtgtgggagatccgggcgctcaagcggaagcccgaggagccggccgcccgcgcgctcctcgaccgcatcgccaagcaggtccagcccatcatgcgccgccgcaagtggcgggttaaggtcctctccgagttctcgcccaagaacccgaggctgctggggctcaacgtcaaccggggcgtcgaggtgaagctgcggctccggcgcgacggccgcgacctcgacttcatcccctacgaggaggtgctcgacaccatgctccacgagctcgcgcacaacgcgcgcgggccccacgacgcgcagttttacaagctctgggacgagctccgcaaggaatgtgaagaacttgttgccaagggtatcactgggccagggcaagggtttgatggtaccggcaggcgattaggtggattttcgaaatacatccaccaccaccatctctccgacaagctacactaactgcagcacagaaacgagcaaggaatggggctctattgccgtccggcccaagaaagttgggtggaaacaatgccatcatgagtgctcttagtccagtacaagctgctgccatggctgctgaaaggagaatgcaggatgacttgtggtgtggatcacaaaatgattccggtatcgatgattcagatgatgttgttattcttgagcaaccacctaacttgacagcaagggatggaaaaaacacaaagcgtgcaaaaaacacaaggtgtgattcttctagcggttctgcagaacccagcacttcatctggatttcaagttccagcacgagctgatccctcttctggtagaacgactgatgcggactttagttctatgtgggagtgtagtgcttgcactcttcttaatcagcctctggcaccaatttgtgaagtttgtgggacagcgaaacctaaaattgcaaaagccaagtacgcatcttggtcctgcaaattctgcactctggagaactgcactaagcttgataaatgttcggcatgcgatcaatggaggtactcatatggagcacctgtagccacatatggcccaagctacgattgacttacattgaaggctacaagaatacagtttacaattttgggggaggcggctgctgcaatgtttataaattgcctcaccagcagcagttgcctctgttgccacctaccaagtaccgctgcatgtcaactcaaacctgtggagtcgcatgaagatttagcatccaggtctgggtacctgtcggcctgccaatggctcccaattcctctctgggagcactgaatcagtcctgctcacaggcggacggctgctgtatgctttggtgacttccaccagtgggttgccgatttaagaacgtggtcggttttttgcaagaatgcctgtatgtgtaccactgattgcagtagttatcattgtcttgctcatctgatctaatcccgagccagttgctatggcttttgttgcgccaaaaaagtc

SEQ ID NO: 3959 - DNA, 1900 bp, Brachypodium distachyon
ccaagagcctgccttctagacttctagttctccccccgttcacaaacaaaaacgaagttagttttgcttccccacgttcgaaactcgccccccaaattctctagagccgccgtcggatggaatcctccagacgcgcccgcctcccataaactcgtccccccgtggtctcccgcccgcctctcttccccaaatcaatttcaaatcgcgcggcgtcggatcggcgtgaatccgcggcggcggcggcggcgatggaggtgggcgacctgcacaaggtgtgggagatccgcgcgctcaagagaaagcccgacgagccctccgcccgcgcgctactcgaccgcatcgccaagcaggtccagcccatcatgcgccgccgcaagtggcgcgtcaaggtcctctccgagttctcgcctaagaaccccaggctgctggggctcaacgtcaacggtggcgtcgaggtgaagctgcggctgcggcgcgccggccgggactacgacttcatcccctacgaggaggtgctcgacaccatgctccacgagctcgcccacatcgcccgcgggccccacgatgcgcagttttataagctctgggacgaactccgcaaggaatgtgaagaacttgtttcaaagggtatcactggaccaggacaagggtttgacggtacaggcaggagattaggtggattttcaatacatccaccaccaccatctctccggcaagctacattaactgcagcacagaaaagggcaaggaatggggctctattgccatccggcccaagaaagttgggtggaaataatgatattatgagtgcacttagtccaatacaagctgctgctatggctgctgagaggagaatgcaagatgacttgtggtgtggatcacatgatcaatctggcattgatgattcagaagatgttgttattcttgagaaaccacctaactggccaacaagggacagaaaagacacagaggatggaaaaaacgcaaaaggtgtttcttcgagcggttctggagagtccagcacttcatctggatttcaagttggagcacaaggtgattcctcttcgtgtaggacgactgatgcaagcatgagttctctctgggagtgtagttcttgcactcttctaaatcagcctctggcaccaatatgtgaagtttgtgggacagcgaaacttaaacttgcaaaagccaagtacacaacttggtcatgtaaattctgtaccttagagaacaacactaagcttgagaaatgttcggcatgcgatcagtggagatactcatatggaccacctgtagccacatatggttcaagctatgattgacattcagcgaaagctacaataacacggattacaggtttgggcaagcacctgctgcaatgtccatagattcccttaccagcagcagttgcctctgttaccactgcatatcaagtttaccaggttgcagaaaagaacatctggtaatattctgtgtgcctattaacttagttcccaattccttcttggaagcactgaatcatggttatgcaccgcccaggtagtttccagagcttgtacggttgcacctaaacgtggtgtgtgtgtgtgtctatatataactcattttgtgaatccggaatcaagttttgtatcctttgggtggcccagctgacaattataactcatttgcaaagcaactactctctccgtttcgaattaactgacgtggatttgtatagattcttatacaaattcatgtcagttaattcggaacggagtgaatgtagtatgttgaatttgagtgccctctgattcggtcctctttgatttgcatgattcccagcacataagaatagaaaaaagagtataaattagatatcatggtacgatgaaatctaaaatatatatttttgcaagta

SEQ ID NO: 3960 - DNA, 1611 bp, Triticum aestivum
ggggcgaccgtcgcgacaaggtgtgggacggagtccggcgcgtcaagcggaagcccgacggagccggcggccgcgcgctcctcaaccgcgtcgccaagcaggtccagcccatcatgcgccgccgcaagtggcgcgtcaaggtcctctccgagttctcgcccaagaacccgaggctgctggggctcaacgtcaaccggggcgtcgaggtgaagctgcggctccggcgcgacggccgggacctcgacttcatcccctacgaggaggtgctcgacaccatgctccacgagctcgcgcacaacgcgcgcgggccccacgacgcgcagttctacaagctctgggacgagctccgcaaggaatgtgaagaacttgttgcaaagggtatcacggggccaggacaagggtttgatggtacaggcaggcgattaggtggattttcaatacatccaccaccaccatctctccgacaagctacactaactgcagcacagaaacgggcaaggaatggagctctattgccgtccggcccaagaaagttgggtggaaataatgccatcatgagtgctcttagtccagtacaagctgctgccatggctgctgaaaggaggatgcaggatgacttgtggtgcggatctcataatgattctggtatcgatgattcagaagatgttgttattcttgagcaaccacctaacttgacaacaagggatggaaaaaacacaaagcgtgcaaaaaacacaaggtgtgattcttctagtagttctgcagaacccagcacttcatctgtatctcaagttccagcacgagctgattcctcttctggtagaacgactgatgcggactttagttctttgtgggagtgtagtgcttgcactcttcttaatcagcctctggcaccaatttgtgaagtttgtgggacagcgaaacctaaaattgcaaaagccaagtacgcatcttggtcctgtaagttctgcactctggagaactgcactaagcttgataaatgttcggcatgcgatcaatggaggtactcatatggaccacctgtagccacatatggtccaagctacgattgacttacattgaaggctccaagaatacgtttacaattttgggggaggcggctgctgcaatgtttaaaattgcctcaccagcagcggttgcctctgcagccacctaccaagtaccactgcatgccaactcaaacccgtggagtcgcaggaagatttagcatccagatctgggcacctgtcggcctgccaatggctcccaattcctctctgggagcactgaatcctgtatgccttggtgacttccgctcgtggttgccgatttaaagaacgtggtcggtcttgtcatcttgtgcaaggatgcctacatgtttgcaaattgcagcagttgctatcactgccttgttcgtctcatatacagtagtggctcacctttgctatcattgctgtagcttttgcgcgctcgtggtaggagtaggagaatcgtagaggttcaccttgctatcattgctagtagctttgcgcgctcgtggtaggagtaggagatcggtagaggttcaccgtttgccgtgggtgaaggtcactgtcacctgtgttcatctac

SEQ ID NO: 3961 - DNA, 1253 bp, Cenchrus ciliaris
cagcccgagccgccctccccttccctctccctcgcgctcgcgcgggcaagcggagccccctcctcgccacgcctggactccggctttcgtttcccagcggccagttctcccttcccttttcctctatcagctccgccctctcggccttatttcctagcggcgacgacaaggcgagcagccactgccaagtcttttgtcagccgaccaactggccctcgtcgggcaccggcgacgaacatacgaaagattttaggatggacgaagtcacacaagctgttgaaaatctgaagaaagaatggaaccaagcagtttcacagcttgaggagaacattgctgcaattgaatcatgtggaaaaacagggaaagggacagaggaagcaaattcccttccaaggttgaatggttctgcacaggatgctctgcaattgctcaagtcactgcagtttcggcttgatcttctagcacagcagcttcccacttttgaagaagtgcagtctggccaagcaaccttagagtcatgggatgaacaatacaagaagctgcgtgctagcctgaggagtgctaacttacaagcgaaagagaatattagaaaagctgctcaagaggagagggagcttcttctcgggggtggagaagagtctaccatccgcaggcgcaatctccagacaaaggctgggatgacatctgctgctgaaagtatcactgagagcctccgacggtctcgccagatgatggttcaggaagtggaaagaagtgcaagtaccttggctacatttgatgaatcaacaagtgtccttaggaaggctgaaggtgaatatcaaggacaccgctctttgctgtcgcggacccgtggtttgctctccacaatgcagcggcaagatgttcttgatagggtcatcctgacagctggcttcatcattttctccttggcggttctctacgttgtgtcgagacgtattggtctgctgacgctgcagaggaagctggctgatgccatcagatcaggttcgctgtcggccgaggacatcgtagcgaaagcccagcagcatggacctgctgcagctggtgttgcagcccccgcccctcccatttacgatgaactgtgattcacatttccccatggttggttcctttttgattcgtttcgagagggcatttgctcgtggtttcttatacgtgtatgtgtatccagaagaaattgcaaggcaataggtttgacgaataagctgttgttgatatatttacttaacaca

SEQ ID NO: 3962 - DNA, 918 bp, Setaria italica
cagatattaggatggatgaactcacgcaagctgttgataatctgaagaaagaatggaaccaagcggtttcacagcttgaggagagcattgctgtaatcagatcatgtggaaaaacagggaaagggacagaggaagcaaattctcttccaaggttgaatggttctgcacaggatgctctgcaattgctcaagtcactgcagtttcgtcttgatcttctagcatagcagcttcccacttttgaagaagtgcagtctggccaagcaaccttagagtcatgggatgaacaatacaagaagctgcatgctagcctgaggaatgctaacttacaagcgaaagagaacatcagaaaagctgctcaagaggagagggagcttcttctcgggggtggagaagagtctaccattcgcaggcgtaatctccagacaaagactgggatgacatctgctgctgaaagtatcactgagagcctccgacggtctcgccagatgatggttcaggaagtggaaagaagtgcaagtaccttggcaacatttgatgaatcaacaagtgttcttcggaaggctgaaggtaaatattaaggacaccgctctttgctgtcgcggatcgtggtttgctctccacgatgcaacggcaagatgttcctgttagggtcatcctgacagccggctttatcattttctccttggcggttctctacgttgtctcaagacgcattggtctgctgacgttgcaaaggaaactggctgatgccatcagatcaggttcgctgtcagccgaggacatcgtagcgaaagcctagcagcatggacctgccgcagctgatgctacagcccccactcctcccatttacgatgaattgtgactcgcatctgcccatgagttttttttttagaggcatttgcccgtggtttcttatac

SEQ ID NO: 3963 - DNA, 1319 bp, Panicum virgatum
gtgcgtgctctccttccatccctctctcttcccatgccagcatcaaagctagattctgtttatgttacaagtagtcagttctttcttcggatgccagcatggcaagtctgctgaattttttttatccctttggatattaggatggatgaagttacacaagctgttgaaaatctgaagaaagaatggagccaagcggtttcacagcttgaggagagcattgctacaatcaaatcatgtggaaaagcagggaaagggacagaggaagcaaattctcttccaaggttgaatggttctgcgcaggatgctctgcaattgctcaagtcactgcagtttcggcttgatcttctagcgcagcagctacctacttttgaagaagtgcaatccggccaagcaaccttacagtcatgggatgaacaatacaagaagctgcgtgctagtctgaggaatgctaacttacaagctaaagagaacattagaaaagctgctcaagaggagagggagcttcttcttgggggtggagaagagtctaccatccgcaggcgtaatctccagacaaaggctgggatgacatctgctgctgaaagtatcactgagagcctccgacggtctcgccagatgatggttcaggaagtggaaagaagtgcaagtaccttggcaacatttgatgaatcaactagtgttctccagaaggctgaaggtgaatatcaaggacaccgctctttgctgatgcgtacccgtggtttgctctccacaatgcaacggcaagatgttcttgatagggtcatcctgactgtcggctttatcattttctccttggcggttctctatgttgtttcaagacgtattggtctgttgacgctgcaaaggaaactggctgatgccatcagatcaggttcattatcagctgaggacatcgtagcaaaagcccagcctggacctgctgcagccaatgttccagctcccgcccctcccatttacgatgaactgtgatttacttttaactatggtcttatacactgtatccagattccagaagcaactgttaagatgtgcgctagcgagtttgggaaggtactctccactggcggaatgaactagatgcctcactgcagtgtggatttaagtttagtgcagctgacttattttttctggggggcatttatttatacgaccagcaccaatatggttcagatagccttgattcagatgtataattatcccatccctctatccaagttggatttaagtggtatagttttggtttgtttcatgcaaaacggtcaggattcagcttctgaatcctggtaccgtgtcacgcc

SEQ ID NO: 3964 - DNA, 1442 bp, Panicum virgatum
ggcccgtgcaggtgcaagggccaggaacggatcaggccaccgcagctccgccccggcgcggaggctgggggcgcagtcgctgtcctccggcacgggggtcagggttgggccgcacggggcaccgccgctcccggagtccgggcctccgccacggcacccccgtcggccctcgatctgctaggtgcgcgctttcccccctccctctcgctctcgctctccctctccctccctctgcctccctctctcccgctagcgcggaggctgagggtgctgcggctgtcctccatcgcgggggtcaggacgcgccccctttggcgcgggtgccgccgctcctgagggccgggcctccaccgcgcacccccccccccccctgtcagcactcgatctgctaggatggatgaagttacacaagctgttgaaaatctgaagaaagaatggagccaagcggtttcacagcttgaggagagcattgctacaatcaaatcatgtggaaaagcagggaaagggatagaggaagcaaattctcttccaaggttgaatggttctgcgcaggatgctctgcaattgctcaagtcactgcagtttcggcttgatcttctagcgcagcagctacctacttttgaagaagtgcaatccggccaagcaaccttacagtcatgggatgaacaatacaagaagctgcgtgctagtctgaggaatgctaacttacaagctaaagagaacattagaaaagctgctcaagaggagagggagcttcttcttgggggtggagaagagtctaccatccgcaggcgtaatctccagacaaaggctgggatgacatctgctgctgaaagtatcactgagagcctccgacggtctcgccagatgatggttcaggaagtggaaagaagtgcaagtaccttggcaacatttgatgaatcaactagtgttctccggaaggctgaaggtgaatatcaaggacaccgctctttgctgatgcgtacccgtggtttgctctccacaatgcaacggcaagatgttcttgatagggtcatcctgactgtcggctttatcattttctccttggcggttctctatgttgtttcaagacgtattggtctgttgacgctgcaaaggaaactggctgatgccatcagatcaggttcattatcagctgaggacatcgtagcaaaagcccagcctggacctgctgcagccaatgttccagctcccgcccctcccatttacgatgaactgtgattcacttttgactatggtcttatacactgtatccagattccagaagcaactgttaagatgtacgctagcgagtttgggaaggcaatgccgtaccagactaggtgttaatttatcatccagaaaatgatggtagcattcaatttgcaacctcttacaaatctgggattggattgacactgagaattgtatacacaaacatg

SEQ ID NO: 3965 - DNA, 1138 bp, Pennisetum glaucum
aggatggacgaagtcacacaagctgttgaaaatctgaagaaagaatggagccaagcagtttcacagattgaggagagcatttctgcaatcgaatcatgtggaaaaacagggaaagggacagaggaagcgagttctcttccaaggttgaatgcttctgcacaggatgctctgcagttgctcaagtcactgcagtttcggcttgatcttctagcacagcagcttcccacttttgaagaagtgcaggctggccaagcaaccttagagttatgggatgaacaatacaagaagctgcgtgttagcctgaggaatgctaacttacaagcgaaagagaatattagaaaagctgctcaagaggagagggagcttcttcttgggggtggagaagagtctaccattcgcaggcgcaatctccagacaaatgctgggatgacatctgctgctgaaaatatcactgagagcctccgacggtctcgccagatgatggttcaggaagtggaaagaagtgcaagtaccttggcaacatttgatgaatcaacgagtgtccttaagaaggctgaaggtgaatatcaaggacaccgccctttgctgtcgcgaacccgcggtttgctctccacgatgcaacggcaagatgttcttgatagggtgatcctgacagccggcttcatcattttctccttggcggttctctacgttgtctcgagacgtatcggtctgctgacgctgcaaaggaagctggctgatgccatcagatcaggttcgctgtcggccgaggacctcgtggcgaaagcccagcagcatggacctgctgcagctggtgttgcagaccccgctcctcccatttacgatgaactgtgattcgcatttgcccacggttcctttctgattcgttttgagagggcatttgcccgtgtttctttatacgtgtatgtgtatccagaagcaattgtaaggcaatactaacagtctgcgatgatcattaaatcatgcccgacccaagatggattgatacaagtccgagaggaacagggaagttggggaacacctcagagctcgggctgctcggcgctgtaagaaatactagtaagaaatgcggtgaattctagtaagaaatactcgaagagagtcatttgaatctttt

SEQ ID NO: 3966 - DNA, 1540 bp, Zea mays
ggaaagggaagcttgaccccggttcggggcggttttcacagggaagaaaaacacaccccggatggtcgggcacgtaagccccgtctcgtcctccagatatcggccgccaccttcacctccaccgccccggcgcacgtgcgcgtctccatcgtcgccgcctctcctccttcggacacgactgaccttccactggcgccgacgaagaagacacataggaagaagctcaccgccaaacctcatccagatccagtcgctaccctccgaaagccgcatacggaacgtctcgtctcttcctttggatccggcagccggtgctcctcctccggatccggtggtcaactccatcacccccagctccacctcccttagtccccctccatccgccctcacccaccgcttctatatcgccacctctctcgttgtagaagacactgaggatctgggaagtgaagccgttccgccgtgaagcagcgccaccccttgccatccgcccgaccgctgggaagcagggcccacgtctccaagcttcctacaggaagagcctgcgcccctcccaaaggacaaagatattaggatggatgaagtcacacaagctgttgaaaatctgaagaaagaatggagccaagctgtttcacagcttgaggagagcattgctgcaattgaatcatgtggaaaaacagggaaaggaacagaggaagcaacttctcttccaaggttgaatggttctgcacaggatgctctgcagttgctcaagtccctgcagttccggcttgatcttctagctcagcagctacctacttttgatgaagtgcagtctgggcaagcaaccttagggtcgtgggatgaacaatacaagaagttgcgtgctagcctgaggaatgctaacttacaagcgaaagagaacattagaaaagctgctcaggaggagagggagcttcttctagggggtggagaagagtcaacaatccgtaggcgtaatctccagacaaaggttgggatgacatctgctgctgaaagtatcaccgagagcctccgacggtctcgccagatgatggttcaggaagtggaaaggagtgcaagtaccttggcaacatttgatgaatcaacaagtgttctccggaaggctgaaggtgaatatcaaggacaccgctctttgctaatgcgtacccgtggtttgctctccacgatgcaacagcaagatgttcttgataggatcatcctgaccatcggctttatcattttctccttggcggttctttatgttgtctcaagacgtattggtctattgacgctgcaaaggaaactggccgatgccatcagatccggttcattatcagccgatgacatcgtagcgaatgcccaacgtggacctgccccagcaaatgttcctgctcccatctacgatgaactgtgattcgtttgtcctctgtattgttaaggttagttttgcatgtggctattgggattttgtccagtgtgtggtggtcatgtaccgatctgcgattcattaaaataatttcaaatgaaaaatagttaacta

SEQ ID NO: 3967 - DNA, 1588 bp, Sorghum bicolor
aagagccccatttatctttgggcctccaatacgaaacgttggtctgctcaccctcgccccccggatctcacgacgtcaccggggctcccctccgtgtccgtccgtccgtccgttcccaggccatcgtccgtcgccccgagctcactccatcccttgccggctgccgctgctccaccgtccccagtccccatctgccgccagctccctcctggctcctcgcctccaacgcagggaagagtcgcgccgtcgcgccgggaagcagcgccgcccccctcccccatccgccgaccgccgtgaagcagggccgatcctctccacctgcctgtacgaagagccggcgccgcccctcccaaaggtaaaaagcactagccgatcccgtccggttcatgtggcttgtgtggttcttccttccatctattcagatattattaggatggacgaagtcacacaagctgttgaagatctgaagaaagaatggagccaagcggtttcacagcttgaggagagcattgctgcaattgagacatgtggaaaaacagggaaaggaacagaggaagcaacttctcttccaaggttgaatggttctgcacaggatgctctgcagttgctcaagtcactgcagttccggcttgatcttctagctcagcagctacccacttttgatgaagtgcagtctgggcaagcaaccttagagtcatgggatgaacaatacaagaagctgcgtgctagcctgaggaatgctaacttacaagcgaaagagaacattagaaaagctgctcaggaggagagggagcttcttctagggggtggagaagagtcaacgatccgtaggcgtaatctccagacaaaggctgggatgacctctgctgctgaaagtatcaccgagagcctccgacggtctcgccagatgatggttcaggaagtggaaaggagtgcaagtaccttggcaacatttgatgaatcaacaagtgttctccggaaggctgaaggtgaatatcaaggacaccgctctttgctgatgcgtacccgtggtttgctctccacgatgcaacggcaagatgttcttgataggatcatcctgaccatcggctttatcattttctccttggcggttctttatgttgtctcaagacgtattggtctgttgacgctgcaaaggaaactggccaacgccatcagatccggttcattatcagctgcggacatcgtagcgaaagcccaacatgtccctgccccagcaaatgtccctgctcccatttacgatgaactgtgatttattttgtcttctgttttgttaaggtaatagttttgcaagttgccattgagattttgtctacagtccgcagtgaacatgtaccgacctgttatccatttgaaattgaaatatgttttggttacggaggtatgctagtgagtttcggaagatactctccactggtgagaccagttgcctcacttgagaagtagtctccggagtctggactgaatttctgctcattctgcttgtttacttgcaaaatttttgcaaaatgtgaacagtgttactttcgtttgtatttaacaaatattgtccaattataggctaaga

SEQ ID NO: 3968 - DNA, 1104 bp, Sorghum bicolor
aggatggacgaagtcacacaagctgttgaaaatctgaagaaagaatggagccaagcagtttcacagcttgaggagaacattactgcaatcgaatcatgtggaaaaacagggaaaggaacagaggaagcaaattctcttccgaggttgaatggttctgcacaggatgctttgcagctgctcaagtcactgcagttccggcttgatcttctagcacagcagcttcccacttttgatgaagtgcagtctggccaagcaaccttgaagtcatgggatgaacaatacaagaagcttcgtgttagcctgaggaatgctaacttacaagcaaaagataacattagacaagctgctcaagaggagagggcacttcttctgggtggtggcgaagagtctaccatccgtaggcgtaatctccagacaaaggctggaatgacatctgctgctgaaagtatcactgagagcctccgacggtctcgccagatgatggttcaggaagtggaaagaaatgctagtaccttggcaacatttgacgaatcaacaagtgttctccggaaggctgaaggtgaatatcaaggacaccgctctttgctgatgcgtacccgtggtttgctctccacgatgcaacggcaagatgttcttgataggatcatcctgactatcggtttcatcatcttctcctcggcggttctttatgtcgtctcaagacgtattggcctgttgacgctgcaaaggaaactggccaacgccatcagatcaggttcattatcagctgaggacattgtagcgaaagcccaacacggacctgtggccctagcaaatgctcctgctcctcctcccatttacgatgaactgtgaagaatcacttttagtctccgttctgtggatgtgtatcctagagcaattgctaagtcagaagacgatgctcttcagtctccaccggtgaaatcaattagaatgccctgacggcgaagtctcctggatgaagcttagtgctgctgtcttcgatgtttagaacatacggagtactaggaatatccccctacaaatcaacatccctgtcaatcacctccaatcctcttgggttgaggatgagccagacaagatctt

SEQ ID NO: 3969 - DNA, 1154 bp, Zea mays
atcaatttctcctccaccaagttcctcctcccttcgacttcctctcccccgtctggccgtgcagccccggaggcgtcactgggcaaggaggctggggtggggacctcaaacgccatggatgtgcagccctaggcaccaggatggatggagtcacacaagctgttgaaaatcttaagaaagaatggggccaagcagtttcacagcttgacgagaacattactgcaatcaaatcatgtggaaaaacagggaaagggacagaggaagcaaattctcttccaaggttgaatggttctgcacaggatgctctgcagttgctgaagtcactgcagttccagcttgatcttctagcacagcagcttcccacttttgatgaggtgcagtctggtcaagcaaccttgaagtcatgggatgaacaatacaagaagcttcgtattagcttgaggaatgctaacttagaagcaaaagacaacattagacaagctgctgaagaggagagggcacttcttctaggcggtggtgaagagtctaccatccgtaggcgtaatctccagacaaaggctggaatgacatctgctgctgaaagtatcactgagagcctccgacggtctcgccagatgatggttcaggaagtggaaagaagtgctagtaccttggcaacatttgacgaatcaacaagtgttctccagaaggctgaaggtgaatatcaaggacatcgctctttgctgatgcgtacccgtggtttgctctccacaatgcaacgacaagatgtttttgataggatcatcctgactattggtttcaccattttctccttggcggttctttacgttgtctcgagacgtattggtctgttggctctgcaaaggaaactggccgatgccatcagatcaggttctttatcagctgaggacattgtcgcgaaagcccaacatggacctgccccggcaaatgttcctgctcctgctcctcgcgtttacaatgaattatgaatcgcttttattttccgttttatgaaatgtttgaccaggagagattgttaaggtaatactttccacaagtaagctattaagatttcttatctgtagtctcaaatgatgatgcaccaacctgtcaacgtttgaaattcccaacaagttttggttacagttggaaga

SEQ ID NO: 3970 - DNA, 1841 bp, Oryza sativa
tcgagccttcgatcctctcgggtgggtctacggcgcgttcgttctctctccatccattcacgcgattgacgcgagcgagggacgacgactccgacgatcttactccggcgaggcgagacgacggcgactgccgaccggcgagttcgctccatcttccccagagaaccccctcattctccctccggcgagctttcttcgacggagaagacgagacgcggacgagcgacctccctccggcgacgacaacagcctactccggcgagccccctcctccctacggtgagtccccttctcctccctccggtgagccgctaccgcctcgccgcgcgcccttgtccgccgcccaccgccggtccgccgcctcccagaccatccctctaagccccgatcccccacttccccctcccaagcgccaccctccccccacccccacatccccttcgcactcacgcgcagcgcccgttgaccgcgccgctgtcaattcgccgccctcggctgtcgcggggtcgcgcggtcgcgggatcgcgccaccgcccttggccgtcgcggggtcgagccgctgccgtcggccgtcgagctaccccgagaggccgagaaaccctaagatattaggatggataaggtgactcaagctgttgagaacctaaaggaggaatggaatcaagctgttgcacagcttgaagggtgcattgctgcaattgaatcatgtgggaagatgggaaaggggacagaggaagcaagttcacttcctaggttaaacggttctgcacaggatgcactgcaattgctcaattcactacagtgcagacttgatcctctggcagagcagctacccacttttgaagaagtacagtctggccaagcaaccctgcagtcatggaaggaacagtatcagaagctgcgcatgaggctgagaaatgctaacttacaagcaaatgcaaacattaaaaaagctgctcaagaagagagggagcttcttctagggggtggagaagaatctaccatccgcaggcgtaatctacagacaaaggctgggatgacatcggctgcagaaagtataaccgagagcctccgccgatctcgccagttgatggtccaggaagtggaaagaagtgcaaataccttggcaacatttgatgaatcaacaagtgttcttcgtaaggctgaaggtgaatatcaaggacaccgctctttgctgatgcgtactcgtggtttgctatctacaatgcaacggcaagatgttcttgataggatcatccttaccattggttttctcattttctccttggcggtgctatatgttgtctcgagacgtattggcctgttgacactgcaaaggaagctggccgatgccatcagatcaggctcaatatcagctgaagacgttgtagcaaaagtcaagaatgtgcctgtcccagcacctgctgctcctgctcctgctcctcctatttatgatgaactatgatttacttttgtgtattgtttgtacatgtagattcagaagaaaatattcaccatcattgtcagttttatatagtaaactttaaaaattctgattaaggtctctattaactttttttaccgaggaaatgcaggagctgtgtcatgtgtttcaagtaatatttgcaaatggaggatatgattggggacggatgttgttctcagccttcttcggttaaaaaatgtgttgattgcacagttttccaatctcttgaaggaactaattttgactcaaacggtatttactggtattgcgcatccatctgttcgacatgtaataccagcgaatgtaaggctagtttctattgccaaaatgtatttccttctataaccttagcgtg

SEQ ID NO: 3971 - DNA, 3924 bp, Brachypodium distachyon
tacttctgatactgttccttccaagatcctaaggtagcctggccagactgcacttcttcaaaactgggtagctgctctaccagaagatcgagcctgcactgcagtgcgttgagcagttgtagtgaatcctgtgcagaaccattcagcctaggaagagaacttgcttcttctgtccctttccccatcttcccacaggattctattgcagcaacacacaactcaagctgagtaactacttggctccattccttcttcaggttttcaacggcttgtgtgacctcatccatcctgatatctgaaattctgaatggatcagttcagcaggtttaccatgctgctatgaagcaataaccggctaatgtaagacttgtaacaaaaaccaaatttgcactttcaaaattcaattggacaagctgaccaaccagcagtacgtccacaaaaaatgcatattgaacatcagtttgagcacaaaaatcgaatatgatctttccaaatattaacttgagctacacaagatacatgttttttttccttagtacctgagaccaagtacaccaaagctagaggtgggaatggtttgacggttaattaagggggtccaattccaactcaatggtcagccattgcaggcataggggtttggtataccatacgcagagacagacacccacaaaatatagcatatcctaagagtgcactttcaaattaactagtacgatagtatgtatagaatgaaaaatgatatatagaagaaacatgcacaactttcacaagacatttaaaccacaaggcagtcatgctagcatcaataaaatatactgtagcacaacctaaggcctgtttctgtaattgttttgtacaggtctttgggttgctacccgtttctgattggatatgctgtacaacctaaagatcacatgatgcttgtacaatggttcaatagttgttaattttatccaagatttgctgttttaattccatatttgataggacccaatatcacttcagtgctagctaaaaatcacatgatgcttgctggtttggacgtgtatcacttcaactgtatgtgaatgtatcagtgtatctgaatatagcagcacaggcaggctgtggaaacatctgctggcagcgcctctcctaccgttggcccccatggtctgagactggattccaacctgcaaacttcgtgcggtctggtgagattcgggggctacctgcacgcggtttggtatggtttggattaaacaaacagatgagtggggtggattggtacggggagcgagctggctgccgcatggaccgatctgggtctggtgcgggtttgtccccattaccaggcctacatctaaccgtgaactccatgagtccccatcgaccagcgcaaactctgctgcaatccaacgctctccatctctgcctgagagatctcgatctcgttgcagtagcgccggctgtcggtgggcgcaccgccagccgtgggtcacagcagcagcacctccctctgacagcagcgccgcgccgcgtcctccttgcagctccactgggctgctctcccagcaccgccggactccgcttgcagccgccctgacggcccccacccagccgcccgcggatggcagcaacgccacctcctccttgcagcaccgccgcacgccgctggcagcagccccggcggcccccacgctcccgcgggttgtagcgacgccgcctcctcctcgcagcaccgccttgcagcaccgtcgtctctccctcgcaaaaccacctgcatctgcttgcagcaccgccggccgccgcttgcagcagcgccgccggccgtggtcgcagtagcgccaccctcctttgcagcagcgccgcctccctttgcagcaccggcggactgccctcgcgggcgggcgggcggtccctttgcagccgtgacgacggcctagccttggataatcggcatgcggcgcagcgattggagtgtctcgtagagatttagacaagggagagggagaagggaacacccgagagagaggaaaagaggaggaagacttacgggagagaagagataagaagagaggagggcaaccgttttcttttcaccacacacgaggcggccgacgcgcgtccaggaaagaatagcatcagttaaaataaaatccaaaaaagtatagcaatagttttccttttaccaccggaaatcccccgtaccgattcagccgaggcctttttcccccgagccagacccgcgacgcgattccatctgtcccgcgctccaccgccgccgctcgcctacctcccaccgccgctgcgctgccgaccaatcttcaaccgccgccgctgccgttgccccatcgcccacctctccaggagtccggccgccatctctcctctccagctccgatttgcccgacgaacccggcgtccacaaccaggcaccagctcggactttcccacccttgatcccagactcacaccactgctcgtccccttcttcttcctgctgtattatgtattacacgcctgctcaaggccacgttcctattaaccctgacgcgcaggacgccgtctctctgtgttgaccgaaagcagcatcgcaggggcaccaacgacaggacaagccgggggcggcgagatctggccaacagatatcaggatggatgaggtcacacaagccgttgaaaacctgaagaaggaatggagccaagtagttactcagcttgagttgtgtgttgctgcaatagaatcctgtgggaagatggggaaagggacagaagaagcaagttctcttcctaggctgaatggttctgcacaggattcactacaactgctcaacgcactgcagtgcaggctcgatcttctggtagagcagctacccagttttgaagaagtgcagtctggccaggctaccttaggatcttggaaggaacagtatcagaagctgcgtgcgagcttgaggagtgctaacttacaagcgaaatcaaacataaaaaaagctgctcaagaagagagggaacttcttcttggaggtggagaagagtctaccatccggaggcgtaatctccagacaaagactgggctgacatctgctgcagaaagtatcactgagagcctccgtcgatctcggcagttgatggttcaggaagtggaacgaagtgcaagtaccttatcaacttttgatgaatcaacaagtgttctccggaaggctgaaggtgaatatcaaggacaccgcagtttgctaatgcggacccgtggtttgctatccacgatgcaacgacaagatgttcttgataggatcatcctgactattgggttcctcattttcttcttggcggttctttatgttgtctcaagacgcattggcctgttgacactgcaacggaaactggctgatgcgatcagatcaggttccatatcagccgaagacattatacctaaagtgcagcacggacctgccccagcaaatcctaatattgctcctcccatttatgatgaactgtgattgatttccatatatcatttgtgtgtctagatctagaaagcaagttatctgggagcgacagttctgtgtgctagctgttgagaattcctgtttcttagggggatgtcgtctcaattaacagtttccaatgaagctcattatggttcactgtccttctcatgcttcgaaagtaatcgaggtgtttctttatattgcttccatctcaaacatgaaagcaaattctgtgcattagagatgcatttgttaaactgtactactgtagacaaacactgaagttctgttcgaatatatgtcatcgatgggtgctagttcttccttctggaagaacagatgctatgtaaaacctcaagttcatcagttgagtagagccgtgatgggcgcacatgtaatttcagactgatttacagaatacatagggaggtccgcgcagattaacctac

SEQ ID NO: 3972 - DNA, 1517 bp, Secale cereale
tacctcgacggaccaccgcacgcatcccccctgctccgttcgtgctccctgccctgcgcaccgccacggccagcgcacacccctctcactctcccctcgacggctggcatacggtgggttgagttacatctcgtctccggcggtggacgctgcgggaaccgtactcgcctccctctccgcccccagcgctcgcaccacgaacgcacggacctgcctccgcgtcactccgttcgcgaccccggcaggcaacgccggcgatcagcggcgacgaacgacgaatccctagcgcccgccctccgtcgtgcccctgcctccaccccactccgcgcgctatcctgcatctgcgccactccgttcgcgaccctgcgtgcgccggtgagcagccccgccagaggacgacctccgcagctgcgcgaagataatacagatggatgaggtcacacaagccgttgaaaacctgaaaaaggaatggggccaagcagttgcacagcttgaggtgtgcattgctgcaattgaatcctgtgggaagatggggaaagggacagaagaagcaatgtctcttcctaggttgaacggttctgcacaggatgcactgcaactgctcaatgcactgcagtgcaggcttgatcttctggcagagcagctacccacttttgaagaagttcagtctggacaggcaaccttagggtcatggaaggaacagtatcagaggcttcgtgtgaacctgaggagtgctaacttgcaagcaaaagcgaacattggaaaagctgctcaagaagagagggagcttcttctgggaggtggagaagagtccactgtccggaggcgtaatctccagacaaaggctgggatgacatctgctgcagaaagtattactgaaagcctccgtaggtctcgacagttgatggttcaggaagtggaaagaagtgctaataccttgtcaacttttgatgaatcgacaagtgttctgcggaaggctgaaggtgagtatcaggggcaccgctctttgctgatgcgcacccgtggtttgctctccacgatgcaacgacaagatgttctcgataggatcatcctagccattgggttcctcgtgttctccttggcggttatgtatgttgtctcgagacgtattggcctgctgacactgcaaaggaagctggctgatgctatcagatcaggctcagtatcagctggagacatcttggctaaagtgcaggagggacctgccccaacagatgctcctcccatctatgatgaactgtgattttagtattttactaacatccattgtttatacattattacatccagtacatgttgtctaaagtaacatttgccggaaaggctatgctggtgcattgacctgctgccagacttgagttgaaatcgaagcatgctttataatgcttctatctgcccaacatcctgcgtgagctgctgaagcctgaaaagtctgtacgtttatagtatagcgtatctttttctctacattacctgtggcatataccaaaaaagtc

SEQ ID NO: 3973 - DNA, 1453 bp, Hordeum vulgare
atgtccaaatccctagcggcggccgctggtctctccggtctccactccacccgcgctcgccggcgctgccagcccgccaccccttgacctcgacgggccacggctccgcctgcctacctgcccacgccgccgctcgtctctccacccgtgcacgccggccccgccgctccctgcctccctgttcggctgctcaggggaggaggcagaggaagcggccagccgcacacggtcaggcgacagaggcagtttccagcagcagcagcagatgttgcagatggacgaggtcacacaagccgttgaaaacttgaaaaaggaatggagccaagcagttgcccaacttgaggtgtgcattgctgcaattgaatcttgtgggaagatgggaaaagggacagaagaagcaatgtctcttcctaggttgaacggttctgcacaagatgcactgcaattgctcaatgcactgcattgcaggcttgatcttctggcagagcagctacccacttttgaagaagttcagtctggacaggcaaccttagggtcatggaatgaacaatatcagaggctgcgtgtgagcctgaggactgctaacttacaagcaaaagcgaacattggaaaggctgctcaagaagagagggagcttcttctgggaggtggagaagagtccactatccggaggcgtaatctccagacaaaggctgggatgacatccgctgcagaaagtatcactgagagcctccgtaggtctcggcagttgatggttcaggaagtggaaagaagcgctaataccttgtcaacatttgatgaatcgaaagtgttctccgaaaggctgaaggtgaatatcaaggataccgctctttgctgatgcgcacccgtggtttgctctccacgatgcaacgacaagatgttcttgataggatcatcctgactgttgggttcctcatattctccttggcggttctgtatgttgtctctagacgtattggcctgttgacactgcaaaggaagctggctgatgctatcagatcgggctcagtaccagctgaagacatgttgggtaaagtaccccaagatggacctgccccaacaaatgctcctcccatttatgatgaactgtgatttacttccatctgttgtttgttgtacatgagcttacctttcagagttgttatttctgagttagtgtctaaagttttgagtcttgactcttgaactcttgatagatagatagtactcccaccgtcccacaatataagatcgtttctcaagctaacatagcttgaaaaacgatcttatattatgggacggagggagtgtaaccatttctgactccaggcgtgatatatgtagatcgcttttcttttgtattattctgaagtataggtttttctgaccgcatactagcatttatcttgtgcaaattctttcattcatattttagaatagtgctatcttcttg

SEQ ID NO: 3974 - DNA, 1070 bp, Secale cereale
ggccagtcgcaaacgttcaggcgacagcggcaatatccaccagcagcagcagataatacggatggatgaggtcacacaagccgttgaaaacttgaaaaaggatggagccaagcagttgcacagcttgaggtatgcattgctgcaattgactcttgtgggaagatgggaaaagggacagaagaagcaatgtctcttcctaggttgaacggttctgcacaggatgcactgcaattgctcaatgcactgcagtgcaggcttgatcttctggcagagcagctgcccacttttgaagaagttcagtctggacgggcaaccctaggctcatggaaggaacaatatcagaggctgcgtgtgagcctgaggagtgctaacttacaagcaaaagcaaacattggaaaggctgctcaagaagagagggaacttcttctgggaggtggagaagagtccactatccgtaggcgtaatctccagacaaaggctgggatgacatctgctgcagaaagtattactgagagcctccgtaggtctcagcagttgatggttcaggaagtggaaagaagtgctaataccttgtcaacttttgatgaatcgacaagtgttctgcggaaggctgaaggtgagtatcaggggcaccgctctttgctgatgcgcacccgtggtttgctctccacgatgcaacgacaagatgttctcgataggatcatcctagccattgggttcctcgtgttctccttggcggttatgtatgttgtctcaagacgtattggcctgctgacactgcaaaggaagctggctgatgctatcagatcaggctcagtatcagctggagacatcttggctaaagtgcaggagggacctgccccaacagatgctcctcccatctatgatgaactgtgattttagtattttactaacatccattgtttatacattattacatccagtacatgttgccattggcgtaccctcgaaaaacatttgccggaaaggctatgctggtgcattgacctgctgccagacttgagttgaaatcgaagcatgctttataatgcttctatctgcccaaaaaa

SEQ ID NO: 3975 - DNA, 1125 bp, Triticum aestivum
gataataaagatggacgaggtcacacaagccgttgaaaacctgaaaagtgaatggagccaagcagttgcacagcttgaggtgtgcattgctgcaattgaatcctgtgggaagatggggaaagggacagaagaagcaatgtctcttcctaggttgaacggttctgcacaggatgcactgcaattgctgaatgcactgcaatgcaggcttgatcttctggcagagcagctacccacttttgaagaagttcagtctggacaggcaaccttaggatcatggaaggaacagtatcagcggctgcgtgcgaccctgaggagtgctaacttacaagcaaaagtgaacattggaaaagctgctcaagaagagagggagcttcttctgggaggtggagaagagtccactattcggaggcgtaatctccagacaaaggctgggatgacatccgctgcagaaagtattactgagagcctccgtaggtctcggcagttgatggttcaggaagtggaaagaagtgctaataccttgtcaacttttgatgaatcgacaagtgttctccgaaaggctgaaggtgagtatcaagggcaccgctctttgctgatgcgcacccgtggtatgctctccacgatgcaacgacaagatgttctcgataggatcatcctgaccattgggttcctcgtgttctccttggcggttctctatgttgtctcaagacgtattggcctgttgacactgcaaaggaagctggctgatgctatcagatcaggctcagtatcagctggagacatcttggctaaagtgcaggagggacctgccccaacaaatgctccttatgatgaactgtgattttacttccacccattgtttatacatgagcttacatccagaagcaagcttacctttcagagttcttatttcttattagtacatgttgtctaaagtaacgtttgcccaaaaaggctatactggtgcattaacctgctgttagacttgagttgaaatcggagtatgctttatgttgcttccatcaagcctcaaaactctgtacagttagaatgcattttctcttctcactctacattacctgggacatatactacattactccctccgatccatattacttgtcg

SEQ ID NO: 3976 - DNA, 960 bp, Pseudoroegneria spicata
  misc_feature (4)..(4): n is a, c, g, or t
  misc_feature (8)..(8): n is a, c, g, or t
  misc_feature (10)..(10): n is a, c, g, or t
  misc_feature (13)..(13): n is a, c, g, or t
  misc_feature (22)..(22): n is a, c, g, or t
  misc_feature (36)..(36): n is a, c, g, or t
  misc_feature (46)..(46): n is a, c, g, or t
  misc_feature (68)..(68): n is a, c, g, or t
  misc_feature (70)..(70): n is a, c, g, or t
  misc_feature (75)..(75): n is a, c, g, or t
  misc_feature (130)..(130): n is a, c, g, or t
  misc_feature (145)..(145): n is a, c, g, or t
  misc_feature (163)..(163): n is a, c, g, or t
  misc_feature (184)..(184): n is a, c, g, or t
  misc_feature (298)..(298): n is a, c, g, or t
  misc_feature (313)..(313): n is a, c, g, or t
  misc_feature (329)..(329): n is a, c, g, or t
  misc_feature (333)..(333): n is a, c, g, or t
  misc_feature (352)..(352): n is a, c, g, or t
  misc_feature (376)..(376): n is a, c, g, or t
  misc_feature (418)..(418): n is a, c, g, or t
  misc_feature (558)..(559): n is a, c, g, or t
  misc_feature (568)..(568): n is a, c, g, or t
  misc_feature (583)..(583): n is a, c, g, or t
  misc_feature (607)..(607): n is a, c, g, or t
  misc_feature (609)..(609): n is a, c, g, or t
  misc_feature (649)..(649): n is a, c, g, or t
  misc_feature (670)..(670): n is a, c, g, or t
  misc_feature (688)..(689): n is a, c, g, or t
  misc_feature (691)..(692): n is a, c, g, or t
  misc_feature (700)..(701): n is a, c, g, or t
  misc_feature (703)..(703): n is a, c, g, or t
  misc_feature (715)..(715): n is a, c, g, or t
  misc_feature (733)..(733): n is a, c, g, or t
  misc_feature (736)..(736): n is a, c, g, or t
  misc_feature (787)..(787): n is a, c, g, or t
  misc_feature (793)..(793): n is a, c, g, or t
  misc_feature (807)..(807): n is a, c, g, or t
  misc_feature (811)..(811): n is a, c, g, or t
  misc_feature (826)..(826): n is a, c, g, or t
  misc_feature (829)..(829): n is a, c, g, or t
  misc_feature (856)..(856): n is a, c, g, or t
  misc_feature (889)..(889): n is a, c, g, or t
  misc_feature (904)..(904): n is a, c, g, or t
  misc_feature (932)..(932): n is a, c, g, or t
  misc_feature (939)..(939): n is a, c, g, or t
  misc_feature (950)..(950): n is a, c, g, or t
  misc_feature (954)..(954): n is a, c, g, or t
cganaggncnatntccgcagcngcgcagataatacngatggacgangtcacacaagccgttgaaaacntnaaaanggaatggagccaagcagttgcacagcttgaggtgtgcattgctgcaattgaatcntgtgggaagatgggnaaagggacagaagaagcnatgtctcttcctaggttgaanggttctgcacaggatgcactgcaattgctcaatgcactgcagtgcaggcttgatcttctggcagagcagctacccacttttgaagaagttcagtctggacaggcaaccttaggntcatggaaggaacantatcagaggctgcgtntgancctgaggagtgctaacttncaagcaaaagcgaacattggaaangctgcttaagaagagagggagcttcttctgggaggtggagangagtccactatccggaggcgtaatctccagacaaaggctgggatgacatccgctgcagaaagtattactgagagcctccgtaggtctcggcagttgatggttcaggaagtggaaagaagtgctaataccttgtcaacttnngatgaatcnacaagtgttctccgnaaggctgaaggtgaatatcaaggncnccgctctttgctgatgcgcacccgtggtttgctctccacnatgcaacgacaagatgttctngataggatcatcctgacnntnnggttcctnntnttctccttggcngttctgtatgttgtctcnagncgtattggcctgttgacactgcaaaggaagctggctgatgctatcagatcnggctcngtatcagctggagncatnttgggtaaagtgcanganggacctgccccaacaaatgctccttangatgaactgtgatttacttccatccattgtttntacatgagcttacanccagaagcaagcttacctttcagagttnttatttnttagtacatgntgtntaaagt

SEQ ID NO: 3977 - DNA, 1229 bp, Pennisetum glaucum
gcgaatccccagtcagagtcacgcggcagattcgcacgcgataccacccatcgccataggtgagcgcggcggcaggcagcctctcctcccatcctcctccctcctccatcgaccacacccctgccagccggtcccttgggatctatccatcgcgtcctctgctctgctgctcatggcggctcccactcccaacgacaatcctactgtcagttctctggcagcaactgttccggttcaggcagttctgtttgacattgatggaaccctctgcgattcagatcctctccatcatgtggctttccaggagatgcttcttgagattgggtacaacaacggcgtgccgatagatgaggagttcttcataaaaaatattgctggaaggagtgatgttgaggctgcccagaatctgttcccagactgggagctcgagaagggactcaaattcctagaggacaaggaagcgaagtacagaagtttggcaaaggagcgcttggaacctgtgaaaggccttgggaaagtggttcagtgggtcaaagatcatggctacaaacgtgcagcagtaaccaacgcccctaggattaacgcagagctcatgatctccctccttggcctctcagacttcttccaggccattattgtcggaggcgaatgtgagcaaccaaagcctgccccatacccatacctcaaggccctcaaggagcttcaggtgtctgctgaacacaccttcatctttgaggattctccttctggcatccgtgctggtgttacagcaggaatgcctgtcgtcgccgtggccacaaggaaccctgagaaatcccttctggaagcacgagccagcttgctgatcaaggactatgaggatcccaagctctgggctgcacttgaagagattgatgaagaggaagccaagctaaagaaggctggcgcatgagacggatgacgagaaggctggcacatgagaccggatgacgatgaacatttgtctagatttattagcaaattaaatttgctccccgattacatttctgttattagttatgatgcagccgggaggaactgcatagggctcaactgggtatattttttgagcttctagtttggtattgttttttttcccttaatgagaattgagacccaataagaactgagaaaccttgccttcggtggttatgattgtttgatggattggagactggaagtcattccttagaaatgacaaatctgttgga

SEQ ID NO: 3978 - DNA, 1097 bp, Panicum virgatum
gcagcagataggttgacaagtgtcctgctggtgggcccagggagcagcaggccgctcgctgctgggccacacaaaggaaacaggggagaggagatccaaaataacaagaaactccagcagattgcgaaacccatctgcgcctcctcctcctcgatcgagagagggagctcgctcatctcatctcatctcatctctctccgcccccgccggccggtcttctcgcccggggcccttcctccggatcctggatcgatcgcctgttcggcacatggcggctcccactgccaacggcaattccactgtcagctctcttgcaacaactgttccggttcaggcagtcctgtttgatattgatggaactctctgcgattcagaccctctccatcatgcggctttccaggaattgctcctcgagattgggtacaacaacggcgtgcccatagatgatgagttcttcatcaaaaatattgctggaaggagtgatgttgaggctgcccagaatttgttcccggactgggaccttgaaaaggggctcaagttcctagacgagaaggaagctaaatacagaagtttggcaaaagagcgcttggaacctgtgaaaggccttgggaaagttgttcagtgggtcaaggatcacggctacaagcgtgcagcagtgaccaacgcccctaggattaacgcagagctcatgatctcactccttggcctctcggacttcttccaggccattattatcggaggtgaatgtgagcagccgaagcctgccccatacccgtacctgaaggccatcaaggagcttcaggtgtctgcagaacacaccttcatcttcgaggattctgcttctggcatacgtgctggtgttgcagcaggtatgcctgtcgtcgccgtggcaacgaggaaccctgagaaatcccttctcgaagcaggagccagcttgctgatcaaggactatgaggaccccaagctctgggctgcgcttgaggagatcgacagagaggaagctaagctaaagaaggccagcgaatgagatgacaatgaacaattgattacatttattagcaaattaaatttaccctgtgttgcagctgaaggaacag

SEQ ID NO: 3979 - DNA, 1273 bp, Panicum virgatum
taaaaagaaactcgagcagattcgcgaatcccatcggcgctagcgctgcggcatctccgatcctcctcctgtcctccacaaccccaacccctctcctcctcgatcaagagagggagctcgcccccgccggatcctggatcgatcgcctcgcctgctctgcacatggcggctcccactgccaacggcaatcccactgtcagctctcttgtaaccactgttccggttcaggcagttctgtttgatattgatggaactctctgcgattcagaccctctccaccatgtggctttccaggaattgctcctcgagattgggtacaacaacggcgtgcccatagacgatgagttcttcatcaaaaatattgctggaaggagtgatgttgaggctgcccagaatttgttcccagactgggaccttgacaaggggctcaagttcctagaggagaaggaagctaaatacagaagtttggcaaaagagcgcttggaacctgtgaaaggccttgggaaagtggttcagtgggtcaaggatcacggctacaagcgtgcagcagtgaccaacgcccctaggattaacgcagagctcatgatctcactccttggcctctcggacttcttccaggccattattattggaggtgaatgtgagcagccgaagcctgccccatacccgtacctgaaggccatcaaggagcttcaggtttctgcagaacacaccttcatcttcgaggattctgcttctggcatacgtgctggtgttgcagctggaatgcctgttgtcgccgtggcgacgaggaaccctgagaaatcccttctggaagcaggagccagcttgctgatcaaggactatgaggaccccaagctctgggctgcgcttgaagagatcgacagagaggaagctaagctaaagaaggccagcgcatgagatgacgatgaacaattgattagatttattagcaaattaaatttaccctgtgttgcagctcaattgggtatattttgagcttctagtttggtattgtttcttttttttctctctcgatgggttgaaaccaaataagagctcagaaatcttgccgtgggtggttatgattgtttgatggatgggactcactccgtgaaaatgacaaatctggtgggtcttgttgcgtaccatctctgaataattgactggttgcttcatcactcttgacttggtgatgtgaaagaaagatggcaattccttcgactcctagaaactgtgttgaaatgatttgtgaattacattcattcgtcga

SEQ ID NO: 3980 - DNA, 1178 bp, Panicum virgatum
ttcgcgaaacccatctgcgcctcctcctcctcgatcgagagagggagctcgctcatctcatctcatctcatctctctccgcccccgccggccggtcttctcgcccggggcccttcctccggatcctggatcgatcgcctgttcggcacatggcggctcccactgccaacggcaattccactgtcagctctcttgcaacaactgttccggttcaggcagtcctgtttgatattgatggaactctctgcgattcagaccctctccatcatgcggctttccaggaattgctcctcgagattgggtacaacaacggcgtgcccatagatgatgagttcttcatcaaaaatattgctggaaggagtgatgttgaggctgcccagaatttgttcccggactgggaccttgaaaaggggctcaagttcctagacgagaaggaagctaaatacagaagtttggcaaaagagcgcttggaacctgtgaaaggccttgggaaagttgttcagtgggtcaaggatcacggctacaagcgtgcagcagtgaccaacgcccctaggattaacgcagagctcatgatctcactccttggcctctcggacttcttccaggccattattatcggaggtgaatgtgagcagccgaagcctgccccatacccgtacctgaaggccatcaaggagcttcaggtgtctgcagaacacaccttcatcttcgaggattctgcttctggcatacgtgctggtgttgcagcaggaatgcctgtcgtcgccgtggcaacgaggaaccctgagaaatcccttctcgaagcaggagccagcttgctgatcaaggactatgaggaccccaagctctgggctgcgcttgaggagatcgacagagaggaagctaagctaaagaaggccagcgaatgagatgacaatgaacaattgattagatttattagcaaattaaatttaccctgtgttgcagctgaaggaacggcaaagggctcaattgggtatattttgagcttctagtttggtattatttcccttttctcgatgaactgaaaccaaataagaactcagaaatcttgccgtgggtggttatgattgtttgatagatgggactcactccgtgaaaatgaaaaatctggtgggtcttgttgcgtaccatctctgaatactgacttgttgcttcatc

SEQ ID NO: 3981 - DNA, 1157 bp, Panicum virgatum
cgcgaatcccatcggcgctagcgctgcggcatctccgatcctcctcctgtcctccacaaccccaacccctctcctcctcgatcaagagagggagctcgcccccgccggatcctggatcgatcgcctcgcctgctctgcacatggcggctcccactgccaacggcaatcccactgtcagctctcttgtaaccactgttccggttcaggcagttctgtttgatattgatggaactctctgcgattcagaccctctccaccatgtggctttccaggaattgctcctcgagattgggtacaacaacggcgtgcccatagacgatgagttcttcatcaaaaatattgctggaaggagtgatgttgaggctgcccagaatttgttcccagactgggaccttgacaaggggctcaagttcctagaggagaaggaagctaaatacagaagtttggcaaaagagcgcttggaacctgtgaaaggccttgggaaagtggttcagtgggtcaaggatcacggctacaagcgtgcagcagtgaccaacgcccctaggattaacgcagagctcatgatctcactccttggcctctcggacttcttccaggccattattattggaggtgaatgtgagcagccgaagcctgccccatacccgtacctgaaggccatcaaggagcttcaggtttctgcagaacacaccttcatcttcgaggattctgcttctggcatacgtgctggtgttgcagctggaatgcctgttgtcgccgtggcgacgaggaaccctgagaaatcccttctggaagcaggagccagcttgctgatcaaggactatgaggaccccaagctctgggctgcgcttgaagagatcgacagagaggaagctaagctaaagaaggccagcgcatgagatgacgatgaacaattgattagatttattagcaaattaaatttaccctgtgttgcagctcaattgggtatattttgagcttctagtttggtattgtttctttttttctctctcgatgggttgaaaccaaataagagctcagaaatcttgccgttggtggttatgattgtttgatggatgggactcactccgtgaaaatgacaaatctggtgggtcttgttgcgtaccatctctgaataattgactggttgcttcatc

SEQ ID NO: 3982 - DNA, 1158 bp, Setaria italica
cgatacccatcggccatcctcctccatcgaccacacccccgccggccgctcccttcggatccatccatcgcgtcctctgctctgctctgctcatggccgacggcaatcccactctcggctctcttgcaacaactgttccagttcaggccgttctgttcgacattgatggaaccctctgcgactctgaccctctccatcatgtggctttccaggagctgcttcttgagattgggtacaacaacggtgtgccgatagatgacgagttcttcataaaaaatattgctggaaggagtgatgttgaggctgcccagaatctgttcccagactgggaccttgagaagggcctcaaattcctagaggacaaggaagctaaatacagaagtttggcaaaagagcgcttggaacctgtgaaaggccttgggaaagtggtccaatgggtcaaagatcatggctacaaacgtgcggcggtaaccaacgcccctaggattaacgcagagctcatgatctcccttcttggcctctcggacttcttccaggccgttattgttggagatgaatgcgagcaaccaaagcctgccccatacccatacctgaaggccatcaaggagcttcaagtgtctgctgaacacaccttcatctttgaggattctccttctggcatccgtgctggtgtcgcagcaggaatgcctgttgtcgccgtggcgacgaggaaccctgagaaatcccttctggaagcaggagccagcttgctgatcaaggactatgaggaccccaagctctgggctgcacttgaagagatcgacagagaggaagcgaagctaaagaaggctggcgcatgagatgggatgacgatgaacaattgtctagatttattagcaaattaaatttacatgatgcagccgagaggaacggcaaatggctcaactgggtatatttttgagcttctagtttggtattattttttgttcttaatgagaattcagaccaaataagaactcagaaatctcgccttcggtggttatgattgtttgatggatgggaggctgtgagtcactccgtggaaatgacaaatctgttgaaccttgttgcgtagcatctcttaattgttgcttcagtcctcttgacttgctgatctgaaagaaagatggcaatttcttt

SEQ ID NO: 3983 - DNA, 1586 bp, Sorghum bicolor
aaccaaggcgagacgacgcggccgggccacagaaacaggggagacaaggacagatccaaaattccctggatctgtgtaagaaaaaaaaaagagaagattttctgtgtataaagctcgcgccacgggagtccccgcacgcggacgccggcacattcgcgaaacccatcgcatcggccatccccgcggctgcctcctcctcgatccatccgggagagatttctcttgcctgctcgtctctctcgcacccgccggccggccggtgctcttcccggcccacttcgtttcgatcgaccatggcggcttccgtccccaacggtagtcccactgtcagctctctcgcgacgactgttcccgtccaggcggttctgttcgacatcgacgggacgctgtgcgactcggatcccctccaccatctcgctttccaagagctgcttctcgagattgggtacaacaacggtgtgccgatagacgacgagttcttcatcaagaacatcgctgggaggagtgacgtcgaagctgcccagaacctgttcccggactggccccttgagaaggggctcaaattcctggatgacaaggaagcgaaatacagaagtttggcaaaagagcgcttggtacctgtaaagggcctcgagaaagtggttcagtgggtcaaagaccacgggtacaagcgcgcagcagtaaccaatgccccaaggatcaacgcggagctcatgatctcccttctgggcctgtcagacttcttccaggccgttatcattggaggcgaatgtgagcagccaaagcctgcgccatacccttacctcaaggccctcaaggagcttgaggtgtctgcacagcacaccttcatctttgaggattctccttctggtatacgggcaggcgtcgcagcaggaatgcctgttgttggtttagtgacaaggaacccagagaactcattgctggaagcaggagccgcgttgctcatcaaggattacgaagatccaaagctctgggcagcacttgatgagatcgacagagaggaagcgaagctgaaggctagcgcatgatatgatctgatgataaacaattgattaattagatttattgccgatcgaagttggctcaaatacatttctgttcctagttatgctgcagctgtgaccgtgagtaacggcagagatagctcatcagggtctttttgagactagtttggtatattatgtccttttttcttgatggaactgaagactaaataagaactcaggagtcttctgccagcggttacgattgtttggtggatacgagtatgggattcgctctgtgaaaattgactaagcagttgtgcctcgttgcgtatcatctgtgtattaactttgttgcttctgttagtcgctggatccttgctctaggagtgagcaggatccttactctcattgagaggatagcacactgagttggggcaattttctggatttatttctcacacaatgctataccaacctgagggattggggatacatatttatagggctgctaaccagccagcatatgccaagatgctagtctaagatgctgtcctacagatgctaactgctgtcctaaaa

SEQ ID NO: 3984 - DNA, 824 bp, Panicum virgatum
ggctggcactgatccatgccgtcaaacctttgcagctctcttgcaacaactgttccggttcaggcagtcctgtttgatattgatggaactctctgcgattcagaccctctccatcatgcggctttccaggaattgctcctcgagattgggtacaacaacggcgtgcccatagatgatgagttcttcatcaaaaatattgctggaaggagtgatgttgaggctgcccagaatttgttcccggactgggaccttgaaaaggggctcaagttcctagacgagaaggaagctaaatacagaagtttggcaaaagagcgcttggaacctgtgaaaggccttgggaaagttgttcagtgggtcaaggatcacggctacaagcgtgcagcagtgaccaacgcccctaggattaacgcagagctcatgatctcactccttggcctctcggacttcttccaggccattattatcggaggtgaatgtgagcagccgaagcctgccccatacccgtacctgaaggccatcaaggagcttcaggtgtctgcagaacacaccttcatcttcgaggattctgcttctggcatacgtgctggtgttgcagctggaatgcctgtcgtcgccgtggcaacgaggaaccctgagaaatcccttctcgaagcaggagccagcttgctgatcaaggactatgaggaccccaagctctgggctgcgcttgaggagatcgacagagaggaagctaagctaaagaaggccagcgaatgagatgacaatgaacaattgattagatttattagcaaattaaatttaccctgtgttgcagctgaaggaac

SEQ ID NO: 3985 - DNA, 1278 bp, Oryza sativa
aagacgagaagcagcataaaagtgcgggcccacaaaacgaggggcccccaacccaagcctcccctgtccgtgatagagaagagaatagaaaggctttaaaaccggcacgagagattccgccgcggccacagatttcggtgctcctcctcctcctccccctcctcgccgctgatctctcccgtccgtcccctcgcctccctcaccaccgcggcggcatcagggctctcccccccatggcggccgccactcccaacggcatcccagcttccagacctctggcttcatcagttccaattgaggcagttctgttcgacattgatgggaccttgtgcgactcagatcctcttcatcatgtggccttccaagaaatgcttcttgagattgggtataacaacggtgtgccaatagacgaggagtttttcataaacaatattgctggaaggagtgatgttgaagctgctcagaatttgttccctgattggccccttgagaaggggctgaaattcctcgaggacaaggaagctaaatacagaagtttggcaaaggagcgtttggaacctgtaaagggccttgctaaagtggttcagtgggtcaaagatcatggatacaagcgtgcggctgtaaccaatgcccccaggattaattccgagctcatgatctcccttcttggcctcacagatttcttccaggccgtcatcgttggaggcgaatgtgagaagccgaaacccgccccattcccctacctgaaggctctcaaggagcttcaggtgtctgcggaccacaccttcatctttgaggattctgcttcaggcacacgtgcaggcgttgctgctggaattcctgttgttgctgtggcaacaaggaacccagagaagtccctactggatgcaggagccacgttgatcatcaaggattatgaagaccccaagctttggagcgcacttgaagagatagacagagaggaagccaagctaaagaaagctgatgcatgagatgagggttctcgattagatgatatattgcaggtttagctccttttgcatttgcagtaatattgtagccgaagtgatggcgcacagagctcatctttgcacttttgagcttctgtggttttattattctttgttgctactcagcctattgagttggtacagagaaataaagacccaaaactcccattgagttattctttatggatggatgttacttctgagaagtttcaggggtgatcttgttcatcctgccaaaactattgcatttgcttggcttcttgttatc

SEQ ID NO: 3986 - DNA, 1282 bp, Panicum virgatum
  misc_feature (688)..(688): n is a, c, g, or t
gtctataaagaaacctcacgagagggggggagtcgctcgcgcaaagcagattcgattcgcgaggacggagaggaggagacccggcgccgccgggcggccatcgcatcccctccctccttcctgacctccccctactccatccatcgatccatcgaccgaggcgctcatggctgcttccactcccaacggcaatcaaactgtcagatttcgagctcatccaaacaaggccgagttgccgtcgtccatgatctgcagctctctggcggccactgccccggtccaggcggtgctgttcgacatcgacgggacactctgcgattccgacccccttcaccatgtggctttccaagagctgcttctcgagatcggttacaacaatggcgtgccgatagatgaggagttcttcatcaagaacatcgctgggaggagcgatgtagaagccgcgccagaacctgttcccggactgggagctcgagaaggggctcaagttcctggaggacaaggaagccaagtacaggagcttggcgaaagagcgcctggaacctgtaaaaggctcggcagagtggtccagtgggtcaaggaccatggctacaagcgcgcggcggtgaccaacgcgccgaggatcaacgccgagctcatgatctcccttcacggcttctcggacttcttccagccgtcatcgtcggangggagtgcgagcagccgaagcccgcgccgtacccgtacctcaaggccctcaaggagcttcaggtttctgcagaccacaccttcatctttgaggactctccttctggcatccgggctggcgtcgctgcaggaatgcctgtcgttggtgtggccacaaggaacccggagaattccctgctggaagcaggagcggcattgctcatcaaggattatgaagatcccaagctctgggcagtgcttgaagagatcgacagagaggaagcgaagcacaagaaggccagcgaataagatgatgatgatgataatgatgatgatcaaacattgattagatttattgctgattaaaattcgccttgcatatattcattcatgttcctagtagttatgctgccgctgagagtaacggcagagctcagctcttctggcctgggtgtttttgagcttctagtttggtattgtttcttttttcttgatgaattgcttgaaaccaaataagaaatcaggaactctgccgtgggtggttatgattttttgatggatgtgacttgctccctcaaaatggtaaatacgttgggccttgttgcacccatctctg

SEQ ID NO: 3987 - DNA, 1374 bp, Brachypodium distachyon
ggccaaagtgccaaacggcaagcgaacggactcctcctataagagaggaggaagaactgaagggcggccaagcgccaccacagattccttcatccggtcgatcgaagcagccagtccctgatctgctcgattccaagaaggaggaaccccgatcgatccctagtcttcttcgatcgatctccatcccactgtcatggctgcggctcccaacggcggcgccgtcagttctctaccggcgacggttccagtggaggcggtgctgtttgacatcgacgggaccctgtgtgattcggaccctcttcatcatgtggctttccaagaattgcttctcgcgatcgggtacaacaatggtgtgccgatcgacgatgagttcttcataaagaacattgctggaaggagcgatgttgaagctgctcaaaacctgttcccggactggccgcttgaaaaggggctcaaattcctcgaggacaaggaagtcaaatacagaagtttggcgatggaacgcttggagcctgtaaaaggccttggcaaagtggttcagtgggtgaaagatcatggctacaagcgtgctgcggtaaccaatgcccccaggatcaatgcagagctgatgatcaaacttcttggcctatcagacttcttccaggccgtgatcgtcggaggcgaatgcgagaagccgaaacctgcccccttcccttacctgaaagccctcaaggagctagatgtatctgcagcacacacatttatctttgaggattcggcttcagggacaagtgcaggcgtcgccgcaggaatgcctgtcgtcgccgtgctgacaaggaacccagagaagtcgctgttggatgccggagcttcattgattatcaaggactacgaagaccccaagctctggactgtgcttgaagagatcgatagagaggaagccaagctgaagaatagtggagcgtgaaatgatcctaatggtgataaacaagtcgattagattcattgccaagttaccactcttacgattagtagagctcatcttgagcttttatattgatatgttttctcttttctcgattaatacgcaatgaaataaacaaaaactccagtctcccatgacttaggttgtgtgcggatgggacttgcgaaaattctgattctgttgggctctggattatgacccttgtacacttcagatcactccaaactgattggatttctttttatttatctggaagaaatataccagatgagagatgatacgatggatgttgcaatgagaactgcgatgaataaaacggttcacttcagaaataagaggatcagaacgcgcaggagtaaagagaaagaacaaatcaagttttgattaattctttcagaaaccagtttttg

SEQ ID NO: 3988 - DNA, 809 bp, Festuca arundinacea
  misc_feature (453)..(453): n is a, c, g, or t
ggcacgagggcggtcagtccctgattcggaggagtccacgatcctgatcctactgccatggcggctcccaacggcgcctccgccgtcagtcctctcgcggcgatggttccggttgaggccgttttgttcgacatcgacggaaccctctgcgattcggaccctcttcaccatgtggccttccaagaaatgcttctcgcgattgggtacaacaatggcgtccccatagatgaggagttcttcatcaaaaacattgctgggaggagcgatgttgaagctgctcagaatctgttcccggactggccacttgagaagggcctcaagttccttgaggacaaggaaaccaaatatagaagtttggcgatggagcgcttggagcctgtaaacggccttggcaaggtggttcagtgggtgaaagatcacggctacaagcgtgctgcagtgaccaatgccccnaggatcaatgctgagctgatgctcaaacttcttggtctgtcggacttcttccaggccgtgattgttggaggtgaatgcgagaagccaaaacccgcccccttcccgtacctcaaggccctcaaggagctgggtgtgtctgcagaacacaccttcatcttcgaggattccgcttcaggcacacgtgctggcgttgccgcgggaatgcctgtcgtcgctgtgctgacgaggaacccagagaactccctacaggaggctggggccgcgctgatcgtcaaggactacgcggaccccaagctctggagcgccctcgaagagatcgacgcagcggaagctaagctgaagagcggcggagcttg

SEQ ID NO: 3989 - DNA, 3986 bp, Hordeum vulgare
gcgtcaaacttcccgccatttgcgccaccaccaagcccccgatgccatcctcgccagcgccgcgccgccgcccgccggcggcggcgaccagcaccgccctcctcccgcggctccggctcgcggtcggccatacctccccgcgccgcctcctcctccaatccctagcgctggtcctcacctccaacctctcatccacccacgccgccgtctcctcccgcctcctcaactccctcctgccgcacctccccgccagccacccccacctcctccgcttcctccccttcgaccacctcaccctcctcctcctctcctccggcagccccaaccgccacaccatctaccccctccccgccgcctcatccctccacgcgctcgccgtccgctcgggacacctgcccgccgacctccgcctcgccaactcgctcctggcgcgctacctcgcgcacggctcccacgcctccgcgcgccgcctctttgccgacgtcccccgccccgacgccgtcacctggaacaccctcctccgcgcctgcctccgctccggcctcctcccctccgcacgccacctgttcgaccaaatgcccgtgcgcgacctcgtctcctacaactccatgctgtccggccatgccgcggccggggacatggacggcgcacggcagctgttcgacgggatgcccgagagggacgtggtctcctggaactcgatgctggccgggcacacccgctgcggagacatggaggaagccaggaggatgtttgatgcgatgccggagagggacgtcgtgtcgtggaactcgatgctggacgggtacgcccaggccggtgacgtcctggcggcgagggccgtgttcgacggcatgccgaggaggagcactgtgtcctggaatgtcgtcctggcgctgtacgcgcgggtgaagaactggcgggagtgcctgaggctgtttgacgcgatgatggcggtgggggctgccgtgccgaacgagaagaccttcgtgagcgtcctgacggcctgcggcagcctcggtgatctcgagaggggaaagcgggtgcacgacctggtccgacagaggtgggagacgctcgtgccggacgtcctcctgctcacggcgctgctgactatgtacgccaagtgcggggtgatggaggctgcgagggtgatcttcgactcgatgggcgagaggagcgtcccgtcttggaactcgatgatcatcggctacgggctgcatgggcagagcgagaaggcgctcgagctgttcctggagatggagcgaactgggccaaggccgaacgagacgacctttgtctgcgtcctgagctcgtgcgcccacggcggcctggtgctcgagggctggtggtgtttcgacaggatggtcaggctctacggcgttgagcccaaggccgagcacttcggctgcatgatggacctcctcggccgcgccgggctgctcacagactccgacacccttgtccagaacctgcaagagaaggcgtcccctgcgttgtggggcgccatggtctcggcctctcgggcgcagaacggctccaggctcggggagtttgtcgggaagaagctgatcgagatgaggccgaaggaggttggcccgtacgtgctgctctcgaacatctacgccgcggaagggaggtggaacgacgtcgagaaagtgagggagatgatgaaggggaacggggccgaaaaggacgtcgggctgagcctcgttggatcaagtgaaccagagcaccgtattggtactgaagatggcgttgttctgtcgatgctgggcgagattggcgcacatctgaagctgccgtccgtggagcccaagcgcatggaagggaggctgtgactaggagatgttgtgtgagtgactccaccggaccggagggcatgcatgttgcagcctcccttgagcaagaagatctgacgccttgtatgccgttgctgatcgtggagccggagcatcaggctcctactacactactggtgcttgtgttgtgccggggccaatggccgaagaaatgaaagccgggagtgactgctggctgatgggcaagccacggaacttggaaaagagatttgtaggtcgaaggcttgagaaggaagacgaagcagagtcagtggaggttcttgttgtgctccagctctttccagtgggcggctggctactcaactgatcaggtgatgcgatgtgatgatgatggcatcagctgagcgacgggcggacggacggcgtctgcagcaagctgcaagaggtatttgttccttggacagggtaggatgctagccagcctcgtgggcatgagtggaccgtccggtggaattggcattaggatctgtataatagaaggacgaggggaaaaggaacatgacaagtgcgagagcatattccacctcttttttgactaggcatattccacctgttggcaaacatatgcgtccaacgttttcgtgaccaccatttgcctctaaggaacagtaaaattgttgcaactattactgttttacatttttttttccgtcaggcagtttttttttttcatttttttcgcctcctgtgagccccacctggcatggagatggctgtgttgcccaacagagggggaaagaaagaggcgagcagcagaagacgaggccagcccaagaaatcagggatcgatcgatcggatccaactccgtccagtgcatcggtcctataagacgaggacgagccaccgccccttcacccaacatacctcctccatctgcctgccgcgagagtcctccactccacaacaaccatcgagaaacaagcgcctaattcttctctcgcgccatggcgtccaccaatggcggctttgccagtcctctcgcagcgaccgttccggttgaggcggttctctttgacatcgatggcactctgtgcgactcagaccctcttcatcacgtcgctttccaagaaatgcttcttgcgattgggtacaacaacggcgtgcccatagacgacgagttcttcataaacaacattgctggaaggagcgatgttgaagctgcccagaatttgtttccagactggcctctcgaaaaggggctgaaattcctagaggagaaagagatcaaatacagaagtttggcaatggagcgcctagagcctgtaaagggacttggcaagctggttcagtgggtgaaagatcacggctacaaacgtgctgcagtaaccaatgccccaaggatcaatgcagagctgatgatcaaacttcttggtctatcagacttcttccaggccgtgatagttggaggtgaatgcgagaagccaaagcccgcacccttcccatacctgaaggccctcaaggagctcgaagtatctgcggcacacacctttatcttcgaggactctgcttcagggacgcgtgcgggtgttgctgcggggatgcccgtcgtcgccgtgttgacgaggaacccggagaagtccctagaggaagccggggccgcattgatcgtcaatgactatgaagaccagaaactgtggaacgcgctcgaggagattgacagggaggaagcgaagctaaagagtggtggggcatgagacgatgatggcgacgaacagttcattagaccactgcaaacttacccattcttattatttataagggaatctgcgccctgaagttattatggtaggacagagctcatctaggtattttgagctttttagtttggtatatgtgtttgtttcttgttgtctattccttctgtacctaaatacttgtagttggggagcttctggacctaaatatttgtagttggggaggtacagagggagcaggagagaagcaaataagaaacttttgtgcccatgacatgagattgttcggttgatggggcctatgaaaatggcatatctatcaggcccattgcctaccagctctgaattttgactggtgagcactctgtttgattgagctttgctttattattaatctgaaaacaatatgataatgatggacatcgcaat

SEQ ID NO: 3990 - DNA, 1267 bp, Triticum aestivum
ccgcagaagacgaggacagcagcccaacaagcagggatcgatcgatcggatccaactctgtccgtccgtgctataagacgagccaccgcccggttcccaaattcctcctccgtctgcctgccttccgcgaccgccagagtcctgcactccacaacaaccatcgacaacaagcgcccgagcacgcggccgcgatctctcgcccacccaccacccgcgccatggcttccaccaatggcggcgccgtcagtcctcttgcagcgaccgttccagttgaggcggttctgtttgacattgatggtaccttgtgcgactcggatcctcttcatcacatcgctttccaagaattgcttcttgcgattgggtacaacaatggtgtgccgattgacgatgagttcttcataaacaacatcgctggaagaagcgatgctgaagctgcccagaatttgttcccagactggcccctcgaaaaggggctgaaattcctagaggacaaagacgtcaaatacagaagtttggcgatggagcgcctagagcctgtaaagggcctccacaaggtggttcagtgggtgaaagatcacggctacaagcgtgccgcagtaaccaatgccccaaggatcaatgcagagctcatgatcaaacttcttggtctatcagacttcttccaggccgtgattgttggaggcgaatgcgagaagccaaaacccgccccctttccatacctgaaggccctcaaggagctcgaagtgtccgcagcacacaccttcatcttcgaggattccgcttcagggacacgcgcaggcgttgccgcgggaatgcccgtcgtcgccgtctcgacgaggaacccggagaagtccctacaggaagctggggccgcattgatcgtcagtgactatgaagaccagaagctgtggaacgcgctcgaggagattgatagggaggaagcgaagctaaagactggtggggcctgaaaaagatgatggtgatgaacagttgattagaccactgcaaatttacccattcttattatttataagggaatctacgccctgaagttattatggtaggacagagctcatctaggtattttgagctattagtttgatatatgtttcttttggttctctagtagagaatcaaataaaaaacttttgtgtcccacacatgagatttgttcgcttgatgggacctatgaaaatggcatatctgtcaggctcattgtctactggctctgatttttgactgttgagcgctctgtttgattgagctt

SEQ ID NO: 3991 - DNA, 1134 bp, Triticum aestivum
gcgcgcgcgcacgcacggaggcggccgcgatctctcgcccacccaccactcgcgccatggcttccaccaatggcggctttgtcagtcctcttgcagcgaccgttccagttgaggcggttctatttgacattgatggtaccttgtgtgactcggatcctcttcatcacgtcgctttccaagaattgcttcttgcgattgggtacaacaatggtgtgccgattgacgatgagttcttcataaacaacatcgctggaagaagcgatgctgaagctgcccagaatttgttcccagactggcccctcgaaaaggggctgaaattcctagaggacaaagacgtcaaatacagaagtttggcgatggagcgcctagagcctgtaaagggcctccacaaggtggttcagtgggtgaaagatcacggctacaagcgtgccgcagtaaccaatgccccaaggatcaatgcagagctcatgatcaaacttcttggtctatcagacttcttccaggccgtgatagttggaggtgaatgcgagaagccaaagcccgcgcccttcccgtacctgaaggccctcaaggagctcgaagtgtccgcagcacacaccttcatcttcgaggattccgcttcagggacacgcgcaggtgttgccgcgggaatgcccgtcgtcgccgtctcgacgaggaacccggtgaagtccctacaggaagctggggccgcattgatcgtcagtgactatgaagaccagaagctgtggaacgcgctcgaggagatcaacagagaggaagcgaagctaaagaatggtggggcgtgagacgatgatggtgatgaacagttgattgaccactgcaaatttacccattcttattatttataagggaatctacgccctgaagttattatggtaggacagagctcatctaggtattttgagctattagcttgctatatgtgtttctctttgttgtctagtagagaatcaaataaaatactttagtgcccatgacatgagatttgttctgttgatgggacctatgaaaatggcatatctgccaggctcattgcctaccagctctgaattttgactgttgaccactctgtttgattgagcttctctttatattaatctgaaaacaatatgg

SEQ ID NO: 3992 - DNA, 1470 bp, Brachypodium distachyon
taacggagcatttgccgagttgttatacgccagaaaaaatgtgagcgccccggtggacggtggtgattattcagtagatcgaaatgtggggagtaaaaaagagttcttttttggtacgttgtctacaactgctaatctgttatgtgtaggtcaaggctcgatttttgtctctttctctctctctcctagtagcgctggaccgcaccgcagcagaagccagaagacaagggccaaggccaacccaggaaatcaggggggatcggatccaactccagtctccagaagcccgcggatcgatcctataagaaggccagagattcattactcgggagtgaagctagccagccattcatccatccatctgcggcgagaatccctctcctccacaacaagagcgagcacgcacgcagcagctgggatcgatcgattctcaccatggtgaccaccaatggcgtcctcagttctctcgcagcaacggttccggttgaggcagttctatttgacattgatggcaccctgtgtgattcagaccctcttcatcatgtcgctttccaagaaatgcttcttgcgatcgggtacaacaacggtgtgccgatagacgaggagttcttcataaataatattgctggaaggagcgatgttgaagctgctcagaatttgttcccagactggccccttgagaagggactgaaattcctagaggacaaggaaaccaaatacagaagtttggcaattgagcgattggaaccagtaaatggccttggcaaagtggtgcagtgggtcaaagatcatggctacaagtgcgccgcagtaaccaatgcccccaggattaacgcagagctcatgatcaaacttcttggtctgtcagacttcttccaggccgtgatagtcggaggcgaatgcgagaagccgaaacctgcccccttcccgtacctgaaagccctcaaggagcttggagcgtccgcagcacacacctgtatctttgaggattccgcttcagggacacgtgcaggcgttgccgcaggagtgccggtcatcgctgtgttgacaaggaacccagagaaatccctgcaggaggctggagccgcattgattgtcaaggactatgcagaccccaagctgtggagcgtgctggaagagatagacagggaggaagcaaagttgaagaatgtttgagcatgatataatggtgaccaattggttagatccgttgcatagttaccccttatctaccgatcaaaggagttctgcagcctaaagtaattgtagtttgagcttttagtttgatacacttttctttcttttttctttcttgattgctagtagagaaataaataaaataaatttagtctcaatgaattgacattgttctatggctgtgacatatcagactgccctatttatcactggctgcgacacctctgaatactctagctctcttactcatcagatcatctctatttgactgaa

SEQ ID NO: 3993 - DNA, 1521 bp, Secale cereale
tgtttgctttgcttgtgtgggaattcggatctgtggaaaggcaaaatctagagtggcaaaatcaaattttccctagtaaaattgttgcaactgtaccctttttctctctgtattttaccattattatttaatcgtgtgggccccacctggcagcaaggcggcgccttggcccacttgcaggttacaaagcagaagaagagaggaggaagagtcgcggcagaagacgaggcgagccaggcagcagcccaagaaatcggggatcgatcggatccaactccgtccgtctccgtccgtcctataagacgagccaccgccagactcctcctcctcctcctgccttccttccgccagactccgccactccacaacaaccatcgagaacaagcgcgcacgcggccgccatctctcacccacccaccactcgcgccatggcatccaccaatggcggcggcgtcagtcctcttgcagcgaccgttccagttgaggcggttctgtttgacattgatggtaccttgtgcgactcagatcctcttcatcacgtcgctttccaagaattgcttcttgcgattgggtacaacaatggcgtgccgattgacgatgagttcttcataaacaacatcgctggaaggagcgaagttgaagctgcccagaatttgttcccagactggcccctcgaaaaggcgctgaaattcctagacgaaaaagaggccaaatacagaagtttggcgatggagcgcttagagcctgtaaaaggccttagcaaggtggttcagtgggtgaaagatcacggttacaagcgtgctgctgtaaccaatgccccaaggatcaatgcagagctcatgatcaaacttcttggtctatcagacttcttccaggctgtgataattggtggtgaatgtgagaaaccaaagcctgcacccttcccgtacctgaaggccctcaaggagctggaagtatctgcagcacacacctttatcttcgaggattccgcttcagggacacgagcaggcgttgctgcggggatgcccgtagtcgccgtgttgacgaggaacccggagaagtccctacaggaagccggggccgcattgatcatcaatgactatgaagaccagaagctgtggaacgcgctcgaagagattgacagagaggaagcgaagctaaagaatggtggagcgtgagacagatgatggtgatgaacaattgattagaccgctgcaaatttacccattctgattatttataagggattctacaccctgaagttattatggtaggacaaagctcatctaggtatgctgagctttttagtttggtatatgttttgtttcttcttttcttggagagaagcaaataaattactttagtgcccatggcatgagattgttcggttgatgggacctatgaaaatggcacatctgtctgggctcattgcctaccagctctgaattctgactgttatcttgtgaccactctgtttgatgagcttctctttattattataatctgaaaacaatatgataa

SEQ ID NO: 3994 - DNA, 1300 bp, Triticum aestivum
gatccaaaactctgtccgtccgtccgtgctataagacgagccaccgcccctcgcccagattcccaaattcctcctcctgcctgcctgctgccgcgagagtcctccactccacaacaaccttcgagaacgagcgcgcgcacacgcacggaggcggccgcgatctctcgcccacccaccactcgcgccatggcttccaccaatggcggctttgtcagtcctcttgcagcgaccgttccagttgaggcggttctgtttgacattgatggtaccttgtgtgactcagatcctcttcatcacatcgctttccaagaattgcttcttgcgattgggtacaacaatggtgtgccgattgacgacgagttcttcataaacaacatcgctggaagaagcgatgctgaagctgcccagaatttgttcccagactggcccctcgaaaaggggctgaaattcctagaggacaaagacgtcaaatacagaagtttggcgatggagcgcctagagcctgtaaagggcctccacaaggtggttcagtgggtgaaagatcacggctacaagcgtgccgcagtaaccaatgccccaaggatcaatgcagagctcatgatcaaacttcttggtctatcagacttcttccaggccgtgattgttggaggcgaatgcgagaagccaaaacccgccccctttccatacctgaaggccctcaaggagctcggagtgtccgcagcacacaccttcatctttgaggattccgcttcagggacacgcgcaggtgttgccgccggaatgcccgtcgtcgccgtctcgacgaggaacccggagaagtccctacaggaagctggggccgcattgatcatcagtgactatgaagaccagaagctgtggaacacgctcgaagagattgatagggaggaagcgaagctaaagactggtggagcctgaaaaagatgatggtgatgaacaattgattagaccactgcaatcttacccattcttatgatttaagggattctacgccccaaagttattatggaagggcagagctcatctaggtattttgagctattagtttggtatatgtgtttctttttattgtctagtagaaaatcaaataaaaaactttagtgccgatgacatgagatttgttctgttgatgggacctatgaaaatggcatatctgtcaggctcattgcctaccaactctgtattttgactgtttgaccactctgtttgattgagcttctctttattaatatgaaaacaatatggtaatgatggacatcgcaacgtcgactgctcctttaaa

SEQ ID NO: 3995 - DNA, 1010 bp, Avena sativa
agccccctcgcggcgacggttccggttcaggcggttctcttcgacgtcgacgggaccctctgcgactcggaccctctccaccatgtggctttccaagaaatgcttctagcgattgggtataacaatggcgtgccgatcgacgacgagttcttcatcaaaaacatcgctgggaggagcgacgtcgaagctgcccagaacctgttcccggactggcccctcgagaagggcctaaaattcctagaggacaaggagaccaaatacagaagtttggcgatggagcgtctggagcccgtaaacggccttgccaaggtggttcagtgggtgaaggatcacggctacaaacgcgcggcagtgacaaatgcccccaggatcaacgccgagctgatgctcaaacttcttggtctgacagacttcttccaggccgtgattgttggaggcgaatgcgagcagcctaaacctgcaccgttcccctacctcaaggccctcaaggagcttgatgtctccgcggcacacacattcatcttcgaggattccgcttcggggacacgtgcaggcgttgccgcggggatgcccgtggtcgccgtgctgacgaggaacccggagaactccctccaggaggctggtgcctcactgattgtgaaggactacgcggaccccaagctgtggagcgcgctcgaagagatcgacgcggcggaggcgaagctaaagagcggtgcggcgtgagttgatgatgatgaccgatgctgatgaacggtcgagtagatccattgcccgttttaggattggagggattccgaccgcctgaattgataggacagtcggttatactgtctgttttagtctactagagctcgtcagtgtatttttgagcttttattagtttggtgtgtatgcttttctctctttcttggttgctgttagggaacgaaataagaaaaaaaactctggtatttatgactcagattattgttgggacctatggatatggcaaatcttttcgtcttaatctg

SEQ ID NO: 3996 - DNA, 1333 bp, Setaria italica
gcacaacgcacgagtacaggacaccaccagcgccagcgatcgcatcgcaccgcacccgcacgccctcgcggcatagcagatcagatccccgcggcggccatggccgggaacttcgagctccagggccggcacggcaagtcccgtgtccgcgtctcccgcgtctggcgccgccccgccgcggcggggggcgacatcatcgtcgagtggaacgtcgccgtcagcgtcgtctccgactgcctcccctcctacacctccagcgacaactccgccatcgtcgccaccgattccatcaagaacaccgtgtatgtcaaggcgaaggagtgcacggaagtggtgtccatggaggaattcgccgtgattcttggaaggcatttcacctcgctgtaccctcaggtctcggaggctacggtgaccatcgtggagcgcccatgggagcgtgtggttgtcgacggaaagcctcattcgcatgggttcaaagttggtgttgagaagcacagcacagaagtcattgtgaaaaaatctggaagcttgcttataaattccggaatccaagggtactctctgctaaagacaactcagtctggttttgaagggtttgtgacggatcgctatagacttcttcctgatacaagagaaaggatagtagcaacagaagtaactgcttggtggaggtatccttttgaacatgtttcgcagctcccgtcaaagccgttctgctttacgcaaagataccaggatgtaaagaaagttctgtctgatacgttctttggcccccctgatgttggtgtgtatagtccttctgtacagaatacactatacctcatggccaaagaagttcttacgaggttcccagacatatcatcaattcagcttagaatgccgaatcttcactttctgcctgtcaacttggggagcaaagaaaatccattggtgaagtttgctgatgatgtgtacttgccgacggatgaaccgcacggaactattgaagcaactttgagccgtcccatgtcaaaactgtaacaatctagtggtcaggctggtgcgaaactcctgttgcgtttacccagcattcccaggccaaaataaacaagaacctgtaagggggtgggtgggtggggggggggggggggggttgactatcagaacccttatgcaaaaggggtaataagtgaataatcttgtgttgcatgtcagctgtagacgtccagctcgtgaagtccttaccgttgtaaatttgtacattatttcttactttctttgtatgaaatctgtttaacatcttcaaaaagctttgcccttttttttcttttccttcttttagatgatcattttt

SEQ ID NO: 3997 - DNA, 1695 bp, Pennisetum glaucum
cacacctccggcgcagagccagtaccagcgatcgcatcacaccgcacccagcacgcctacgccttcgcagcatcgcagatcagatccctgcggcggccatggccgggaacttcgagctccagggccggcacggcaagtcccgcgtccgcgtctcccgcgtctggcgccgccccgccgcggcggggggcgacatcatcgtcgagtggaacgtcgccgtcagcctcgtctccgactgcctcccctcctacacctccagtgacaactccgccatcgtcgccaccgattccatcaagaacaccgtgtatgtcaaggcgaaggagtgcacggaagtggtgtccatggaggaattcgccgtgattcttggaaggcatttcacctccttgtaccctcaggtctcagaggctacggtgaccatcgtggagcgcccctgggagcgtgtggttgtcgacggaaagcctcattctcacgggttcaaagttggtgttgagaaacacagcacagaagtcattgtaaaaaaatctggaagcctgcttataaattctggaatccaagggtactctctgctaaagacaactcagtctggttttgaagggtttgtgacggatcgctatagacttcttcctgatacaagggaaaggatagtagcaacagaagtaactgcttggtggaggtatccttttgaacatgtttcgcagctcccatcaaaaccattctgctttacgcaaagatacaaggatgtaaagaaagttctatcagatacgttctttggcccccctgatgttggtgtgtatagtccttctgtacagaatacactatacctcatggccaaagaagttctcacaaggttcccagacatatcatcagttcagcttagaatgccaaatcttcactttctgcctgtcaacttggggagcaaagaaaatccgttggtaaaatttgctgatgatgtgtacttgccgacggatgaaccacacggaactattgaagcaaccttgagccgccccatgtcaaaactgtaattgtctagtgatcaggctggtgcgaaactcctgtttcgtttacccagcattacccaggccaaaatgaaactatgataacccctatgcaagggggtaataagtgaataagcttgtgttgcatgttgtcagctgtggacgtcctgctcgtgaagtccttaccgttgtaaatttgtacattgtttctttgtatgaaatctgcttagcatcttgaaaacctcaactctttttttgtcttttccttttattagaagatcttttttgccggtacgtgtcggacatgggcgttcgccgggatacggtaaaggtccctgtccagaacctcgttgctgcaacggaggaggcagaggtcacaacagagactgttgcagctgctatggaggaggtagcagagactgagacagaggtcggagcgtcgtcctcgcctgcttgctgagaaactatcatcaattgatcatccactgtaatgtcatctattgtttgcaagccatcagttattcagcaggcctcttattctgtctgtctgttacacatctgaatcttggaatggaatgaccataactgtcacatactgtatctgctaaatgtcaaattgatattattcaacttcgattcagaacaggagttgccaattttcaaaaaaaaaaaaaaaaaaaaaacaaaaaaaaaaagtaactct

SEQ ID NO: 3998 - DNA, 1639 bp, Sorghum bicolor
acaagacccaagtacaaagctccagttgaacatatcaagatacggcgtggtgcgctacaggcgggccctctgaacagagcaagaacagcccacgtcacttttgctgcagccaggtcccacatctgtccacaaaaggccaatccccctcggcagaagcgcaaccgcgcaacgcaaatcagcgatcgcatcgcactcgcaccacactcagagtcagggtcacagcctcacaggccagatccccgcggcggccatggccgagaacttccagctccagagccggcacggcaagtcccgcgtccgcgtctcccgcgtctggcgccgcccggccgcggcggggggccacatcatcgtcgagtggaacgtcgccgtcagtatcgtctccgactgcctcccctcctacatctccagcgacaactccgccatcgtcgccacagattccatcaagaacaccgtctatgtcaaagcgaaggagtgcacggaagtggtgtccatggaggaattcgccgttattcttggaaggcatttcacctcgttgtaccctcaggtttcagaggccacggtgactatcgtggagcgcccatgggaccgtgtcactgtcgacggaaagcctcattcgcatgggttcaaagttggtgttgagaagcacagcacagaggtcattgtcaaaaaatctggaagcctgcttataaattctggaatccaagggtactcgctgctaaagacaactcagtctgggtttgaagggtttgtgacggatcgctatagacttcttcctgatacaagggaaaggatagtagcaacagaagtaactgcttggtggaggtatccttttgaacatgtttcgcagctcccatcgaaaccattttgctttacacaaagatatcaggatgtaaagagagttcttacagagacgttctttggtcctgctgatgttggtgtgtatagtccatctgtacagaatacgctatacctcatggccaaagaagttcttacaaggttcccagatatatcgtcagttcagcttagaatgccgaaccttcactttctgcctgtcaacttggggagcaaagaaactccgttggtgaagtttgctgatgatgtgtacctgccgaccgatgaaccacacggtaccattgaagcaactttgagccgtcccatgtcaaaactgtaagaatgtagtcatcaggctggtagcctggtatgagactcctgtttcgtctccccagcattcccaggccaaaatgaacaataagctgtaaggaaaagataaactatcataagtcataaccccgatgctatatgtgggggtaataagtggacagtcttgtgttggatgttgtcagctgtaggcgtccagcttgtgagttgtgacgtttcgccactgtaaatgtgtacattgcttgtcttgtatggaaacctgttaacatctttgaaagcttgctcaattttgcttcgtcgtttgtagccttttagctctttattaggtataccggtaaatctgattacttctccatatttgactatttgtattgtactcctcttctcgagaatgcctaaattcattttgctagccagcagtacaccgttgtttttctttaagagagaggttgaggtttttatttagtcaggcagagatgtg

SEQ ID NO: 3999 - DNA, 1404 bp, Panicum virgatum
cggcccccgcaccgcacgggcaccgcttccacccctccggcacagcgcgcaagtacagaacaccaccagtcgtccagtccaccagcgatcgcatcgcaccgcactcgcacacccctccgcggcatccgcagatcagatccccgcggcggccatggccgggaacttcgagctccagggccggcacggcaaatcccgcgtccgcgtctcccgcgtctggcgccgccccgccgcggcggggggccacgtcatcgtcgagtggagcgtcgccgtcagcgtcgtctccgactgcctcccctcctacacctccagcgacaactccgccatcgtcgccaccgattccatcaagaacaccgtgtatgtcaaggcgaaggagtgcacggaagtggtgtccatggaggaattcgcggtgattcttgggaggcatttcacctccttgtaccctcaggtctcggaggctacggtgaccatcgtggagcgcccatgggagcgtgtggttgtcgacggaaagcctcattcgcacgggttcaaagttggcgtcgagaagcacagcacagaagtcattgtgaaaaaatctggaagcctgcttataaattctggaatccaagggtactcgctgctaaagacaactcagtctggttttgaagggtttgtgacggatcgctatagacttctgcctgatacaagagaaaggatagtagcaacagaagtaactgcttggtggaggtatccttttgaacatgtttcgcagctcctgtcaaagcctttctgctttacacaaagataccaggatgtaaagaaagttctttcagagacattctttggtccccctgatgttggtgtgtatagtccatctgtacagaatacactatacctcatggccaaagaagttcttacgaggttcccggacatatcatcaattcagcttagaatgcctaatcttcactttctgcctgtcaacttggggagcaaagaaaatccattggtgaagtttgctgacgatgtgtacttgccgacggatgaaccacacggaactattgaagcaactttgagccgtcccatgtcaaagctgtaatctggtgatcatgctggtgtgaaactcctgtttcgagtccccagcactccctggcgaaaatgtacaataaagttgtagaaaggggaaaaaaactgccataaataacccctctgcaaaggggtaaataagtgaacaatcttgtgttgcatgttttcagctgtagacgtccagctcgtgaagtcccaaggttgtaaatctgtacatcgcttcctcttccttatatgaaacttgttaaacatcttcaaaagcttggtcaatttttcttcttttaaggatcattacatactggtactgcctccatttcaaaatgtacttcgttttagctttgttct

SEQ ID NO: 4000 - DNA, 1363 bp, Panicum virgatum
tccacccctccggcacagcgcgcaagtacagcacaccaccagtcgaccagcgacagcgatcgcatcgcgtcgcactcgcacggcgctcgcacgcccctccgcggcatccgcagatcagatccccgcggcgtccatggccgggaacttcgagctccagggccggcacggcaaatcccgcgtccgcgtctcccgcgtctggcgccgccccgccgcggcggggggccacgtcatcgtcgagtggagcgtcgccgtcagcgtcgtctccgactgcctcccctcctacacctccagcgacaactccgccatcgtcgccaccgattccatcaagaacaccgtttatgtcaaggcgaaggagtgcacggaagtggtgtccatggaggaattcgccgtgattcttgggaggcatttcacctccttgtaccctcaggtctcagaggctacggtgaccatcgtggagcgcccatgggagcgtgtggttgtcgacggaaagcctcattcgcacgggttcaaagttggcgtcgagaagcacagcacagaagtcattgtgaaaaaatctggaagcctgcttataaattctggaatccaagggtactcgctgctaaagacaactcagtctggttttgaagggtttgtgatggatcgctatagacttctgcctgatacaagagaaaggatagtggcaacagacgtaactgcttggtggaggtatccttttgaacatatttcgcagctcccatcaaagcctttctgctttacacaaagataccaggatgtaaagaaagttctttcagagacgttctttggtccccctgatgttggtgtgtatagcccatctgtacagaatacactatacctcatggccaaagaagttcttacgaggttcccagacatatcatcaattcagcttagaatgccaaatcttcactttctgcctgtcaacttggggagcaaagaaaatccattgatgaagtttgctgatgatgtgtacttgccgacggatgaaccgcacggaactattgaagcaactttgagccgtcccatgtcgaagctgtaatctggtgatccatgctggtgcggaactcctgtttcgtttccccagcactccctggcgaaaatgtatgataagctgtagaaaggggggccataacccctatgcaaaggggtaaataagtgaataatcttgtgttgcatgttttcagctgtagacgtccagttcgtgaagtcccacagttgtaaatttgtacatcgcttccttatatgaaacttgttaggcatctccaaaagcttggtcattttttcttctttgttaaggatcattacatactgcctccatttcaaattgtacttcatttagttttgttct

SEQ ID NO: 4001 - DNA, 1181 bp, Saccharum officinarum
cgccaatccagagtccttacccagcgatcgcatcgcactcgcaccacactcaggatcacaggtcagatccccgcggcggccatggccgagaacttccagctccagagccggcacggcaagtcccgcgtccgcgtctcccgcgtctggcgccgcccggccgcggcggggggccacgtcatcgtcgagtggaacgtcgccgtcagtatcgtatccgactgcctcccctcctacatctccagcgacaactccgccatcgtcgccacagattccatcaagaacaccgtctatgtcaaagcgaaggagtgcacggaagtggtgtccatggaggaattcgccgtgattcttggaaggcatttcacgtcgttgtaccctcaggtttcagaggccacggtgactatcgtggagcgcccatgggagcgtgtcactgtcgacggaaagcctcattcgcatgggttcaaagttggtgttgagaagcacagcacagaggtcattgtcaaaaaatctggaagcctgcttataaattctggaatccaagggtactcgctgctaaagacaactcagtctgggtttgaagggtttgtgacggatcgctatagacttcttcctgatacaagggaaaggatagtagcaacagaagtaactgcttggtggaggtatccttttgaacatgtttcgcagctaccatcaaagccattctgctttacgcaaagatatcaggatgtaaagaaagttcttgcagagacgttctttggccctgctgatgttggtgtgtatagtccatctgtacagaatacactatacctcatgggcaaagaagttcttacaagggtggcagagatatcgtcgattcagcttaaaatgccgaaccttcactttctggctgtcaacttggggagcaaagaaactccattggtgaagattgctgatgatgtgtaccctgccacggatgaaccacaccgaaccattggagcacccttgacccgtcccatgtcaaagctgtaagaatgtagtcatcaagcctggagcctggaatgagactcctgtttcgtctccccagattcccaggccaaaaatgaaccaataagctgtaagggaaaagaataactattcataggtcatgaccccctatgctatatatggggggtaataagtggacagtcttgtgttgaatgttgtcagct

SEQ ID NO: 4002 - DNA, 1779 bp, Oryza sativa
ctgaagtcggagccgcgctaaacaatttcctccgaggagatcccgtacgcatccgccccggcccatcccatctccaagtccaacgcagcagctcgccccgcacagcgcagagcgcactcgcacagatcggatccgttgctttgagcctctgacccctccctcccctgcggtggccatggccgatcgcctcgagctccagggcaggcacggcaagtcccgcgtccgcgtctcccgcgtctggcgccgccccgcggccgcgggaggccacgtcatcgtcgagtggaacgtggccgtcagcgtcgtctccgactgcctcccctcctacacctccgacgacaactccgccatcgtcgccaccgattccatcaagaacaccgtgtatgtgaaggccaaggaatgcacggagattgtctccatggaggaattcgcggtgattcttggaaggcatttcacctcgctgtacccgcaggtctcagaggcaacggtgaccatcgccgagcgtccatgggagcgtgtggttgtcgatgggaagcctcattcccacgggttcaaacttggtgttgagaagcacgtcacagaggtcattgtgaagaagtctggaaacttgctcataaattctggaatccaaggatactccctgctaaagacaactcagtccgggttcgaaaaatttgtgagggatcgctacacacttcttcctgatacaagagaaaggattgtagcaacagaagtaactgcctggtggaggtatccttttgagcatgtttcccagattccatcaaagtcattctgcttcacacaaaggtatcaggacgtaaagaaagttcttgcagatacgttctttggtcctcctgatgttggagtgtatagtccatcagtgcagaatacactatacctgatggctaaggaagttctcaacaggttcccggatatagcatctgttcagctaaggatgccgaacctccactttatccctgttaacttagggaacaaagaaaatccaggattagtgaagtttgctgatgatgtgtacctgccgaccgatgaaccacacgggaccattgaagcaacagtgagccgccccaagtcaaagttgtaaaagcaatcaatggtactggggaagctctcggtctggtttctgaggaaaaaagaaggaactgtgtaacaatcacatgggaaggggaaataaataaataatgttcagaaatgaattgtacatggccagctatagttacgccattgtaaatcttgtactgccttattgtatggaacctcaaatgtacaacctccgttttttaatagatgacgcttgactttttctcacatgtttgaccattcgttttattcaaaaaatttatgcaaatgtataagatataaatcacacttaaagtaatatgagtgataaaacaactcataacaaaataaattataattacgtaaattttttgaataagacgaatggtcaaacatgtgagaaaaagtcaacggcgtcatatattaaaaaacggagggagtaccaacttgcacatttgaaggctaaaggttataaattttcttctcctttgtactcatcagtagagcaagatcataacctccattatcacttttgggctgattgtttgattgtattgaaccagagaggagtagaagactgtgtcacaaaagcattatatgggccctaaagatgtgctatatgtggccattcgtttgagcgcctatgggctcctgcttgtggtacagaccacagaacgcagaaccgaataacagcgtccatcttgc

SEQ ID NO: 4003 - DNA, 1479 bp, Brachypodium distachyon
gagccggagacgtatcggctcaccgcagaagcgcagaactccaacacggactttcgcctggtcacccactgcaaccgggtcccatatccctctgcaggaatcgttttttccccgtacgcatcccgttcggctcagctctcctgcggcgatcgattgcatcacgcatcgcagaggccaccaccacactcgcgtcggcgcggcacagatcagatcccgtccccggcggccatggccgagcgcttcgacctccagagcaggcacggcaagtcccgcgtccgcgtgtcccgcgtgtggcgccgccccgccgcggccggcggccacctcttcgtcgagtggagtgtcgccgtgagcgtcgtctccgactgcctcccctcctacacctccgacgacaactccgccatcgtcgccaccgattcaatcaagaacaccgtgtatgtgaaggccaaggagtgcacggaggttgtctccatggaggaattcgcggttatccttggaaggcatttcacctccttgtaccctcaggtctcagaggcttcggtgtcaatcgtggagcgcccatgggagcgtgtggttgtcgatgggaaacctcattcacatgggttcaaacttggtgctgaaaagcacagcacagaggtcaccgtgaagaagtctggaagcctgcttataaattctgggatactagggtactcactgttaaagaccactcagtctggatttgaaggattcgtgagggaccgctacacacttcttccagaaacaagagaaagaattgtagcaacagaagtaactgcttggtggaggtatccattcgaacatatttcccagctcccatcaaagccattttgcttcacacaaagataccaggatgtaaagaaagttctcgcagacacattctttggtcctcctgacgttggagtgtatagtccatcggtgcagaatacattatacctcatggctaaagaagttcttaccaggttcccagacatatcatctgttcagcttaggatgccgaacctccactttctacctgtgaacttatcaggcaaagaaaatccaggattggtgaagtttgctgatgatgtgtacatgcccactgatgaaccacatggaaccattgaagcaacgttgagccgtgccaactcaaagttgtaacttcttttttttttcctttgttgtgaggaaaaactgtaacttcaatcggggaggtggcaaagctcatgatttgattttggtttcttcaaggtaaaagatctgcaataaacagcgacaggaaaaaaaaaagctagcacaaccccatgttaaaaggaaataagtaaactttgcgtgtgttcagctaaacgacttccaccattgtaaatgttgtacacagtacactgtttgtttcgttgtatgaaatctgcaatataccttctactttcctcatcttgattctcagttgcgatttgcagtaggtggaaaagaaacactacgtgacacttg

SEQ ID NO: 4004 - DNA, 1315 bp, Pseudoroegneria spicata
gacgcatccgcatcctcatccgctcacccccggtaccgcagatcggatccccatcaatggccgggcgcttcgacctccagggcaggcacggcaagtcccgcgtccgcgtcgcccgcgtctggcgccgccccgccgaggccggggggcacctcttcgtcgagtggagcgtcgccgtcagcgtcgtctccgactgcctcccctcctacacctccgacgacaactccgccatcgtcgccaccgactccatcaagaacaccgtgtatgtgaaggccaaggagtgcacggaggtggtgtccatggaggaattcgcggtgatcctcggaaggcatttcacctcactgtacccgcaggtctcggaggctacagtgacaatcgtggagcgcccatgggagcgtgtggctgtggacgggaagccccattcgcatgggttcaaacttggttctgaaaagcacaccacagaggtcaccgtgaagaaatctggaagcctgcttataaattctgggatacaaggatactccctgctaaagacaactcagtctggatttgaaggattcgtgagggaccgctacactcttcttcctgaaacaagagaaagaattgtagcaacagaagtaactgcttggtggaggtatccgttcgagcatatttcccagcttccatcaaagccattttgcttcacacaaagataccaggatgtaaagaaagttcttgcagacacattctttggtcctcctgatgttggtgtgtatagtccctcagtgcagaatacattatacctcatggctagggaagttcttaccaggttcccagacatagcatccgttcagcttaggatgccaaacctccactttcttcccgtgaacctaggggggaaagaaaatccaggattggtgaagtttgctgatgatgtgtacatgccgactgatgaaccacatggaaccatcgaagcaacattgagtcgcgccaactcaaagctgtaatttccttttctttgccttttcccctgaggaaaaactgtaattaacaatcaaggctggtagccaggctcatgatttggtttggcttcttcgagatcaaaatcaccaataaacaaagtaataacggggaaaaggctagcacaaatctttgcaaaagggaaaatgatgtaagctttccatgtgttcagctaaatgacttggtgcatggccagctggagttccacctgtctgctgtttaaccgggcgagtctgtggtttagtttgaaacttttggcctgtagatgaggtcctttcatgttttgcgcttatcttgctgggcaatgtaatgtgatttgtat

SEQ ID NO: 4005 - DNA, 1384 bp, Triticum aestivum
atcgatcccacctcgcgcatccgcatccgcatccgcacttcagcgcagatcggatccccaccccacccatggccgggcgcttcgacctgcagggcaggcacggcaagtcccgcgtccgggtctcccgcgtctggcgccgccccgccgacgccggggggcacctcttcgtcgagtggagcgtcgccgtcagcgtcgtctccgactgcctcccctcctacacctccgacgacaactccgccatcgtcgccaccgactccatcaagaacaccgtgtatgtgaaggccaaggagtgcacggaggtggtgtccatggaggaattcgcggtcatcctcggaaggcatttcacctcactctacccgcaggtctcagaggctacagtgacaatcgtggagcgcccatgggagcgtgtggcagtggacgggaagccccattcgcatggattcaaacttggttctgaaaagcacaccacagaggtcaccgtgaagaagtctggaagcctgcttataaattctgggatacaaggatactccctgctaaagacaactcagtctggatttgaaggattcgtgagggaccgctacactcttcttcctgaaacaagagaaagaattgtagcaacagaagtaactgcttggtggaggtatccgttcgagcatatttcccagcttccgtcaaagccattttgcttcacacaaagataccaggatgtaaagaaagttctcgcagacacattctttggtccacctgatgttggtgtatatagcccatcagtgcagaatacattatacctcatggctagggaagttcttaccaggttcccagacatagcatctgttcagcttaggatgccaaacctccactttattcccgtgaacctagggggcaaagaaaatccaggattggtgaagtttgctgatgatgtgtacatgccgactgacgaaccacatggaaccatcgaagcaacgttgagccgcgccaactcaaagctgtaatttcactccatgcttgtggccaggctcatgatttggtttggtttcttgaagatcacagtcgcaaataaacaaagtgttaggggggaagctagcacaaccccttgcaaaagggaaaaaggacgtaaactttgcatatgtattcagctaattgacttgtacatggctagctagagttcccccatcgtaaattttactgttgtacagaaccttcagtgttcgttgtctccacaatgctataatatagcctgttttttcttttctttttgagaaatagaacttctcgacagattgtgtctgcattagacagtaaaggccgtgttacacaaaactatcgcatgggccatgaatatgggccacagtagacaaaatgaggaatggaaaaaaatcgattt

SEQ ID NO: 4006 - DNA, 1368 bp, Secale cereale
ctcgcgcaggcgcgtccgcatccgcgtccacccccagcaccgcagatccgatccccacccatggccgggcgcttcgacctccagggcaggcacggcaagtcccgcgtccgcgtctcccgcgtctggcgccgccccgccgaggccggcggccacctcttcgtcgagtggagcgtcgctgtcagcgtcgtctccgactgcctcccctcctacacctccgacgacaactccgccatcgtcgccaccgactccatcaagaacaccgtgtatgtgaaggccaaggagtgcacggaggtggtgtccatggaggaattcgcggtgatcctcgggaggcacttcacctcactgtacccgcaggtctcggaggctaccgtgacaatcgtggagcgcccatgggagcgtgtggctgtggacgggaagccccattcgcatggattcaaacttggctctgaaaagcacaccacagaggtcaccgtgaagaagtctggaatcctgcttataaattctgggctacaaggatactccctgctaaagacaactcagtctggatttgaaggattcgtgagggatcgctacactcttcttcctgaaacaagagaaagaattgtagcaacagaagtaactgcttggtggaggtatccgtttgagcatatttcccagcttccatcaaagccattttgcttcacacaaagataccaggatgtaaagaaagttcttgcagacacattcttcggtcctcctgacgttggtgtatatagcccatctgtgcagaatacattatacctcatggctagggaagttcttaccaggttcccagacatagcatccgttcagcttaggatgccaaacctccactttcttcccgtgaacctagggggcaaagaaaatccaggattggtgaagtttgctgatgatgtgtacatgccgactgacgaaccacatggaaccatcgaagcaacgttgagccgtgccaactcaaagctgtaattttcactcaatgcttgtggtcgggctcgtgatttggtttggtttcttcaagatcaaaatggccaataaacaaagtgacaggggggaagctagcacaacaaccccttgcaaaagggaaaaaggacgtaaactttgcatatgtattctgctaatttacttgtacatgcctatctagacttcccccatagtaaattttactgttgtacaaaaccttcaatatttgttgtctccacaacgctataatagagcctgtttgttcatttctttttgagaaatagtagaactcgtgtctgcattagacagtaaaggccgtgtacacaaaactatagcatgggccatgaacatgggacacagtagacaaaatgaaccgaaacaatttgattt

SEQ ID NO: 4007 - DNA, 1394 bp, Secale cereale
tcagagcgaccgatccattcccacctcgcgcaggcgcgtccgcatccgcgtccgcccccagcaccgcagatccgatccccacccatggccgggcgcttcgacctccagggcaggcacggcaagtcccgcgtccgggtctcccgcgtctggcgccgccccgccgaggccggcggccacctgttcgtcgagtggagcgtcgccgtcagcgtcgtctccgactgcctcccctcctacacctccgacgacaactccgccatcgtcgccaccgactccatcaagaacaccgtgtatgtgaaggccaaggaatgcacggaggtggtgtccatggaggaattcgcggtgatcctcgggaggcacttcacctcactgtacccgcaggtctcggaggctacagtgacaatcgtggagcgcccatgggagcgtgtggctgtggacgggaagccccattcgcatggattcaaacttggctctgaaaagcacaccacagaggtcaccgtgaagaagtctggaatcctgcttataaattctgggctacaaggatactccctgctaaagacaactcagtctggatttgaaggattcgtgagggatcgctacactcttcttcctgaaacaagagaaagaattgtagcaacagaagtaactgcttggtggaggtatccatttgagcatatttcccagcttccgtcaaagccattttgcttcacacaaagataccaggatgtaaagaaagttctcgcagacacattctttggccctcctgatgttggtgtatatagtccatccgtgcagaatacattatacctcatggctagggaagttcttaccaggttcccagacatagcatccgttcagcttaggatgccaaacctccactttcttcccgtgaacctagggggcaaagaaaatccaggattggtgaagtttgctgatgatgtgtacatgccgactgacgaaccacatggaaccatcgaagcaacgttgagccgtgccaactcaaagctgtaatttcactcaatgcttgtggccaggctcatgatttggtttggtttcttcaacatcacaatcgccaataaacaaagtgacaggggggaagctagcacaacaaccccttgcaaaagggaaaaagggcgtaaactttgcatatgtattcagctaattggcttgtacagtacatggctatctagagttcccccatagtaaattttactgttgtacaaaaccttaaatgtttgttgtctccacaacgctataatagagcctgttttaacttttctttttgagaaatagaactctgcattagacagtaaaggccgtgtacacaaaactaacgcatgggccatgaatatgggccacagtagacaaaatgaacggaaaaattcgattttcaagtc

SEQ ID NO: 4008 - DNA, 1381 bp, Secale cereale
acgagagcgacaccacgacgggcatctcgccgactgcgcgcgatcccatccctatctctctacaaaagaagcagcagtagcactcccgtgcgggtcacttccgccagcgaccgatccattcccacctcgcgcaggcgcgtccgcatccgcgtccgcccccagcaccgcagatccgatccccacccatggccgggcgcttcgacctccagggcaggcacggcaagtcccgcgtccgggtctcccgcgtctggcgccgccccgccgaggccggcggccacctcttcgtcgagtggagcgtcgccgtcagcgtcgtctccgactgcctcccctcctacacctccgacgacaactccgccatcgtcgccaccgactccatcaagaacaccgtgtatgtgaaggccaaggagtgcacggaggtggtgtccatggaggaattcgcggtgatcctcgggaagcacttcacctcactgtacccgcaggtctcggaggctaccgtgacaatcgtggagcgcccatgggagcgtgtggcagtggacgggaagccccattcgcatggattcaaacttggctctgaaaagcacaccacagaggtcaccgtgaagaagtctggaatcctgcttataaattctgggctacaaggatactccctgctaaagacaactcagtctggatttgaaggattcgtgagggatcgctacactcttcttcctgaaacaagagaaagaattgtagcaacagaagtaactgcttggtggaggtatccatttgagcatatttcccagcttccgtcaaagccattttgcttcacacaaagataccaggatgtaaagaaagttctcgcagacacattctttggccctcctgatgttggtgtatatagtccatccgtgcagaatacattatacctcatggctagggaagttcttaccaggttcccagacatagcatccgttcagcttaggatgccaaacctccactttcttcccgtgaacctagggggcaaagaaaatccaggattggtgaagtttgctgatgatgtgtacatgccgactgacgaaccacatggaaccatcgaagcaacgttgagccgtgccaactcaaagctgtaatttcactcaatgcttgtggccaggctcatgatttggtttggtttcttcaagatcacagtcagcaataaacaaagtgacagggggaaagctagcacaacaaccccttgcaaaagggaaaaagggcgtaaactttgcatatgtattcagctgattggcttgtacagtacatggctatctagagttcccccatagtaaattttactgttgtacaaaaccttcaatgtttgttgtctccacaacgctataatagagcctgttttaacttttctttt

SEQ ID NO: 4009 - DNA, 1257 bp, Secale cereale
cgatccattcccacctcgcgcaggcgcgtccgcatccgcgtccgcccccagcaccgcagatccgatccccacccatggccgggcgcttcgacctccagggcaggcacggcaagtcccgcgtccgggtctcccgcgtctggcgccgccccgccgaggccggcggccacctcttcgtcgagtggagcgtcgccgtcagcgtcgtctccgactgcctcccctcctacacctccgacgacaactccgccatcgtcgccaccgactccatcaagaacaccgtgtatgtgaaggccaaggagtgcacggaggtggtgtccatggaggaattcgcggtgatcctcgggaggcacttcacctcactgtacccgcaggtctcggaggctacagtgacaatcgtggagcgcccatgggagcgtgtggctgtggacgggaagccccattcgcatggattcaaacttggctctgaaaagcacaccacagaggtcaccgtgaagaagtctggaatcctgcttataaattctgggctacaaggatactccctgctaaagacaactcagtctggatttgaaggattcgtgagggatcgctacactcttcttcctgaaacaagagaaagaattgtagcaacagaagtaactgcttggtggaggtatccgtttgagcatatttcccagcttccaccaaagccattttgcttcacacaaagataccaggatgtaaagaaagttctcgcagacacattctttggccctcctgatgttggtgtatatagtccatctgtgcagaatacattatacctcatggctagggaagttcttaccaggttcccagacatagcatccgttcagcttaggatgccaaacctccactttcttcccgtgaacctagggggaaaagaaaatccaggattggtgaagtttgctgatgatgtgtacatgccgactgacgaaccacatggaaccatcgaagcaacgttgagccgtgccaactcaaagctgtaatttcactcgatgcttgtggccaggctcatgatttggtttggtttcttcaagatcacaatcagcaataaacaaagtgacagggggaaagctagcacaacaatcccttgcaaaagggaaatagggcggaaactttgcatatgtattcagctaattgacttgtacatggctatctagacttcccccatagtaaattttactgttgtaactaaaacctttaaatattttagttgtctccacaacgctataatagagcatgttt

SEQ ID NO: 4010 - DNA, 1307 bp, Triticum aestivum
cagatcggatccccacccatggccgggcacttcgacctccagggcaggcatggcaagtcccgcgtccgcgtctcccgcgtctggcgccgccccgccgatgccggcggccacctcttcgtcgagtggagcgtcgccgtcagcgtcgtctccgactgcctcccatcctacacctccgacgacaactccgccatcgtcgccaccgactccatcaagaacaccgtgtatgtgaaggccaaggagtgcacggaggtggtgtccatggaggaattcgcggtcatcctcgggaggcatttcacctcactgtacccgcaggtctcagaggctgcagtgacaatcgtggagcgcccatgggagcgtgtggctgtggacgggaagccccattcgcatgggttcaaacttggttctgaaaagcacaccacagaggtcacggtgaagaagtctggaagcctgcttataaattctgggatacaaggatactccctgctaaagacaactcagtctggatttgaaggattcatgagggaccgctacactcttcttcctgaaacaagagaaagaattgtagcaacagaagtaactgcttggtggaggtatccgttcgagcatatttcccagcttccgtcaaagccattttgcttcacacaaagataccaggatgtaaagaaggttcttgcagacacattctttggtccttctgatgttggtgtatatagtccatccgtgcagaatacattatacctcatggctagggaagttcttaccaggttcccagacatagcatccgttcagcttaggatgccaaacctccactttcttcccgtgaacctaggggggaaagaaaatccaggattggtgaagtttgctgatgatgtgtacatgccgactgacgagccgcatggaaccatcgaagcaacgttgagccgtgccaactcaaagctgtaatttcacttgatgcttgtggccaggctcatgatttggtttggtttcttgaagatcacaatcgccaataaacaaagtgatagggggaaagctagcacaaccaccccttgcaaaagggtaaaaggacgtaaactttgcatatgtattcagctaattgacttgtacatggctagctagagttcccccatcgtaaattttactgttgtacaaaaccttcaatgtttcgttgtctccacaatgctataatatagcctgttttttcttttcttttcgagaaatagaacttctcggcagaatatgatttagagtaaaggccgtgtacacaaaagtatcgcatgggccatgaatatgggctacagtagacaaaa

SEQ ID NO: 4011 - DNA, 1226 bp, Cenchrus ciliaris
  misc_feature (77)..(77): n is a, c, g, or t
  misc_feature (251)..(251): n is a, c, g, or t
  misc_feature (528)..(528): n is a, c, g, or t
  misc_feature (752)..(752): n is a, c, g, or t
  misc_feature (806)..(806): n is a, c, g, or t
  misc_feature (841)..(841): n is a, c, g, or t
  misc_feature (860)..(860): n is a, c, g, or t
  misc_feature (866)..(866): n is a, c, g, or t
  misc_feature (882)..(882): n is a, c, g, or t
  misc_feature (888)..(888): n is a, c, g, or t
  misc_feature (893)..(893): n is a, c, g, or t
cagcagtgccaagcgatcgcctcacaccgcacccagcacagcatcgcagatcagatccccgtagcgacctggccggnaatttcgagctccaaggccggcatggcaagtcccgcgtccgcgtctcccgcgtctggcgccgccccgccgcggccgggggcgacatcatcgtcgagtggaacgtcgccgtcagcctcgtctccgactgcctcccctcctacacctccagcgacaactccgccatcgttgccacngattccatcaagaacaccgtgtatgtcaaggcgaaggagtgcacggaagtggtgtccatggaggaatttgccgtgattctcggaaggcatttcacctcgttgtaccctcaggtctcagaggctacggtgaccatcgtagagcgcccctgggagcgtgtggttgtcgacggaaagcctcattctcacgggttcaaagttggtgttgagaaacacagcacagaagtcattgtaaaaaaatctggaatcctacttataaattctggaatccaagggtacnctctgctaaagacaactcagtctggttttgaagggtttgtgacggatcgctatagacttcttcctgatacaagagaaaggatagtagcaacagaagtaactgcttggtggaggtatccttttgaccatgtttcgcagatcccgtcaaaatcattctgctttacgcaaagataccaggatgtaaagaaagtctgtcagagacgttctttggccccctgatgtggngtgtatagtccttctgtcagaatacctatacctcatggccaagagttcttacanggttccagcatatcatcagttcagcttagaatgcnaatttcactttctgcctgncaactnggggagcaagaaaatncgtggngaagnttgctgatgatgtgtacttgccgacggatgaaccgcacggaactattgaagcaactttgagccgtcccatgtcaaaactgtaatgatctactactgatctagtggatcaggctggtgtgaaactcctatttcgtttatccaccattcccaggccaaatgaacaagttgtagaaagggggaaagaaactatgataaacccctacgcaaaggggtaataagtgaataaacttatgttgcatgttgtcagctgtagacgcccagctcgcgcctgaagtccttaccgttgtaaatttgtacattgtttctttgtatgaaatctgtttagcatcttca

SEQ ID NO: 4012 - DNA, 1292 bp, Secale cereale
tccagggcaggcacggcagtcccgcgtccggtctcccgcgtctggcgccgcccgccgaggccggcggccacctcttcgtcgagtggagcgtcgccgtcagcgtcgtctccgacctgcctcccctcctacacctccgacgacaactccgccatcgtcgccaccgactccatcaagaacaccgtgtatgtgaaggccaaggagtgcacggaggtggtgtccatggaggaattcgcggtcatcctcgggaggcatttcacctcactgtactcgcaggtctcagaggctacagtgacaatcgtggagcgcccgtgggagcgtgtggctgtggacgggaagccccattcgcatgggttcaaacttggttctgaaaagcacaccactgaggtcaacgtgaagaagtctggaagcctgcttataaattctgggatacaaggatactccctgctaaagacaactcagtctggatttgaaggatttgtgagggaccgctacactcttcttcctgaaacaagagaaagaattgtagcaacagaagtaactgcttggtgaggtatccgttcgaacatatttcccagcttccgtcaaagccattttgcttcacacaaagataccaggatgtaaagaaagttctcgcagacacattctttggccctcctgatgttggtgtatatagcccatccgtgcagaatacattgtacctcatggctagggaagttcttaccaggttcccagacatagcatccgttcagcttaggatgccaaacctccactttcttcccgtgaacctaggtagcaaagaaaatccaggattggtgaagtttgctgatgatgtgtacatgccgactgacgaaccacatggaaccattgaagcaacgttgagccgtgccaactcaaagctgtaatttcactcaatgcttctggccaggctcatgatttggtttggtttcttcaagatcacaattagcaataaacaaagtgatacgggggaaagctagcacaacaaccccttgcaaaagggaaaaaggacgtaaactttgcatatgtattctgctaatttacttgtacatggctatctagactccccccatagtaaattttactgttgtacaaaaccttcaatgtttgttgtctccacaacgctataatagagcctgttttttcttttctttttgagaaatagaactcggcagattgtgcctgcattagacagtaaaggccgtgtacacaaaactatcgcatgggccatgaacatgggccacagtagacaaaaatgaaccgaaacaatttgattt

SEQ ID NO: 4013 - DNA, 3124 bp, Setaria italica
ggtttatgagcctgccaaagtccattccaatcccttccactacgcctccgctcgctcgcttcgctgtcatgaggaccctcgccgtcgcaggcccccacccgggcgccgccttcaccgcccgccaccgccgtcttcacccctccgccgcggacagggactcgatttctcagcgctgttggcgatgtgagagaactcaagaccgctcctttgggaactctctaaggatcagccgccttccaggaacgccgcacagagatgtcggaaagaatttgctcacaccaactgctgctgtttctgttgagcaagccgaagctactgctgaccttccgaaaggtgatatgtggtcggtgcataaatttggtgggacgtgcatggggacttcacagagaatccagaatgttgctgacatagtccttcgtgatccttctgagaggaaactcgttgttgtatctgcaatgtctaaagtcaccgacatgatgtacaatcttgtgaacaaggctcaatcaagggatgattcttacatcactgtgcttgatgaagtttttgaaaagcatatgggaacagcaaaggacttgcttgcaggagaagaccttgcaagattcctgtctcagttgcatgcagacatcagtaaccttaaagcaatgcttcgtgccatatatatagccgggcatgcaacagagtcattctctgattttgttgttggccatggagagttatggtctgcacaaatgttgtcatatgcgataaagaagtctggaacgccttgcagttggatggatacaagagaaattctagttgtaaatccatcaggatccaaccaggtagatcctgactatttggaatctgaaaaacgacttgaaaaatggtttgctcgaggtccagctgagacaataattgctactggtttcattgcgagtacacctgacaacatcccgacaactttgaaaagagatggaagtgatttctctgcagccataattggttcccttgttaaggctcgtcaagtgaccatctggaccgatgttgatggggtatttagtgcagatcccagaaaagttagtgaagctgtgatcttaagcacattgtcatatcaggaggcctgggagatgtcgtatttcggggcaaatgtcttgcatccgcgtaccattatacctgtgatgaaatacaatattcctattgttataaggaacatattcaatacttctgcccctggaactatgatctgtcagcagcctgcgaatgaaaatggtgatttggatgcttgtgtcaaagcttttgcaactatagataaactagctctggttaatgttgaagggacaggaatggctggtgtcccaggcacagcaagtgccatatttggtgctgtgaaggatgttggagcgaatgttgtcatgatatcgcaggctagcagtgaacactccgtatgctttgctgttccagaaaaggaagttgcatctgtgtcggcagccttgcatgttaggttccgtgaagcattggcagcagggaggctatctaaggttgaagtcattcataattgtagcatccttgctgctgttggcctgaggatggcaagtacacctggagtcagtgcaaccctttttgatgcacttgctaaggctaatattaatgtaagggcaatagctcaaggttgcagtgagtacaacattacagttgtattgaagcaagaagactgtgtacgggctttgagagctgcccactcaaggttcttcctctccaaaaccacactggctgttggaattgtaggacctgggttgattggtcgcacactgcttaaccagctgaaggaccaggctgctgtcctgaaggaaaatatgaacattgacctgcgtgtcatgggtataactggttcaaggacaatgcttttaagtgatataggaatcgatttgacccagtggaaagagaagctgcaaactgaagcagaaccggccgatcttgacaagtttgttcatcatttgtctgagaatcacttcttccctaacagagttttggtagattgcacagcagacactagtgttgcatctcactattatgattggctcaagagaggaatccatgtcatcactccaaacaagaaagcaaattcagggccacttgagaggtatctgaagcttagaactcttcaacgtgcatcatatactcattacttctatgaagcaactgttggtgctggcctccctatcattagcactctgcggggtcttctagagacaggtgacaagatattgcgtattgaagggattttcagtggaacgttgagttatatttttaataactttgaaggagcaagaacctttagtgatgttgttacggaggcaaaagaagctggatacaccgagcctgatccaagagatgatctatctggtactgatgttgccagaaaggtcataatccttgcaagggaatctggtttgaggcttgagctttctgatattcctgtaaggagtcttgtgccagagtcactgagatcatgtacatcagctgatgaatacatgcaaaaactaccatcctttgatcaagactgggcaagtgagcggaatgatgctgaagctgcaggggaagttttgaggtatgttggagtggtagatgtggtcaacaagaaggggcaggtagagttgcggcgctacaagagggaccacccatttgcgcagctatctggctctgacaacatcatagccttcaccacatcgagatacaaagagcaaccactgattgtgagaggcccaggagcaggcgcggaagttactgcaggaggcgtcttcagcgacatactaaggctggcatcttaccttggtgctccctcgtaagtcatgaatgttgactggtggcttatacatgtaaggagtcttggtattcatattctcctgattttggtagagtttgaaatagcaggccagaaaataagtatgtgttccaatgtgttttgttcctggagcgctaggtaggggcagtataatttagtgggttatattgggaaaaataaagacaatccactgttcttgctcgttgcaataatgttgtctgggtttgattggttgttgataataactaaattagggagtcaaaacaatcaaatggaaaaaagctaattgtcaggaatgcgttc

SEQ ID NO: 4014 - DNA, 3203 bp, Brachypodium distachyon
ggggtgcgataagaagggtcaaagcttgaagcgggtagggttaaccagggttttgagctggcctgactgctcaattccaactccctgcccccacgccgctgcgccaccgttctccgtggctgccatgacgagccttgctgccgcgagcccccacccgggcgccgccttcgccgcccgccgccgccaccgcgttcaccccaccaggtcgggcagggaagcgatttcccagtgttggcgacgcgagagaagccagggacgttcgtttcggagctctctaaggatcagcaatcttccaggacagctacgtggagatgttccaaagaatttgctcacaccaactgctggtaccgtttcagttgaacaagttgaagccagcacttatcttccaaaaggtgacatgtggtctgtgcacaaatttggcggaacctgcatggggacaccccagagaattcagaatgttgctgacatagtccttcgcgatccttctgagaggaagcttgtagttgtatccgcaatgtctaaagtcactgacatgatgtacaaccttgtcaataaggctcaagcgagggatgattcttacatcgttgcactagatgaagtttttgagaagcatatggtagcagcaaaggacctgcttgaaggagaagaccttgcaagatttttgtctcaaatgcatgcggacatcagtaacctaaaagcgatgcttcgtgccatatatatagctgggcatgtaacggaatctttctctgattttgtggttgggcatggagaattatggtcagctcaaatgttgtcatttgcaataaagcagtctggtacgccttgcagttggatggatactagagaagttttagttgtaaatcctacaggttccaaccaggtagatcctgactatttggaatctgagaaacgacttgacaaatggtttgctcgaaaaccagctgagacaataattgcaactggatttattgcgagcacacatgaaaacatccctacaaccttgaaaagagatggaagtgatttctctgcagccataatcgggtcccttgttaaggctcgtcaagtcaccatatggactgatgttgatggggtattcagtgcagatcccagaaaagttagcgaggctgtgatcttaagcacattgtcatatcaggaggcctgggaaatgtcatattttggggcaaatgttctgcatccacgtaccatcatacccgtgatgaaatacaatattcccattgttataaggaacatcttcaacatttctgcccctggaaccatgatctgccagcagcccacgaatgaagatggagatttggaggcttgtgtcaaagcatttgcaactatagataaattagctcttgttaatgttgaaggaactggaatggctggtgttcctggtacggcaaatgccatatttggtgccgtgaaggatgttggagctaatgttatcatgatatcacaggctagcagtgaacactctgtatgtttcgctgttccagagaaggaagtttcagcagtctctgcagccttgcatgttaggttccgtgaagcattatccgcgggcaggctatccaaggttgaagtcattcataattgtagcattctcgctgctgttggcctgaggatggcaagtacacctggagtcagtgcaaccctttttgatgcactggcaaaggcaaatattaatgtaagggcgatagctcaaggttgcagtgagtacaacattactgttgtattgaagcaagaagactgtgtaagggctctgagagctgctcactcgaggttcttcctctccaaaaccacattggctgttggaattattggacctgggttgattggccggacactgcttaaccaactgaaggatcaggctgctgttctcaaggaaaatatgaacatcgatttgcgcgtcatggggattaccggttcaaggacaatgtttttgagtgacacaggagttgatttgacccagtggaaagagctgctggaaactgaggcagaaccagccaacctcgacaagtttgcttaccatttatctgaaaatcacttcttccctaacagagttttggtggattgcacagcagacacaagtgttgcatcccattattatgattggttaaagaagggaatccatgtcatcactccaaataagaaagcaaattcagggccacttgacaggtatctgaaacttaggaccctacagcgtgcatcatatacacattacttctatgaagcaaccgttggtgctggcctcccgatcattagcactctgcgaggtctcctggagacgggtgacaagattttacgcattgaggggattttcagtgggacgttgagttatatttttaacaattttgaaggaacaaggacctttagtgatgttgttgctgaggcaaaggaggctggatatactgagcctgatccaagagatgatctatctgggactgatgttgccagaaaggtcataatccttgcaagggaatctggtttgaggcttgaactttctgatattcctgtgaggagtcttgtgccggaggaactgagaatgtgttcatcaggtaatgaatacatgcaaaagctgccatcctttgaccataactgggccagtgagcggaaagaagctgaagttgcaggagaagttttgcggtatgttggagtcgtcgatgtggcgaacaagaagggacaggtcgagctgcgaaggtacaagagggaccacccatttgcgcagctgtctggctccgacaacatcatagctttcaccacgtcgagatacaaggagcaaccgctgattgtgcgaggcccgggggcaggtgcagaagtgactgcagcaggtgtcttcagtgacatactacggctggcctcttaccttggcgctccttcataggctcacacacaaccgtattttgatggtagaggaatggctagttatgcaaggtttttgttatgcttcgtggagtctatataacaggaaagaaaaaaagttatctgaagtcttctgtttctgttgttccttaaagcactcagtaggaggtcaggagttggatagtcctattgaacagaaaataatctggtatcgtttttgtcttgttgcaatgataatgtccctagttgtttttttactgctgacattagctagttatgtctaaacaaattaataaaagaatcgtgttggttgctgagtggtaaccaagtttcgtcctacg

SEQ ID NO: 4015 - DNA, 3626 bp, Oryza sativa
tcacgctcatcagtctaatcccacccatttcggctgcgctggctgccaccatgtggagcctcgccgtcgcgagcccgcaccccgccgccgccttcgccgcggcccgtccccgccgcggccctcgccccgccgccgccccctcccacagaggtgtgaatccgcagcggtggcgatgtgagaagactcaggcatggtcgttttggagctctctgtgggccagcgaccttccaggaggactttatggggatgtttcgaagaatatgctcaagccagctgctgctgtttcagttgagcaagctgaagctagtgctcaccttccaaaaggtgacatgtggtctgtgcataaatttggtgggacctgcatgggaacctcccagaggattcagaatgtggctgacataatccttcgcgacccttctgagaggaaactggtagttgtgtctgcaatgtctaaagtcactgacatgatgtacaaccttgtaaataaggctcaatcaagggatgattcttatatcactgcacttgatgaagttttcgagaagcatatggcagcagcaaaggatctgcttggaggagaggaccttgcaagattcttatctcagttgcacgcggatgtcagtaacctaaaagcaatgcttcgtgcaatttgcatagctgggcatgccacggagtctttctcagattttgttgttggacatggagagatatggtcagctcaattgttgtcatttgccataaagaagtctggaaccccttgcagttggatggacacacgagaagttttagttgtaaatcctacaggttccaaccaagtagatcctgactatttggaatctgagaaacgacttgagaaatggttcgctcgacagccagctgagacaataattgctactgggtttattgcgagtacacctgaaaacattcctacaaccttgaaaagagatggaagtgatttctctgcagccataattggttcacttgttaaggctggtcaggtcactatctggactgatgttgatggggtctttagtgcagatcccagaaaagttagcgaggctgtcatattaagcactttatcatatcaggaggcgtgggaaatgtcgtattttggggcaaatgtattacatccgcgtaccatcatacctgtgatgaaatacaatatcccaattgttataagaaatatgttcaatatttctgcccctggtaccatgatctgccagcagcctgcgaatgaaagtggtgatttggaggcttgcgtcaaagcatttgcaactatagataaattgtctcttgttaacgttgaaggaactggaatggctggtgttcctggtactgcaagtgccatatttggtgctgtgaaggatgttggagctaatgttatcatgatatcgcaggctagtagtgaacactccgtatgctttgctgtaccagaaaaggaagttgctgcagtttctgcagctttgcatgtcaggttccgtgaagcattatctgcaggcaggctatctaaggtcgaagtcattcataattgtagcatccttgctgctgtcggcctgaagatggcaagtactcctggggtcagtgcaaccctttttgatgcacttgcaaaggcaaatattaatgtaagggcaatagctcaaggttgtagtgagtacaacatcactgttgtattgaagcaagaggactgcgtaagggctcttagagctgctcactcaaggttcttcctctccaaaaccacacttgctgtcggaattattggacctgggttgattggtcgtactctccttaaccagctgaaggatcaggctgcagttcttaaggaaaatatgaacattgatctgcgtgtcatgggaatcactggttcgaggacaatggttttgagtgatacaggaatagatttggcccattggaaagagcagctacaaactgaagcagaaccagccaaccttgacaagtttgttgatcatttgtccgagaatcaattattccctaacagggttttggtggactgcacagcagacacaagtgttgcatcccactattatgactggttaaagaagggaatccatgtcatcacgccaaataagaaagcaaattcagggccactggacaagtatttgaaacttaggactctacaacgtgcatcatatacccattacttctatgaagcaactgttggtgctggccttcctatcattagcactctgcgcggtctcctggaaacaggtgacaagatattgcgtattgaggggatcttcagtggaacattgagttacattttcaacaattttgaaggaacaagagctttcagtgatgttgtttctgaagcaaaagaggctggatacactgaacctgatccaagagatgatctgtctggaactgatgtagccagaaaggtaataattcttgctagggaatctggattgaagcttgagctttctgatattcctgtaaggagtcttgtgccggaggcattgagatcctgttcaacagctgatgaatacatgcaaaagttaccatcctttgaccaggactgggcaagagagagtaaagatgctgaagctgccggagaagttttgcggtatgttggagtggtggatttggtgaacaaggagggtcaggtcgagctgcggaggtacaagaaggaccacccgttcgcgcagctatctggctccgacaacatcatcgccttcacgacgtcaagatacaaggagcaaccgctgatcgtgcgaggcccgggcgccggtgcagaggtgaccgcaggaggtgtcttcagtgacatactacggctggcctcctacctaggcgctccctcataagctttgtagcaggaagcattttctgatggtggtcaagatggctttgaatcttgtaaggttgcctggtttcttcttctcttttcctttgcacaagcattctaaatcacagtgaggaaataagcctttgttctgtagtgatgttcgtcaagggcaataggtaggagttgtgcaggtcttgttggaaaacaattcttgttcgttgcaataatggtgtggtcgtcaggtttgtttttgatggtgacgctagtgaggtgagacggcattacaagtgaagaatcaataatgcaaagcttcgaatcgtgatgatggaagaaaaaaaaaatccaattgtgcaatgctgcgtaagacctgaaaggtggcaatgtctctgggaccgattcgatcgaccttggaggttcactttacatgtcttacgacctttaatcctgcagagtttggttacaaaagggcttgggattgaattagaatccattggttcctacatgtcttactacaccaacaatcattaatcacatctcaacctaatactagcggaacaggagcatgatgattcctaaaccataggttactccatgttctaaacttgaaatgagctcacttggttagataaaacggaggtaggttactccatattctaaacttgaaatcagctcacttggttagataaaacggaggttgtgcattaagagactcgaagcggcatcatgctggtcagacttcagagagaccggcgtttgtacaggaactgaagtaggatagtgtcatgtgtcttgaattgaagtataaataaattgactgtctgtcacttac

SEQ ID NO: 4016 - DNA, 3026 bp, Setaria italica
cgccgtcaccgcggagatgcggggcctcgccgtcgcaagcccgctccctcccgccgccgcagccgctctccggcggacccgcgccccctcctcctccggcagggaagtgtcatcacaatgttggaagtatgacttaagccaagaccgatctttgggaggctccctaaggataggtcagtctcaaggaagtttgcacagacatcgtccgacaaatttgctcagaccagctgctgcagctatttcagtcgaacaagatgaagttaatacatatcttccaaaaggtgatatgtggtctgtccacaagtttggtggaacctgtatgggaacaccccaaagaattcagagtgttgcagatatagttcttggtgattcttctgagagaaagctgatcatagtttctgcaatgtccaaagtaactgacatgatgtacaaccttgtacataaggctcagtcaagggatgattcatatacaatagcacttgaagaagtttttgagaagcatatggctgcagcaaaggatcttcttgatggggaagatcttgcaagattcttgtctcagttgcactcagatgtcagcaacttgcgagcaatgctccgtgctatttatatagctggacatgcgacggaatctttctcagactttgttgtcgggcatggagagttgtggtctgcacagatgttatcgtatgcaataaagaagtctggagcaccatgcagttggatggatacaagagaagttctagtcgtaaaacctagtggttctaatcaagtagaccctgattacttagaatctgagaagcggtttcagaaatggttttctcgacaaccagctgagacaatagttgccacggggtttattgcgagtacagcagaaaacgtacctaccactttaaaaagggatggaagtgatttctcagcagccataattggttctcttgttagggcacgccaggtcaccatctggactgatgttgatggggtatttagtgcagaccctagaaaagttagtgaggctgtgatcttaagcacgttatcctaccaggaggcctgggaaatgtcatattttggcgcaaatgtgttgcatccccgcaccattatacctgtgatgaaagacaacatccccattgttattaggaacatgttcaatatctctgcccctggaaccatgatttgcaggcagcctgccaatgataatggtgatttagatgcttgtgtcaaatcatttgctactattgataatttggcccttgtcaatgttgaaggaactggaatggctggtgttccaggtacatcaagtgccatatttagtgctgtaaaagatgttggagctaatgttatcatgatatctcaggctagcagtgagcactccgtatgctttgctgttccagaaaaggaggttgctgcagtttcggctgccttgcatgttaggtttcgtgaggcattagcagcagggaggttatctaaggttgaagttattaatggttgtagcattcttgctgctgttggcctgaggatggccagcactcctggagtgagtgcaatcctttttgatgcattagcaaaggcaaacattaatgttcgagcaatagctcaaggctgcagtgaatacaatattactgttgtattaaagcaagaagattgtgtaagggctctgagagctgctcactcaaggttcttcctctccaaaaccacacttgctgttgggatcattggacctggtttaattggtgggacactccttaaccagctgaaggatcaggctgctgttctcaaggaaaatatgaacattgatctgcgtgtaattggaataactggctcaagtacaatgcttttgagtgacacgggaatagacttaacccagtggaaagagcttctacgaaaggaaggagaaccagctgatgttgctaattttgttcgccatttgtctgataatcatgtgtttccgaacaaggttttggtggactgcacagcagatacaagtgtagcatcccactattatgattggttaaagaagggtattcatgtcatcacgcccaataagaaagcaaattctgggccacttgatcggtacctgaaattacggactctgcagcgtgcctcatacactcattacttttatgaagcaactgttggtgctggcctcccaatcattagcaccctgcgaggtcttctggagacgggtgacaagatactgcgtatcgagggcattttcagtggaactttgagttatatatttaacaattttgaaggaacaagaaccttcagcaatgtcgttgctgaagcaaaagaggctggatacactgaacctgatccaagagatgatctatctgggactgatgttgccagaaaggtcattatcctggctagggaatcgggtttgaggcttgaactttctgatattcctgttaagagccttgtgccagaggcacttgcgtcatgctcatcggcagatgaattcatgcaaaagctaccatccttcgatgaggactgggcccggcaacgcagtgacgctgaggctgcaggcgaagtcctgcggtatgttggagtcgtggacgtggtgaacaaggagggccaagtggagctgcggaggtacaagagggaccacccgttcgcgcagctctccggctccgacaacatcatcgccttcaccacgtcgaggtacaaggagcagccgctgatcgtgcgggggccaggcgcgggtgcggaggtgacagccggaggcgtcttctgcgacatcctgcggctggcctcttacctgggcgccccgtcgtagggtagggtagccgagccctgtgacgaatctcctcagaggcagacggacaccattgtcctgcatgatgtctccgttgctcccgtatggacgagctgtgggtagtgtattgttctgagtgccagcaaataaggtccctcttgttagggaaggatgggctttggtgtcaggcgtggttgtttcatcgaatccagagttcatattaaactgataatgaagtgccaactcaataatgcaacaacgtttgcttgtggct

SEQ ID NO: 4017 - DNA, 3327 bp, Oryza sativa
ctgacaacaaatcgacaaccaaatttaatttatagtgtcattgtccaggttcatcagtagaaaacaaatctcgccaaaccttgcaaataaaaaaacaaaaaaaaaagaaacaaagtactcatccggatataattataattaactcggcaatttggttcgacgacgtgatgaaaaagccgcggcgggcgcgggcgtgcgcagctacgcggcgtgggtgcgggggttaaacaagggaaggggtttttggcgtcactcgcttctctctctcccctacgcgccgccggcgagatgcggagcctcgccgtcgcgagccccctcccgcccgccgccgcggttcgccgccggccacgcgcatccgcctccggaagggaagtgatttcacaatgttggaagtgtgagataaatcaggaccaacctttggggaactccctaaggataggtcactcacaaggtagtttgcaaagacatggttccaggaatttgctcgcagctgctgcggctatttcaattgaacaagctgaagtcagtacttatcttccaaaaggtgacatgtggtctgtgcacaagtttggtggcacctgtatgggaacaccccagagaattcagaatgttgctgatattgttcttggtgactcttctgagaggaagctgatcattgtttctgcaatgtccaaagtcactgacatgatgttcaaccttgtgcataaagctcagtcaagggataattcttatgtgactgcactggatgaagtttttaataagcatatggctgcagcaaaggaacttcttgatggagaagacctagcaagattcttggctcagttgcattctgacatcagtaacctgagagcgatgcttcgtgctatttttatagctggacatgcaacagaatcgttctctgatttcgttgttgggcatggagagttgtggtcagctcaaatgttgtcgtatgctataaaaaagtctggggtgccttgcagttggatggatacaagagaagttctagtagtgaaacctagtggttctaatcaggtcgatcctgactatttggaatctgagaagcgactccagaaatggttttcacgacaaccagcagagataataatcgctactgggtttattgccagtacagccgaaaacattcctactacgcttaaaagggatggaagcgacttctcagcatcaataattggatcccttgttagggcatgtcaggtcactatctggactgatgttgatggggtatttagtgcagatcctagaaaagttagtgaggctgtgatcttaagcacattatcttatcaggaggcctgggaaatgtcatattttggtgcaaatgttttgcatccccgcaccattatacctgtgatgaaagacaatattcctattgtcattaggaatatgttcaatctatctgcccctggaacaacaatttgcaagcagcctgctaatgaaaatgctgatttagatgcttgtgtcaaatcatttgctactatagacaaattggcccttgttaatgtggaaggaactggaatggctggtgttccaggtacagcaagtgccatatttagtgctgccaaggatgttggagctaatgttatcatgatatctcaggctagcagcgaacactcggtatgctttgctgttccagaaaaggaagttgcagcagtctcgacagccttgcatgttaggtttcgtgaggcattagcagctggaaggctatctaaggtcgaagtcattcgtgggtgcagcattcttgctgctgttggcttgaggatggccagtactcctggagtcagtgcaatcctttttgatgcattagcaaaggcaaatattaatgtacgagcaatagcccaaggttgcagtgaatacaatattactgttgtgttgaagcaagaagattgtgtgagggctttgagagctgttcattcaaggttcttcctctccaaaaccactcttgccgttgggatcattggaccaggtttaattggtggaacacttcttgaccagctgaaagatcaggctgctgttctcaaggaaaatatgaatattgatctacgtgttattggaatatctggctcaagaacgatgcatttgagtgacataggggtagacttaaaccagtggaaagagcttctacgaaaagaagcagaaccagcagatcttgatagttttgttcgccatttgtctgaaaatcatgtatttccaaacaaagttttggtggactgcacagcagatacatacgtagcatgccactattatgattggttgaagaagggtatccatgtcatcacgccaaataagaaagcaaattctggtccgcttgatcggtatctgaaattaaggactctgcagcgtgcatcgtatactcattacttttatgaagcaactgttggtgctggccttccaatcattagcaccctacgaggtcttctagagacaggtgacaagatattgcgtattgagggcattttcagtgggactttgagttatattttcaacaattttgaaggtacacgaacttttagtaatgttgttgctgaagcaaaagaagctggatatacagagccagatccaagagatgatctatcaggaactgatgttgccagaaaggttattatccttgcaagggagtctggtctgaggctcgagctttccgatattcccgtaaagagccttgtgccagaggcactgaggtcatgttcgtcagcagatgaattcatgcagaagctaccgtcctttgatcaggactgggacaggcaacgcgatgaagctgaagctgcaggagaagtgctgcggtatgtgggcgtggtggacgtggcgaacaggaagggccgggtagagctgcagaggtacaagagagaccaccccttcgcgcagctgtccggctccgacaacatcatcgccttcaccacgtcgaggtacaaggagcagccgctgatcgtgcgaggccccggcgccggcgcggaggtcaccgccggtggcgtcttctgcgacatcctgcggctggcgtcctacctgggagcaccctcctaggctttaaccttgagcgtcctgccttcctcgacaaaaattgtctggaggaagatgaggcgtattgattgtgcccgactggttattacatcatatatgggactggtagtatgcagtatgtatgttgtttctgaataagtgcgaggaaataaggtcttagaggtgctagatggtccttggatcaggtgttgtttttgccacacaatccagagccgcttgctatcgaactgccacattgtattggtgatttggagtgatctaataataatggcttaaatttctttttgctgagac

SEQ ID NO: 4018 - DNA, 3347 bp, Sorghum bicolor
tcgacaacgacgtcgtcaaaagccaggcgcactgccgcagcacaggccaaagcagcaggcagcaggctctgtgtactagggttaaagaagggtttttggcgtctagcagtccctttctgctgcgtcccgcattgcgttcctcgccctcttcccctctctcgggtctcggctctagccgtcgccgcgagcgagatgcagggcctcgcggtagcaagcccgcttcctcccgccgcggccgcagctcggcggcggccgcgcgcgtcctcctctaccagggaagcagtttcacaatgctggaagtacgaattaagtcgagatcaatatctaggaggcttcctaaggataagtcagtctcaaggaagcttgcacagacatcgctcaacaaatttgctcagaccagctgctgcagctatttcagttgaacaagatgaactcaatacttatcttccaaaaggtgatatgtggtctgtgcacaagttcggtggaacctgtatgggaacaccccaaagaatccagagtgtcgctgatatagttctcggtgattcttctgagaggaagctgataattgtttcagcaatgtccaaagtaaccgacatgatgtacaaccttgtacagaaggctcagtcaagggatgattcatatacaatagcattggaagaagtttttgagaagcatatggctgcagcaaaggatctccttgatggagaagatcttgcaagtttcttgtctcagctgcactcagacgtcagcaacttgcgagccatgctccgtgctatctatatagctgggcatgcgacagaatctttctctgactttgttgttgggcatggagaattgtggtcttcgcagatgctttcatatgcaataaagaagtctggggcaccctgcagttggatggatacaagagaagttcttgttgtaaaacccagtggttctaatcaagtagaccctgattgtttggaatctgagaagcgacttcagaaatggttttctcggcaaccagctgacataatagttgctacagggtttattgcaagtacagctgaaaacattcctacaactctaaaaagggatggaagtgatttctcagcagccataattggttctcttgtcagggcacgccaggtcactatttggactgatgttgacggggtatttagcgctgatccaagaaaagttagtgaggctgtgatcttaagaactttgtcttaccaggaggcctgggaaatgtcatattttggggcaaatgttttgcatccgcgcaccattatacctgtgatgaaagacaacattcccattgttattaagaacatgttcaatctctgtgcccctggaaccatgatttgcaagcagcctgccaatgaaaatggtgatttagacgcatgtgtgaaatcatttgctactatcgataatttagctcttgttaatgttgaaggaactggaatggctggtgttccaggtacagcaagtgctatatttagtgctgttaaagatgttggagctaatgttatcatgatatctcaggctagcagtgaacattcagtatgctttgctgttccagaaaaggaagttgctgcggtttctgctgcattacatgttaggtttcgtgaggcattagcagcagggaggttatctaaggttgaagttattaaaggttgcagcattctggctgctgttggactgaggatggctagcactcctggagtcagtgcaatactttttgatgcattagccaaggcaaacattaatgttcgagcaatagctcaaggttgcagtgaatacaatattactgttgtattgaagcaagaagattgtgtaagggctctgagagctgctcactcaaggttcttcctctccaaaaccacacttgctgttgggatcataggacctggtttaattggtggaacactccttaaccagctgaaggatcaggctgctgttcttaaggaaaatatgaacattgatctacgtgtcattggaataactggttcaagtacaatgcttttgagcgacacgggaatagacttaacccagtggaaacagcttctacaaaaggaagcagaaccagctaatattgatagttttgttcatcatttatctgataatcatatatttccaaacaaagttttggtggactgcacagcggatacaagtgtggcatcccattattacgattggttaaagaagggtattcatgtcatcacgccgaataagaaagcaaattctgggccacttgatcggtacctgaaattacggactctgcagcgtgcctcatacactcattacttttatgaagcaactgttggtgctggcctcccaatcattagcaccctgcgaggtcttctggagacgggtgataagatactgcgtattgagggcattttcagtggaactttgagttatatatttaacaatttcgaaggaacaaggccttttagtgatgttgttgctgaagcaaaagaggcaggatacactgaacctgatccaagagatgatctatctggaactgatgttgcccgaaaggtcattatccttgcaagggaatctggtttgaggctcgaacttcctgatattcctgtgaagagccttgtgccagaaacacttgcatcatgctcgtcagcagatgaattcatgcaaaagctaccaacctttgatgaggactgggccaggcaacgcagtgatgctgaagctgcagacgaagtcctgcgttacgttggagtggtggacacggtgaacaagaaaggacaggtggagctacgtagatacaagagggatcacccgttcgcgcagctctccggctccgacaacatcatcgccttcaccacctctaggtacaaggagcagccactgatcgtgcggggtccaggcgcgggcgcggaggtgactgcgggtggcgtcttctgcgaccttctgcggctggcgtcttacctcggcgctccttcgtagagcttccagctacagttgtcaatttcaagaggcagacggacacactgttctgcatgatgcctccggattgatcttatggacttgttcatatgttgttgtttctgaataagtgccaggaaataaggcctctatcttatgtagggagagagaggttcggctttgggatagccgactatgtgttgtttttgctcagaatccagaatcctgtgaattgaaatgaattataccaatggaacaaggtctactggaggtgtgatgtgagtatgccgggctcagcagtcagcaggtaacggaacggcaattagaaacaggcattcaaggtggagcaactacagaaaaaaagttctgaaaaggtttcagatgcaaaaaaaaatatatcacaaaattgacgcacaattctt

SEQ ID NO: 4019 - DNA, 3256 bp, Secale cereale
gactgcgggggggggggggggttaaagcagggtttttggcgtctagcctctccccgttgtcgccccctctctccccactgagcctcctctcctccccgccttccgcgccgcctcgccccgccgcgagatgcggagcctcgccgtcgcgagccccgtcccgccagccgccgcccatcggcggaggctccggccatccgcctccggcagggaagtagtttcacaatgtttgaagtgtgagataaatcaggaccgacctacgggagctctaaggataggtcactctcaaggaaatttgccaagacatggttcgaagaatctgctcacaccagctgctgcagccatttcagttgaacaagttgaagtcagtacttatcttccaaaaggtgatatgtggtctgtgcacaagtttggtggcacttgcatgggaacacctcagagaattcagaatgttgctgatgtagttcttggtgactcttccgagaggaagttgataattgtctctgcaatgtccaaagttactgacatgatgtacagtctcgtgcataaggctcagtcaagggatgattcttacatagaagaattgaataaagtttttgagaagcatatggctgcagcgaaagatcttcttgatggagaaaaccttgcaagatttttgtctcagttgcattcggacatcagtaatctgagagcaatgctccgtgctatttatatagctggacatgcaacagaatctttctctgaattcgttgttgggcatggggagttgtggtcatctcagatgctatcatatgctgtacagaagtctggagcatcttgtagttggatggatacaagagaagttctagttgtaaaacctagtggtcctgacatggtagatcctgattatgtggaatctgaaaagcgactccagaaatggttttcacgccaacctgctgagataatagttgctactggctttatcgcgagtacagctgaaaacatccctactactctgaaaagggatggaagcgatttctcagcagcaataattggttctcttgttagggcacgccaggtcacaatctggaccgatgttgatggggtatttagtgccgatcctagaaaagtcagtgaggctgtgatcttaagcacattatcatatcaggaggcctgggaaatgtcatactttggggcaaatgtgttgcatccccgtaccattatacctgtgatgaaagacgatattcccattgtcattaggaacatgttcaacctctctgcccctggaactgtgatttgcaagcagcctgctaacgaagatgctgatttggatgcttgtgtcaaatcatttgctactatagataaattggcccttgttaacgttgaaggaactggaatggctggtgttccaggtacatcaagtgccatatttagtgctgtaaaagaggtcggagctaatgttatcatgatatctcaggctagcagtgaacactcgatatgctttgctgttccagaaaaggaagttgcagcagtctctgcagccttgcatgttaggtttcgtgaggcattagcagcaggaaggctctctaaggttgaagtcattcatggttgcagcattcttgctgctgttggcttgagaatggcaagtactcctggagtcagtgcgatcctttttgatgcgctagcaaaggcaaacattaatgtacgagcaatagctcaaggttgcagcgagtacaatattactgttgtattgaagcaagaagactgtgtcagggctctaagagctgctcactcaaggttcttcctctcaaaaaccacacttgctattggggtcattggacctggtttgattggggcaacactgctcaaccagctcagggaccaggtagcagtcctgaaggaaaatatgaatattgatgtgcgtgtcatcggaataactggcgcaagcacgatgcttttgagcgacgcgggagtagacctaaccaggtggaaagaagaaatgcaaaaggaagcaaaaccagctgatcttgctaattttgttcgccatttgtctgaggaccatgtgtttccaaacaaagtattggtggactgcacagcagatacaaatgtggcatctcactactatgattggttgaagaagggtatccatgtcatcacaccgaataaaaaagcaaattctggtccacttgatcggtatctgaaactaaggactctacagcgtgcatcatatactcattacttttatgaagcaactgttggtgcgggcctgccaataattagcaccctgcgaggtcttctggagacaggtgacaagatattgcgtattgaaggcattttcagtggaactctgagttatattttcaacaattttgaaggaacaaggagctttagtgatgttgttgctgaagcaaaagaagctggatacaccgagccagacccaagagatgatctatctggaacagatgttgccagaaaggtcattatccttgcaagggagtctggtttgagacttgagctttcagatatcccggtagagagccttgtgccagaggcgctaaagtcatgctcgtcgccaaatgaattcatgcaaaagctaccatcgtttgaccaggattgggccagacagcgccatgaggctgaggctgcaggcgaagtactgcggtacgtgggagtggtggacgtgctgaacggaaagggaagggtagaactgcagaggtacaagagggaccacccattcgcccagctatctggttcggacaacatcatcgccttcaccacttcgaggtacaaggagcagccgctgatcgtgcgagggccgggcgcaggcgcggaggtgactgccggaggcgtcttctgcgacatcctgcggctggcgtcctacctcggcgccccctcatagacatctgtgcctgtattggtagattttgtggggtagatgaacggcaacttgtactcttcttgcacaatattggaattggtagtattttgttctgaatacttgcgaggaaagcaaataaggtgttttgttatgtttgccagtgtgctgttccttggtagggggtgtagggatcaggtgttttgttttgttttggtttgtttgccactcatgccagaactgttactcagtgcaataataaaaaagggatgctttacttaactaaaaaaacaaaaaaaaaaaaaaaaaaaagaaaaaaaaaaaaaaaagaaaaaaaaaaaaaaagaaaaaaaaaaaagaaaacgtaagaacgtagacgaacgacgaacgaacgaaggaggagag

SEQ ID NO: 4020 - DNA, 3123 bp, Zea mays
ctcgggtctcggctctcgccgtcgccactcgccgcgagcgagatgcagggcctagccgtatcatgccagcttcctcctgctgcggccgcagctcggtggcggccgcgcgcttcttcctctaatagggaagcagttttacaatgttggaagtatgaattaagtcaagaccactatttgggaggccccctaaggataggtcagtctcaaggaagtttgcacagacatcgctctacaaattttctcagaccagctgctgcagctatttcagttgaacaagatgaagtcaatacttatcttccaaaaggtgatatgtggtctgtgcacaagttcggtggaacctgtatgggaactcccaaaagaatccagtgtgttgcaaatatagttcttggtgattcttctgagaggaagctgatcattgtttccgcaatgtccaaagtaactgacatgatgtacaaccttgtacaaaaggctcagtcacgggatgattcatatgcaatagcactggcagaagtttttgagaagcatatgactgcagcaaaggatcttcttgacggagaagatcttgcaagattcttgtctcagttgcattcagacgtcagcaacttgcgagccatgctccgtgctatttatatagctgggcatgcgacagaatctttctctgactttgttgttgggcatggagagttgtggtctgcgcagatgctgtcgtatgcaataaagaagtctggggcaccctgcagttggatggatacaagagaagttctagttgtaacacccagtggttgtaatcaagtagaccctgattacttggaatgtgagaagcgacttcagaaatggttttctcgacaaccagctgagataatagttgctacaggatttattgcaagtacagctggaaacattccaacaactctaaaaagggatggaagtgatttctcagcagccatagttggttctcttgtcagggcacgccaggtcactatttggactgatgttgacggggtatttagcgcagatcctagaaaagttagtgaggctgtgatcttaagcactctgtcttaccaggaggcctgggaaatgtcatattttggggcaaatgttttgcatccgcgcaccattatacctgtgatgaaagacaacattcccattgttattaggaacatgttcaacctctctgcccctggaaccatgatttgcaagcagcctgccaatgaaaatggtgatttagacgcatgtgtcaaatcatttgctactgtcgataatttagcacttgttaatgttgaaggaactggaatggctggcgttccaggtacagcaagtgctatatttagtgctgttaaggatgttggagctaatgttatcatgatatctcaggctagcagcgaacattcagtatgctttgctgttccagaaaaggaagttgctgtagtttctgctgagttacatgataggtttcgtgaggcattagctgcagggaggctgtctaaggttgaagttattaatggttgcagcattcttgctgctgttggtctgaggatggccagcactccaggagtcagtgcaatactttttgatgcattagcaaaggcaaacattaatgttcgagcaatagctcaaggttgcagtgaatacaatattactgttgtattgaagcaacaagattgtgtaagggctctgagagctgctcactcaaggttcttcctctccaaaaccacacttgctgttgggatcattggacctggtttaattggtggagcactccttaaccagttgaagaatcagactgctgttctcaaggaaaatatgaacattgatctgcgtgtcattggaataactggctcaagtacaatgcttctgagcgacacgggaatagacttaacccagtggaaacagcttctacaaaaggaagcagaaccagctgatattggtagttttgttcatcatttatctgataatcatgtatttccgaacaaagttttggtggactgcacagcggatacaagtgtggcatcccactattacgattggttaaagaagggtattcatgtcatcacgccaaataagaaagcaaattctgggccacttgatcagtacctgaaattacggactatgcagcgtgcctcatacactcattacttttatgaagcaactgttggtgctggcctcccaatcatcagcaccttgcgaggtcttctggagacgggtgacaagatactgcgtattgagggcattttcagtggaactttgagttatatatttaacaatttcgaaggaacaagggcgtttagtgatgttgttgccgaagcaagagaggcgggatacactgaacctgacccaagggatgatctatctggaactgacgttgcccgaaaggtcgttgtcctcgcgagggaatctggtctgaggcttgaactttctgacattcctgtgaagagccttgtgccagaaacacttgcatcatgctcgtcagcagatgaattcatgcagaagctaccgtccttcgacgaggactgggccaggcaacgcagtgatgctgaggctgcaggcgaagtcctgcgttacgttggagcgttggatgcggtgaacaggagcggacaggtggagctacgcaggtacaggagggaccacccgttcgcgcagctctccggctccgacaacatcatcgccttcaccacgtcgaggtacaaggagcagccgctgatcgtgcggggtccgggtgccggcgcggaggtgacagccggtggcgtcttctgcgacattctgcggctggcgtcttacctcggtgctccttcttgagcttctactagctacaggtgccagtttcaggaagcagacggagacacactgccatgcatgatgcctcccctccgtgtttgggctattgctcacatgttgtaatgttgttctgaataagtgccaggaaataaggcctctagcgtatgtcgagagagagaggtcgttcggctttggaatagccgattaggtgttgtttttgctgcatgatgcaaatgaattatcgtaccaatgaagggatgtttgcttgtgcctactgccatgtatgctcataaaaaacaaggtctactggttacgcttacgcaggtacaaggtcacccgacagactag

SEQ ID NO: 4021 - DNA, 3339 bp, Brachypodium distachyon
ggggggttaaagcaggggttttggcgtctagcatttttgccgtcccctcctgctctctccccctctctgccgctgcactgcgccgcgcctcgccgccacccgcgagatgcggagcctcgccatcacgagccccgtcccgcccacctccgccgccgccgctaggcggcagccccggtcttccgcatctggcagggaggtggtttcacaatgtttgaagtgtgagataaataaggaccggcctttgggaggttatctaaggataggtcagtctcaaggaagtttgctaagacatggttccaagaattttatcgcacaagctgctgcagctatttcagttgaacaagatgaagtcagtacttatcttccaaaaggtgatatgtggtctgtgcacaagtttggtggcacttgcatgggaacacctcaaagaatccagaatgttgctgatatagttcttggtgactcttccgagagaaagctgatcattgtctctgcaatgtccaaagttactgacatgatgtacagccttgtgcataaggctcagtcgagggatgattcttacacgatggcattggatcaaatttttgagaagcatatggcttcagctaaggaacttcttgatggagaagaccttgcaaggttcttgtctcagttgcattcagacatcagtaacctgagagcaatgctccgtgctatttatatagctggacatgcaacagagtctttctctgaattcgttgttgggcatggagagttgtggtcagctcagattctgtcatatgctatacagaagtctgggacagcttgtagttggatggatacaagagaagttctagttgtgaaacctagtggttataacctggtagatcctgattatttggaatctaagaagcgactccagaaatggttttcacgacaacctgctgagataatagttgctactggctttattgcgagtactgctgaaaacattcctactactctgaaaagggatggaagcgatttctcagcagcaataattggttcccttgtgagggcacgtcaggtcacaatctggactgatgttgatggggtatttagcgcagatcctagaaaagttagtgaagctgtgatcttgagcacattatcatatcaggaggcctgggaaatgtcatattttggggcaaatgtgttgcatccccgtaccattatacctgtgatgaaagacaatattcccattgtcattaggaacatgttcaatctctctgcccctggaaccgtgatttgcaagcagcctgccaatgaagatggcgatttggatgcttgcgtcaagtcctttgctactatagataatctggcccttgttaatgttgaaggaaccggaatggctggtgttccaggtacatcaagtaccatatttagtgctgtcaaagatgttggtgccaatgttatcatgatatctcaggctagcagtgaacactcgatatgctttgctgttccagaaaaggaagttgcagcagtctctgcagccttgcatgttaggtttcgtgaggcattagcagcaggaaggctatctaaggttgaaatcattcatggttgcagcattcttgctgctgttggcctgaggatggcaagtactcctggagtcagtgcaatcctttttgatgcgctagcaaaggcaaacattaatgtacgagcaatagctcaaggttgcagcgagtacaacattactgttgtattgaagcaagaagattgtgtcagggctctcagagctgctcactcaaggtttttcctctccaaaaccacacttgctgttgggataattggacctggtttgattggcgcgacacttattaagcagcttggggagcaggtagctgttctcaaggaaaatatgaatattgatgtgcgagtggttggaataactggctcaagcacgatgcttttgagtgactcaggagtagacttaagcaggtggaaagaagatctacaaacagaatcaaaaccagctgatcttgctatttttgttcgccatttgtctgagaatcatgtatttccaaacaaagttttggtggactgcacagcagatacaaatgtagcatctcattattatgactggttgaagaagggcatccatgtcatcacgccgaataagaaagcaaattctgggccacttgatcggtatctgaaactaaggactctgcagcgtgcatcatatactcattacttttacgaggcaactgttggtgcgggcctcccaatcattagcaccctgcgaggtcttctggagacgggtgacaacatattgcgtatcgaagggattttcagtggaactttgagttatattttcaacaattttgaaggaacaaggagctttagtgatgtcgttgctgaagcaaaagaagctggatacactgagccagatccaagagatgatctatctggaacagacgttgccagaaaggtcattatccttgcaagggagtgtggtttgagacttgagctttcagatattcctgtcaagagccttgtgccagagccgcttacgtcatgctcatcggcggatgaattcatgcaaaagctaccatccttcgaccaggactgggcccggcaacgccatgaagctgaggctgcaggcgaagtactgcggtacgttggagtggtggacgtgctgaacaagaagggaagggtagagctgcagaggtacaagaaggatcacccgttcgcccagctatctggctccgacaacatcatcgcctttaccacctcgaggtacaaggaacaaccgctgatggtgcgagggccaggcgcaggcgcggaggtcaccgctggaggcgtcttctgcgacatcctgcggctggcctcctacctcggcgctccctcctagaccaatttacggaggcagatgcaaggcaacatgtactattcctggacttcgtattagtttgttgaacatgttagagggaatcaaataaggttgttcgtgggaggggccgggccgccgtgggggtggtggcttcactcctttgagttagatctcacgcaataactgttatcgaattataattataatacaataataataataaggggcgtaataataatgcctcttctgcgactgacggttttcgtattcattcgtattcgctctgtttcaaaatactccatctatttttttgtgggcatgcatgcattctgaggttcaactttgaccactcgttgtactataatacagtgtgtatcacaaaaaaatatgccactaagtttgtattgaagaagttttcaacgatatagtttttatgctgcataaaggtattgttgttgtacaagtcagagttaaattttcaatgcgtgcatgcccac

SEQ ID NO: 4022 - DNA, 2976 bp, Panicum virgatum
cgagcgcacaatgttggaagtatgacttaagtcaagaccgatctttgggaggctccgtaaggataggtcagtctcaaggaagttttctcacgcatcgttccacaaatttgctcagaccagctgctgcagctatttcagtcgaacaagatgacattaatacatatcttccaaaaggtgatatgtggtctgtccacaagtttggcggaacctgtatgggaacgccccaaagaattcagagtgtcgcagatattgtgctcggtgattcttctgagagaaagctggtcatagtttctgcaatgtctaaagtaactgacatgatgtacaaccttgtacataaggctcagtcaagggatgattcatatatgatagcactggaagaagtatttgagaagcatatggctgcagcaaaggatcttcttgatggggaagatcttgcaagctttttgtctcagttgcactcagatgtcagcagcttgcgagcaatgctcagtgctatttatatagctggtcatgccacagaatctttctctgactttgttgttgggcatggagagttgtggtccgcgcagatgttatcatatgcaataaagaagtctggagcaccatgcagttggatggatacaagagaagttctagttgtaaaacctagtggtcctaatcaagtagaccctgattacttagaatctgagaatcggcttcagaaatggttttctcgacaaccagctgagataatagttgcaacagggttcattgcgagtacagcagaaaacatacctacgacactaaaaagagatggaagtgatttctcagcagccataattggttctcttgtaagggcacgccaggtcactatctggactgatgttgatggggtatttagtgcggatcctagaaaagttagtgaggctgtgatcttaagcacgttatcctaccaggaggcctgggaaatgtcatattttggtgcaaatgtgttgcatccccgcaccattatacctgtgatgaaagacaacatccccattgttattaggaacatgttcaatatctctgcccctggaactatgatttgcaggcagcctgccaatgataatggtgatttagatgcttgtgtcaaatcatttgctactattgataacttggcacttgtcaatgttgaaggaactggaatggctggtgttccaggtacgtcaagtgccatatttagtgttgtaaaagatgttggagctaatgttatcatgatatctcaggctagcagtgaacattccatatgctttgctgttccagaaaaggaagttgctgcagtctctgctgccttgcatgttaggtttcgcgaggcattagcagcagggaggttatctaaggttgaagttattaatggttgtagcattcttgctgttgttggcttgaggatggccagcactcctggagtgagtgcaatgctttttgatgcgttagcaaaggcaaacattaatgttcgagcaatagctcaagggtgcagtgaatacaatattactgttgtattgaagcaagaagattgtgtaagggctctgagagctgctcactcaaggttcttcctctccaaaaccactcttgctgtcggaatcattggacctggtttaattggtgggacactccttaaccagctgaaggatcaggctgctgttctcaaggaaaatatgaacattgatctgcgtgtcattggaataacaggctcaagtacaatgcttttgagtgacacgggaatagatttgacccagtggaaagagcttctacgaaaggaagcagaaccagctgatcttgctaattttgttcgccatatgtctgataatcatgtgtttccgaacaaggttttggtggactgcacagcagatacaagtgtagcatcccactattacgattggttaaagaagggtattcatgtcatcacgccgaataagaaagcaaattctgggccacttgatcagtacctgaaattacggacactgcagcgtgcctcgtacactcattacttttatgaagcaactgttggtgctggcctgccaatcattagcaccctgcgaggtcttctggagacgggcgacaagatactgcgtattgagggcatttttagtggaacattgagttatatatttaacaattttgaaggaacaaggacctttagcgatgttgttgctgaagccaaagaagctggatacactgaacctgatccaagggatgatctatctggaactgatgttgcccgaaaggtcatcatcttggcaagggaatctggtttgacgcttgaactttctgatattcctgtgaagagccttgtgccagaagcacttgcggaaagtcatgctcatcggcagatgaattcatgcaaaagctaccatcctttgatgaggactgggccaaacaacgtagcgaggcagaggctgcaggcgaagtcttacggtacgtcggagttgtggatgcggtgaaccagaagggacaggtggagctgcgcaggtacaagagggaccacccgtttgctcagctctccggctccgacaacatcatcgccttcaccacgtcaaggtacaaggagcagccgctgattgtgcgggggccaggtgcaggcgcggaggtgacggccggaggcgtcttctgcgacatcctgcggctggcatcttccctcggcgccccctcataggtctgggctgctgacaaatttctagaggcagacggacaccattgtcctgtatgatccctccgtttgatcccgtttatggatggacttgcattgttctcaataataagtgcccggaaataaggcctctctggttagcaaaggttcggctttgggctagccgactaggcggtgtggtgtggtgtggtggtgtggtgtttcatcgaatccagaattcatatcgaattggtaatgaagtgccaactcaataatgtttgcctgtgcctattgctgtgcttcgatctgcaaatcctcggacccgaatgcaa

SEQ ID NO: 4023 - DNA, 2964 bp, Triticum aestivum
gcccatcgacggaggctccggccgtccgcctccggcagggaagtagtttcacaatgtttgaagtgtgagataaatcaggaccgacctatgggagctctaaggataggtcactctcaaggaaatttgccaagacatggttcgaagaatctgctcacaccagctgctgccattccagttgaacaagttgaagtcagcacctatcttccaaaaggtgatatgtggtctgtgcacaagtttggtggcacttgcatgggaacacctcagagaattcagaatgttgctgatgtagttcttggtgactcttccgagaggaagctgataattgtctctgcaatgtccaaagttactgacatgatgtacagtctcgtgcataaggctcagtcaagggatgattcttacacagaagaattggataaagtttttgagaagcatatggctgcagcgaaagatcttcttgatggagaaaaccttgcaagatttttgtctcagttgcattcggacatcagtaacctgagagcaatgctccgtgctatttatatagctggacatgcaacagaatctttctctgaattcgttgttgggcatggggagttgtggtcatctcagatgctatcgtatgctgtacagaagtctggagcatcttgtagttggatggatacaagagaagttctagttgtaaaacctagtggtcctgacatggtagatcctgattatgaggaatctgagaagcgactcgagaaatggttttcacgccaacctgctgagataatagttgctactggctttatcgcgagtacagctgaaaacatccctactactctgaaaagggatggaagcgatttctcagcagcaataattggttctcttgttagggcacgccaagtcacaatctggaccgatgttgatggggtatttagtgccgatcctaggaaagtcagtgaggctgtgatcttaagcacattatcatatcaggaggcctgggaaatgtcatactttggggcaaatgtgttgcatccccgtaccattatacctgtgatgaaagacaatattcccattgtcattaggaacatgttcaatctctctgcccctggaactgtgatttgcaagcagcctgctaacgaagatgctgatttggatgcttgtgtcaaatcatttgctactatagataaattggcccttgttaacgttgaaggaactggaatggctggtgttccaggtacatcaagtgccatatttagtgctgtaaaagaggtcggagctaatgttatcatgatatctcaggctagcagtgaacactcgatatgttttgctgttccagaaaaggaagttgcagcagtctctgcagccttgcatgttaggtttcgtgaagcattagcagcaggaaggctctctaaggttgaagtcattcatgattgcagcattcttgctgctgttggcctgagaatggcaagtactcctggagtcagtgcaatcctttttgatgcgctagcaaaggcaaacattaatgtacgagcaatagctcaaggttgcagtgagtacaatattactgttgtattgaaacaagaagattgtgttagggctctaagagctgctcactcaaggttcttcctctcaaaaaccacacttgctattggggtcattggacctggtttgattggggcaacactgctcaaccagctcagggaccaggtagcaatcctgaaggaaaatatgaatattgatgtgcgtgtcatcggaataactggcgcaagcacgatgcttttgagtgaaacgggagtagacctaaccaggtggaaagaagaaatgcaaaaggaagcaaaaccagctgatcttgctaattttgttcgccatttgtctgaggaccatgtgtttccaaacaaagtattggtggactgcacagcagatacaaatgtggcatctcactactatgattggttgaagaagggtatccatgtcatcacaccgaataaaaaagcaaattctggtccacttgatcggtatctgaaactaaggactctacagcgtgcatcatatactcattacttttatgaagcaactgttggtgcaggcctgccaataattagcaccctgcgaggtcttctggagacaggtgacaagatattgcgtattgaaggcattttcagtggaactctgagttatattttcaacaattttgaaggaacaaggagctttagtgatgttgttgctgaagcaaaagaagctggatacactgagccagacccaagagatgatctatctggaacagatgttgccagaaaggtcattatccttgcaagggagtctggtttgagacttgagctttcagatatcccggtagagagccttgtgccagaggcgctaaagtcatgctcgtcgccaaatgaattcatgcaaaagctaccatcgtttgaccaggattgggccagacagcgccatgaggctgaggctgcaggcgaagtactgcggtacgtgggagcggtggacgtgctgaacggaaagggaagggtagaactgcagaggtacaagagggaccacccattcgcccagctatctggttcggacaacatcatcgccttcaccacttcgaggtacaaggagcagccgctgatcgtgcgagggccgggcgcaggcgcggaggtgactgccggaggcgtcttctgcgacatcctgcggctggcgtcctacctcggcgccccctcatagacatctgtgcctgtattggtagattttccggggtagatggacggcaactgtactcttcttccacaatattggacctggtagtattttgttctgaatacttgcgaggaaagcaaataaggtgttttgttttgtttgccgtgcgctgttccttggtagcgggtgtagggatcaggtgttttgttttgttttgtttgccacccaggccatgccagaactgttactaaattatcaatgcaataataaagaagggaatgcctcttt

SEQ ID NO: 4024 - DNA, 2941 bp, Triticum aestivum
ggcagggaagtagtttcacaatgtttgaagtgtgagataaatcaggaccgacctatgggagctctaaggataggtcactctcaaggaaatttgccaagacatggttcgaagaatctgctcacaccagctgctgccatttcagttgaacaagttgaagtcagtacctatcttccaaaaggtgatatgtggtctgtgcacaagtttggtggcacttgcatgggaacacctcagagaattcagaatgttgctgatgtagttcttggtgactcttccgagaggaagctgataattgtctctgcaatgtccaaagttactgacatgatgtacagtctcgtgcataaggctcagtcaagggatgattcttacacagaagaattggataaagtttttgagaagcatatggctgcagcgaaagatcttcttgatggagaaaaccttgcaagatttttgtctgagttgcattcggacatcagtaacctgagagcaatgctccgtgctatttatatagctggacatgcaacagaatctttctctgtaatttcgttgttgggcatggggagttgtggtcatctcagatgctatcgtatgctgtacagaagtctggagcatcttgtagttggatggatacaagagaagttctagttgtaaaacctagtggtcctgacatggtagatcctgattatgaggaatctgagaagcgactcgagaaatggttttcacgccaacctgctgagataatagttgctactggctttatcgcgagtacagctgaaaacatccctactactctgaaaagggatggaagcgatttctcagcagcaataattggttctcttgttagggcacgccaagtcacaatctggaccgatgttgatggggtatttagtgccgatcctagaaaagtcagtgaggctgtgatcttaagcacattatcatatcaggaggcctgggaaatgtcatactttggggcaaatgtgttgcatccccgtaccattatacctgtgatgaaagacaatattcccattgtcattaggaacatgttcaatctctctgcccctggaactgtgatttgcaagcagcctgctaacgaagatgctgatttggatgcttgtgtcaaatcatttgctactatagataaattggcccttgttaacgttgaaggaactggaatggctggtgttccaggtacatcgagtgccatatttagtgctgtaaaagaggtcggagctaatgttatcatgatatctcaggctagcagtgaacactcgatatgttttgctgttccagaaaaggaagttgcagcagtctctgcagccttgcatgttaggtttcgtgaggcattagcagcaggaaggctctctaaggttgaagtcattcatgattgcagcattcttgctgctgttggcctgagaatggcaagtactcctggagtcagtgcaatcctttttgatgctctagcaaaggcaaacattaatgtacgagcaatagctcaaggttgcagtgagtacaatattactgttgtattgaagcaagaagattgtgtcagggctctaagagctgctcactcaaggttcttcctctcaaaaaccacacttgctattggggtcattggacctggtttgattggggcaacactgctcaaccagcttagggaccaggtagcagtcctgaaggaaaatatgaatattgatgtgcgtgtcatcggaataactggcgcaagcacgatgcttttgagtgacacgggagtagacctaaccaggtggaaggaagaaatgcaaaaggaagcaaaaccagctgatcttgctaattttgttcgccatttgtctgaggaccatgtgtttccaaacaaagtattggtggactgcacagcagatacaaatgtggcatctcactactatgattggttgaagaagggtatccatgtcatcacaccgaataaaaaagcaaattctggtccacttgatcggtatctgaaactaaggactctacagcgtgcatcatatactcattacttttatgaagcaactgttggtgcgggcctgccaataattagcaccctgcgaggtcttctggagacaggtgacaagatattgcgtattgaaggcattttcagtggaactctgagttatattttcaacaattttgaaggaacaaggagctttagtgatgttgttgctgaagcaaaagaagctggatacactgagccagacccaagagatgatctatctggaacagatgttgccagaaaggtcattatccttgcaagggagtctggtttgagacttgagctttcggatatcccggtagggagccttgtgccagaggcgctaaagtcatgctcgtcgccaaatgaattcatgcaaaagctaccatcgtttgaccaggattgggccagacagcgccatgaggctgaggctgcaggcgaagtactgcggtacgtgggagtggtggacgtgctgaacggaaagggaagggtagaactgcagcggtacaagagggaccacccattcgcccagctatctggttccgacaacatcatcgccttcaccacttcgaggtacaaggagcagccgctgatcgtgcgagggccgggcgcaggcgcggaggtgaccgccggaggcgtcttctgcgacatcctgcggctggcgtcctacctcggcgccccctcatagacatctgtgcctgtattggtagattttccggggtagatggacggcaacttgtactctttttccacaatattggacttggtagtattttgttctgaatacttgcgaggaaagcaaataaggtgttttgttttgtttgccagtgtgctgttccttgttagggggtgtagggatcaggtgttttgttttgttttgttttgtttgccacccatgccagaactgttactaaattatcaatgcaacaataaagaagggaatgtctctttctacaa

SEQ ID NO: 4025 - DNA, 1022 bp, Saccharum officinarum
aacaaagccgagcagggaaatggcggccgtctcctcctccacctccaccgcctacttctcctcgcagccgcagctgccgacctccaccgccgacccgacggccgccgccgccagcagcagtttggtgcggcagccacggcgaagcagcagcttcgtgatggtggaggcgtcctctgccagcagcagcgacggcggggtggccaggacgaagagcctcacggaggacgacctggaggagctcaagggctgcctcgacctcggcttcggcttcgcgtacagcgagatccccgagctctgcgggacgctgcccgcgctcgagctctgctactccatgacccggaggttcctcgatgagcagaaggcgcccgggcaggagcaagaggaggagcctgcgtcgccaccgctccccaactggaggatctctggaccgggtgacgatccagaggaagtgaaggccaggttgaagtattgggctcaagcagtagcatgcactgtcaagctctgcagctaaactagaggctggctagctgctttctgttagtgtacgctatgacggctgaaccgaagaaggtcggttggaggttgaagaatctggtttatatgcttctgggatacggggagcgaaagggggtgcttctgctctctggcatggaagcaacatgagtgatctcatctgcttctgcaaaaacttgggagggggaggaatcatgatctggaacagcgacagacctcgattgagatccatggtctgagcttctacgaaaggattcagaagcttgtcactcctcagcgtgggtggtctgcataatgcagcgtttgcaaatgcaggacctgttggttcttttgctgtttccctgtaatgatcactacgtgttctaattgtcgtactcctgtaataatgtactgaatggagttttgagttttggctactaatccaagggttgattagttccaatattgatttattttgtgctactctgatattgccatgtactacgtgaacatatatgtagattatgctg

SEQ ID NO: 4026 - DNA, 1320 bp, Sorghum bicolor
aattaccacataaatataaattgcctaataaagtactctaaaagatactaccctacaaaaaccatttttaaaccaagaaacactcgcttcgtttataaataggctagacgcccaactcgaacctgagtacctgaagcagcatcagacaaacaaaaccgagcagagaaatggcggccgtctcctccacctccactgcctacttctcctcgcagccgcagctgccgacctccaccgccgaccctacttccgacgccgccagcagcaggctggtgcggcagccacggcggagcagcagcttcgtgatggtggaggcgtcctctgccagcggcagcgacggcggggtggccaggacgaagagcctcacggaggacgacctggaggacctcaagggctgcctcgacctcggcttcggcttcgcgtacagcgagatacccgagctctgcgtgacgctgcccgcgctcgagctctgctactccatgacccggaggttcctcgacgagcagagggcatcggggcaggagcaggaggaggagcctgcgtcgccaccgctccccaattggaggatctctggaccgggtgaccatccagaggaagtgaaggccaggttgaagtattgggctcaagcagtagcatgcactgtcaagctctgcaggtaaacttgaggctggctagttgctttctgttagtgtatgctatgacgggctgcaccgaaggtcagttggaggttgaagaatctggttatatggttttgggacacggggagcaaattctcctcggagggggcgcttctgctctctggacatgagtgatctcatctgcttctgcaaaaacatgggagggggaggaatcatgatccagaacagcgacagagttcaatcgagatccatggtctgagcttcttcgaaaggattcagaagcttgtcattcctctgggtgggtggactgcataatgcagcgtttgcaaatgcaggacctgttggttcttttttcatgtttccttgtaatggtcactaggtgctctaattttcgtactcctgtaataatgtactgaatggagttttgagttttggctactaatccaagggctgattagttccaatattgattttttttgtgctactctgatattgcctgaacatatatgtattgctgttaaatttgtgaaagtaaagaaagtgtctggttgcttgtcaagcttcagttgtgtaaaagatgtatttattcagcctagctgcaaattagctgaaactctgtaaagaagaaactccactgatttgtaacacgcataatacataatgatctactgatcttgcgtttcta

SEQ ID NO: 4027 - DNA, 1051 bp, Setaria italica
gccgagccaaacggagcacagaaatggaagccgtctcctccaccgcctacttctcctcgcagccgcagctcccggcctccaccgccggcgaccctgcgacccccatcgcaagcgccagcaggctggtgcggcagccgcgccggaacagcagcttcgtgacggtcgaggcgtcctcgggcaccggcggcgacggggtggtcaggacgaggagcctcacggaggacgacctggaggagctcaagggctgcctcgacctcggattcggcttcgcgtacagcgagatccccgagctctgcgggacgctgcccgcgctcgagctctgctattccatgacccggaggttcctcgacgagcagagggagccgggccaggagcaggagacttcggcgacgcctctcccgaattggaggatctctggacctggcgatgatccagaggaagtgaaggcgaggttgaagtattgggctcaagcagtagcatgcactgtcaagctctgcagctaatggaggctggctagctgttttctggtagagtatgctatgacaggatgaactgaaggttggctggaagttgaggaatctgcctgtatgggtttgggatatgggatgcagatactcctcaggagctgcttctgcttcgtggcatcgaagcagcatgagtgatctctgcttctgcaaaaactttggaggggaggaatcatgaccttggaattacagcgacgagactcgatgcgattcatggtccgagcttctacgaaagaatcagaagcttatcattcctcagggtggtttgcataatgcagcgtttgcaaatgcaggacctgctggttctttttgccttttccgtgtaatgatcactaggtgctctaattgttgttcacctgtaataatgtttttgggtactaatccaagggttgattagttccaataatgctttgttctgtgctacatggatgtggtcacttcatgaacaggtatgtagattattctgttctacaaaatttacaagagtgcagcaaagtgtttggctgatttgcaaggctcagtcatgt

SEQ ID NO: 4028 - DNA, 935 bp, Panicum virgatum
  misc_feature (845)..(845): n is a, c, g, or t
  misc_feature (870)..(870): n is a, c, g, or t
gcgccatcacccccaaccgaaccgagcagagaaaatggcggcgatctcctccaccgcctacttctcctcgcagccgcagctcccgggctccaccgcggaccgtgacgccgccaccaccgcaagcagcgggctggcgcggcagccgcgccggagttgcagcttcgtgatggtcgaggcgtcctccggcaccggcggcggggtggtcaggacgagaagcctcacggaggacgacctggaggagctcaagggctgcctcgacctcggcttcggcttcgcgtacagcgagatccccgagctctgtgggacgctgcccgcgctcgagctctgctactccatgacccggaggttcctcgacgagcagagggcgccgggcaaggagcaggagaacgcggcgacgcccctcccgaattggaggatctctggacctggtgacgatccagaggaagtgaaggtgagattgaagtattgggctcaagcagtagcatgcactgtcaagctctgcagctaatggaggctggctacctgttttctggcagtgtgtgctatgacgggctggaggttgaagaatctgcttatgtgggtttgggatatgggggcacatactcctcaggtcctgcttctgcttcgtggtactgaagcaacataagtgataactgcttctgcaaaagtttggaaaggaggaatcatgaccttgggattgcagcgacgagactcgatgcgatccatggtctgagcttttctgaaagattcggaagctcatcattcctcagggtggtctgcataatgcagcgtttgcaaatgcagaacctgctggttcttttttgcctttcccttgtaacgatcancaggtgctctaattgttttacaccngtaataatgtactcggtggggttttaggttctaatccaagggttggttagttccaatgatgcttc

SEQ ID NO: 4029 - DNA, 1975 bp, Panicum virgatum
tattaggttcaattcaaatagaactcctctaggatttgatcacctccaaaatctcttttacggacgcagcccaagcaagaagtaaaataatttaaataacatgttctgtaatgtcgctgaaatttggaaagcaaatgactttcatttttggaaaaaaaggtttccttagactgtcaaaaataaaccttagaaatggaggcacagccatggaagaagattttgaatttaatctagtcttcctttattctaggtgcacataagacaatagttcaatgacagcttccaataagtgtagcgaaagggaaaaaaaagacacacggcaaatgtcaatattattacaagagcgcgagtccgatcagatccgactgtctccggcagtccggcactctctcttctccggttgtagagcacgggaggcttacgggtgggtcccattcttgcgtccagtctggtgggccgtcccattcgtttaatgtttcgggcccacgtaccagtgagacgatttacgggagctaaaccacatttctaccgagaatagcccggaatcaccaacgcggcggcggcgacgacgaatctaggcgcgacgaaagcggcggctatggcggcggcagttgaaagcgtggtggtggtccacaacgtggcgaagcggcacaacgtggggacgctggcgcggagcgcgacggcgttcggcgtcgcggaggtggtcgtcgtcggccgccgcgacgtcagcgccttcggcagccacggcgccacctcgcacctccgcttccgccacttcgcctcgctcgccctcgcccgtgcctacctcaaggatgaaagagggtgtgacatttgcggtgttgagatcactgacgacgcccagccggtgactgctcacccgttccgtcggagcaccgccttcctattcggcaatgagggtacaggactctcacaaaaagagtgtgagatctgcgacttctttgtctacatccctcaatatggtggtggaacagcatctctcaatgttacagttgcagcttcaatcgttctccaccactttgcagtctgggctggctttcctgaacgaggcagagagggcaacaaattcattgtagctgatagaccacaagggtactcgagggggctttactgtacggactcaattgaagcagtgattgaagagcgtaaaatgcgaaaagaaaatgcatgtgatatactagaggaaaatggaagcagccatccccaagaatcaaatggcctagatttgatgtttacagactaggcttatgactggacgacattgttacatcatggttgttgaatcaagtcccgggttggggttgatggagcaaatttgcgatactgcaacgcataacagaaatgtctttccaaggccgagagtagaacatgcatgttttttcaaccttggcatggagcagaaaaggatgcactgagcttttgggaagccagggggtgagtgtaccttgaaacagagggcgtggacgaagctctgtttcgctccgattgtttgccttttatgttgtacaaaacaaggtgtggtgcctgctatcagaattcctcagttgtaatgtagccatgaaggtggttgatacctcattcctgacatagaactacctcacattgcacgaagttggatggtagacttcaatggtatttttttcattagcctttggaccatctagtctttgttatacctcaatacgacaaagactggtgagatgcccttcaggtgttgacatttttggatggtagacctcaatggttctttttcaacattggtctgggtcatttagtctattctttttttggggttagaggatcatgttactggaactggaagtagtagtaggctgtaggcatgtgcctccgctatgggataaggcagcggggcatatttctcttttccagttacctctcagttataatgagtagaataataggtgcagtgtctcagttataatgagtagttttataa

SEQ ID NO: 4030 - DNA, 2033 bp, Panicum virgatum
cggtaacgtcgcgctctcagcaggtcctgagttcgattctcatcagaagcgaattttaggctgctgagagaaaaaaaaaaaccctcgctgtgctcgccgtaaggcttggccctcacgggcatgggccaggattcggggggtttctctacccgggtaagccggtgtggcttcctcttaatgaaaaaacggtggggtcgtttcttcccccgggtagagtttttttttaatttagtctttttcctttttattctaggtgcagtttccaccaatagcaaaaaggaaaacacgtcaaacgtcaagattattacaaagagcacaggggttttgtaggtagtaacaaactcgggcagagcacacatgtagtcttagcgttcacttgaggagggtgttaacaatggacttcttttttttcaaaaaagttaacaatggacttgacattcagcttcaggtcgttgtcctgcatacgctcagctgtgtcgacaagaacaacatctgatttggtccgtgtcgcttcttggatcgcttgcttcgctaccactgccggatctcttctccggcagatccgactcgatctcttctccggttgtagagcacggcacttacaggtgggtcccacttgcgtctggtctggtgtgcggtcccatactcccattcgtttaatgtttcgggcccacgtaccagtgagacggttaacgggagctaaaccacattgctcccgagagcatagcccggagtcaccaaggcggcggctatggcggcggcgacaacgaatctagcaggcgcgacgaaaccggcggctatggcggcggcggttgagagcgtggtggtggtccacaacgtggcgaagcggcacaacgtggggacgctggcgcggagcgcgacggcgttcggcgtcgcggaggtggtcgtcgtcggccgccgcgacgtcagcgccttcggcagccacggcgccacctctcacctccgcttccgccacttctcctcgctcgccctcgcccgtgcctacctcaaggatgaaagaggatgtgacatttgcggtgttgagatcactgacaacgcgcagccggtgactgctcacccgttccgtcggagcaccgccttcctattcggcaatgagggcacaggactctcacaaaaagagtgtgagatctgtgacttttttgtctacatccctcaatatggtggtggaacagcatctctcaatgttacagttgcagcttcaattgttctccaccactttgcagtctgggctggctttcccgaacgaggcagagagggcaacaaattcattgtagctgatagaccacaggggcactcgagggggctctactgtacggactcaattgaagcagtgattgaagagcgtaaactgcgaaaagaaaatgcatgtgatatactagaggaaaatggaagcagccatcctcaagaatcaaatggcctagatttgatgtttacagactaggcttatgactagatgacattgttgcatcatggtttaattgaatcaagtcccgggctggggttgatggcataacggaaatgtctttccaaggccaagaacagagcatgcgtgttttttcaaccttggcatggagcagaaaagagtgtactgagcttttgggaagccagggggtgagagtgtaccttgaaaccaaggatgtggacaaagctccgtttcgctccgattttttgccttttatgttgcacaaaacaagatgtggtgcgcgctatcagaattcctctgttgtaatgtagccgtgaaggtggttgacacctcatacctgacatagaagtatagaactacctcacttcgcaggaagttggatggtagacttcaatgggttttttcaattagcctttgggtcatctagtctttgttatacctcaatacgacaaagactagtgagatgcccttcaggcattgacattttcggatggtagacctcaatggttattttcaacattagtctggaccatctagtctattcttttttggtgtggaggatcatgttatacgtcaatactataaagac

SEQ ID NO: 4031 - DNA, 3498 bp, Setaria italica
atcaatttagttttcttctaagtgcaaatatgactataagtagaattcatggcactttgtaccaagtataacaaaaaggtacacgtccaatgcgaagattattacaaagagcatagggaactgaaggtagtaaccaacaagggcagagaacgcatgtagtagtagcgtcacttgaggagggtgttaacaatggacttgacattcagcttcttcaggtcggtgtaagactgaccgcatcccacgaacataaccggagccccagaaacgtaaaccatggaaagcgctgctccaaccttgtcgtcgacggtgtcaaacttgctaagcaggataccatcaatcaaccttgcagctggaacaggcgacaggtcggccagtttctggttgaactgggtcagctgatcgacggcgtcgtttccaaccagcgcttcccgacgaacaagaccaggtccgggctgttgaggttgatgagcttggagagcgccctcatgagcggttcgttgtcctgcatgcgcccagcagtgtcgacaaggacaacatctgatttggtccgggttgcttcttggatcgcttgcttcgctacgactgccggatctctttcatagcccttctcaaagatcggtatctggagcctgcgagcatgggtgcgtagctgctcaacggcaccagacctgaaggtatcacaagctgcaagggtcacactgaggtcatgctggaggagccagtaagcgacctttgcaagattggtggatttgccgactccattcaccccaacgaatacgatgacatacggcctctcacgctccttggcagcgtgcacgtctctcagaatgtcaatggatcggcttggggtcagaatgcgaagaagagcctcctccatggctgcctggacggtggaagctatgcttgtgaaagatcctaccttcttgccctcaaggcttgctgcaatcgattcgcaaagcttctctgcgatctcctccgcaacgttcttggtcatcagcctgtctttcagagctttgaccgcaggctgcagatcagacttgccaattacactgttacctgctgcaatgctctggaacactgaggagaaccatcctttcgctttggagacatctccaacctgttcatccttgtccatcttgcttagtccctccttgactgccacatgatcagtcaccttgcccctttcagctgggtctgagaaatccagcttcttgtgggaaggctccttgtcgtggtccttttgtcttccctttttgtcgggtttgttcttctttgtgtcagtgttcttactatgaatgaacttgtctcgcaggaattgtaacatactcagattgaaggccccgccatctttgggttcgggttctcctgaatattcgtccttcccggagtcaccgtcggagccgtcctgcttcctcccaccagcattacccccagaatctccaggaacattggaatcaacgtcgtgcgacaccgatggtggcggcgccggacgtgactcaataggcgcttgtttagacttgttcatctcctcggcgcgcgcttgggcttcgaggtggagctgccggaacacgtcgctgaagccgtcgtagttggtgcgcttggggtggtagatccgcgcgaactccgcgcggacggcggcgaggaggtcgtcgacgtagaggaggcggagcacgcgccggtacaccgccacgaagacgaggccgagcccgttgtggaaggcccacttgaacgctcgcttgccgtcctgggaggcgccggtgccgtcggcggaccggtcctcgaggaggcaggagcggatgagtgcatcgatgggggaggccttgacggcagcgccgccgctgccgctgagcgcccacaggatcaggccgccgcgcgtgaagatgagcagctcctccagcatcttgcccggccggcgaaccttcgggtcgatgcggatcccttctcgtctcacggagggcgaaaatttgggcggtagttcgcggcggcgaggcggcggttatatcggagagtcaccgtctccgatcggatcggactctcctatcctcccggctgtctccagagtcctaaccgaatcggtctccgttcaatggcacgggctctatgacagcgccaagatctacggcgccaagcttggcgtcatgatggatggcgccaagcccccgctacgtcggcatccacgtcagcagctgcgcatggaccttggcgctagggtggctggcggccgagacgtgtattccgccaggggtgtatttatgagaatctttcgtaaaaaggccccacatatcagtgaggcggtgcacgggagctatccctacggagtcggcgacatcaacacagcggcggcggcaacattgaccccgacgaatcgagcaggcgcggcgaagacggcggctatggcggcggcggcggcagtggagagcgtggtggtggtccacaacgtggcgaagcggcacaacgtggggacgctggcgcggagcgccacggcgttcggcgtcgcggaggtggtcgtcgtcggccgccgcgacgtcagcgccttcggcagccacggcgccacctcgcacctccgcttccgccacttcgcctcgctcgccctcgcccgcgcgtacctcaaggatgagagagggtgtgacatttgcggtgtggagataaccgatgacgcgcagccggtgaccgctcacccgttccgccggagcaccgcgttcctattcggcaacgagggtacaggactctcacaaaaagagtgtgagatctgtgacttctttgtctacatccctcagtatggtggtggaacagcatctctgaatgttacagttgcagcttcaattgttttccaccactttgcagtctgggctggctttcctgaacgaggcagagagggcaacaaattcattgtagctgatagacctcaggggcactcgagggggctttactgtacagactcgattgaagcactgattgaagagcggaaaatgcgaaaagaaaatgcatgtgatatacttgaagaaaatggaagcagccatcctcaggaatcaaatggcctagatttgatgtttacagagtaggcttatcactagacagcgttattacatctcgtttgttgaatcaagtccctgcgttggggttgatgacgcagatttttgcaatactacaacgcataacagaaatgtatttccaaaagagcgagaagtagaacacagattttctttccaaccttggcatggagcagaagggcgcaccgagcttttgtgaagccagggggtgagagtgtaccttgaaacccagggagtggttaaagctctgtttcgctcagattgcttacttttttatgttcccatgtaaaacaagatgtggtgcctgttgcttattggaattgctctgttgtaatgtagccacctaggggtttgatacttggcacctgacttcctcactttgcaggaagttggatgggggagtttgtatttgctcttcaaatatgaaatttattcagagttgccatcc

SEQ ID NO: 4032 - DNA, 1023 bp, Sorghum bicolor
tttgccgagcataacccgagccagcggcggcggcggcggcgaatcgagcaggcgcggcgggcatggcggcggcggtggagagcgtggtggtggtccacaacgtggcgaagcggcacaacgtggggacactggcgcggagcgcgacggcgttcggcgtcgcggaggtggtcgtcgtcggccgccgcgacgtcagcgccttcggcagccacggcgccacctcacacctccgcttccgccacttcgcctccctcgccctcgcccgcgcctacctcaaggaagagagagggtgtgacatttgcggcgtggagatcaccgaagacgcgaagccggtgaccgcgcatccgttccatcggagcacagcgtttctctttggcaatgagggcacaggactctcacagaaagagtgtgatatctgcgacttctttgtctacattcctcagtatggtggtggaactgcatctctcaatgttaccgttgcagcttcaattgttctccaccactttggggtctgggctggctttcctgaacgaggccgagagggcaacaaattcattgtggctgatagaccacaggggcattcaaggggcctttactgcacagactcaattgaagcagtgattgaagagcggaaaatgcgaaaagaaaatgcatgtgatatacttgaggaaaatggaggcagccatcctcaggaatcaaatggcctagatttgatgtttacggactagacagtattgcatctctgttgttgaatcaagtcacagcttaggtgtcgatgacacaaattcgcaatactacaatgcatgacaggaatccctttccaagggaaagaagtagaacactttttgtttttttgctagcttggcatggagaaggtgcaccgacctttttgtgaagccatgggggatggttaatagtgtaccttgaaaccaagggtacaggtaaagcacttgtttgctcagattgtttgtgttttatgttctaaacaaataaacaatgtgttgcactttaaaaaaatttgttgca

SEQ ID NO: 4033 - DNA, 1305 bp, Brachypodium distachyon
ggggccctcatgtcggcgaaacgttgcccgtcgccttttgcgtcgctcgcgacaccctagctccattcctcccgtctcctctcctctctctttgtagcgacaattagcacgaggtgacggcggccatggcggcggcgacggcggcggtggagagcgtggtggtggtgcacaacgtggcgaagcggcacaacgtgggcacgctggcgcggagcgcgacggcgttcggcgtcgcggaggtggtggtggtcggccgccgcgacgtcagcgccttcggcagccacgggtccacatcccacctccgcttccgccacttcgtgtccctcgccaccgcccgtgcatacctcaaggacgagagggggtgtgacatttgcggcgtcgagatcaccgacgacgcgctgccagtgacggcccgccccttccgcaggagcaccgcgttcctctttggcaatgagggtacaggactctcacaaaaagagtgtgagatctgcgactattttgtctatatcgctcagtatggtggtggaactgcatcactcaatgttacggttgcagcatcaattgttctccaccactttggggtctgggctggctttcctgaacgaggccgagaaggcaacaaatttgttgtagctgagaaaccgcaggggcagtcgagggggctctactgctcggactcaattgaagacgtgattgaagagcgcaaggcacggaaagaaaatgcctgcgatatattcgaagaaaatggaagcagccatccccaggaatccaatggcctagacacgatgtttacagactagagtattactacatctcatctgtgtctagacaagcccctggatgacaaggggttgataagataaattcgcaacaccacaagacatgatctggcgctggttttctccttcaccagggaaaagtgcttcgtatcccttcgaattggctcttctgaatgttggggatggtggttaaaggaatgagtgccttcaaactaggcttaaaggctatagctccatgtcttgctatatgaatttttgtatgatatggcaatccgttttttggttgaggacaacctgtgtaatgtgttactccctccgtcctaaattaattgacgtggatttgcatggacttatacaatgtcacgtcggttaattcggtacttgctatctgaaattccttattccttgtacccgtaacttcattggatgccgattctcccagcatcggactctctgtaatcagataggaggttcttttgacttttgagagcatgtcctgcaatatctcgacccaaccaagatgacatgc

SEQ ID NO: 4034 - DNA, 1012 bp, Triticum aestivum
gacggcggcggtggagagcgtggtggtggtgcacaacgtggccaaacggcacaacgtgggaacgctggcgcggagcgcgacggccttcggcgtggcggaggtggtggtggtcggccgccgcgacgtcagcgccttcggcagccacggatccacctcccacctccgcttccggcacttcacctccctcgccaccgcctgcgcctacctcaaggacgagagggggtgtgacatttgcggcgtggagatcaccgacgacgcgctgcctgtgacggcccacccgttccgcaggagcaccgcgttcctcttcggcaatgagggtacaggactctcacaaaaggagtgtgaggtctgtgacttcttcgtctacatccctcagtatggtggcggaactgcatcactcaatgttaccgttgcagcatcgattgttctccaccacttcggggtctgggctggctttcctgaaagaggccgagaaggcagtaaatttgtggtagctgagaaaccaaaggggcagtcgagggggctctactgctcagattcaatagaagacgtgattgaagagcgcaaggcacgcagagaaaatgcctgcgatatattcgaggaaaatggaagtagccatccgcaagaatcaaatggtctaggaatgatgtttacagactagagtgtttattccatcttatctctgcttctaaacaagcccctggatgataagggcttgatatggtgaatttgcaatacataagacatgatgtggcactggttctattttcaccaagggagggcagaattttttataatatctttgttgttccaacaaaggggggaaggagcagaagcgcaatatatgcctcccctaaaaaatgacttgtgatatcagggacgggattaaaaacgagtgccttcaaacttgggccaaaaactaccgctcctttttgctatgaaattttgtgacatgatatacgatttatgttatgcagtacaagattgttgcgtgctgttggaaatttgtttt

SEQ ID NO: 4035 - DNA, 4936 bp, Oryza sativa
tgtgctgtgtgtgctctctctctctccatccatcaggcctagagaagaggagagacaagcgcctccttctcctcatctccttcctcctccttcccccttcttcttcttcctcctcctcctctctctctctagccatactctctctctctcttctccactcctctgatcgactccgcttcgatccccgccgacgacccccccccccccggggtttatttttttttctatctctctctcttccctgattcggtgcacgcacgcgcaggaaggaaccagagcagctatctatcgtgatgtccactctcgcggcgcatccaccgttggggccagcggcggcggcgcaggagaaggcggcgagccggaacaagcgcaagtaccgcgccgagccgccgtccgccgagctggggtcattcgggctggagtacccactgacggccgactgcgtgggcttcgagttcatgtcgccggagaaggcagccatcgcggcggcggcggccgccgccgcggtggccgccgagggcgtcaacctggacctcatcccgggctcgtgcgattgcaaggatattcaccccacggcggaggagctactggagtgccagagatatgtgaattggaatgaccccaacgaggcgctgctcgaggagatccttctcaagggcctggacgcgacgttcgacaatgccgtaggtgtgatcatcgcgatgggttactccgagcccaccgcgcgtgccgccgtcctgcgggctgccacgcagtacaattggagggagagccttgctgggttcggcgaggcggcggtcgaggtgctcaagaccgagggggacatgttgagtgagggcgcctccgaggaagacatgaggaagattgagcaggcagtgctcggtggcatgattgcgttggtcaatcaggctcagccgttctacactacaggtgatgtgatgttctgcttgcttatgtcggatatgaatgtggccaatgcctgtgccatggactacaatccggcttccctcccagcagtggatacgcaagtgattgcccagccagttgttggaaactatgaacctaataatccaagttcggatttatcagtatctattaccaacccacagactggcgtcacttttcgtggaaaacttaccccagtgccacccaattcttacaatactgccaaggctgattcatccgcaacaccagcaaacctgaatgtaccgagcagtaaaccctctgtctcaggtaaggcgcagagtgaaatcccgaatcttaagccaaaagaaaactcaaatcctgtgcctgatcattcagaggagcaaccattcgttgctgctgcgacacaacctgtgaaagatgataagccaatccctagtaagagggggagttctaagcgggattccttgcatcggcagaagttgatgagttttgataagagttcccgagcactgggttctaaaggatctcttaggtcaagcaagcatagctctttgggtagcgcagtgctggacaggaagtgcaggtcgttttcagattctactactagcagtttgaaggcctcatccaaagtaggcaaagggttttctgcaagcatgaagggaccggaagtaccacctgacctttcttttactggtgctgcccttccctccaatccatcatttgatgccaagctgagtagtaacttgaacccattaccagctgctagcacagatctctcattgtcgttgccattgccgtcctcaaatgacagtcctgctccatcttcgaatcatgatgccaatacagagggtatggactctagcagcaaaatcaatttatcatatgatgaggatcagaaggtttggatcccacaagataagaaggatgaaatggtcttgattcttgtccagcggcagaaagagttgcaagcacatatgagggattggacagactgggctcagcagaaggtgatgcaagtcactcgtcgacttgccaaggagaaggaagagcttcattcacttaggaaagagaaggaagaagcggaccgcctccaagaagagaggcacaatctggaagagagcactcggaagaagcttttagagatggaatctgcgatttctagggcgaacacccagctggaaaaggcagaatcttctgctcgtagacgtgaagccgagaatgaacagctcaggatacagatggaagctgcaaagcggcatgcactagtgtctgcaacaaatattttggagctttcaaagaaggatgagaacagtcataaaaggtctcagcattgggaatctgaaagagccctgttgcaagaggatcttgctgctcaaaggaacaagctatctcaggtccaccagcaacttcatcatgctaaagagcagaaggatcaaatccaggcaaggtggaggcaagaagaggctggaaagattgaggcaattgcccgtgtaagcttagagaagaaagagagggatcagattgagacatcactgaggtcggaagagaacttcctgcatctcaaagcggagaacgatacgcaaagatacaagagccagatacgtgctctcgagcagcagatttcgcagctgaaggtatccttggactcgttgagggttggtgcccctcccaagtggggagcagacaacagaaccaacgcgttgcgcctttctgaagggagaaagaatggcagcgctcaaattttggccaatatagcagcggtaccccaggatttcgattttgacgacatacagcgtgaccgggagtgcgtcatgtgcctgagcgaggagatgtcggtcgtcttcctcccttgcgcgcaccaggtggtctgcgcgaaatgcaatgacctccatgacaagcaagggatgaaggagtgcccatcgtgccggacccccatccagcgcagggtgtgcgcccgcctcgccggttgctagacttcttcatatacaccattttgttttctctttttatttgttttttttgattgatttgctgagcttgccttggatggatggatggaagattggatggaataatgagtggtggtgagagtggttaaactttgagaataatatacatggttggtcgcacatcaatcaaaaccccgcagagataatggataatgggatgggtgttggttatacatgatgtacagagcgttgtcttctgaatgcttttccttttggtttatctttttttcgctgagcattgcaggcaatcagaactagttcttgtcaggtaagagtatcaaaatgtgtttgaattttgatgcttctgagctattccatttatcctggaatcctcactgaactgaggtttcggttcatggatgatgttaataagtctggttgtactatgtggctttgtctgattcgccattgacctcattgtgttccaagagctcttctcccaattttggtggtaaataaacaaacagattcctatgaaatttcttatatgaaatactgtgaaatttcctgcgttgcaaatgagagtttgcatcataaacactcaacgcagcagcatcaagagcttcattgtcttcaattttcagacgatctctggcctacgacgaaggcacggtgtcttcctttccatggaccctccaggtgaaccccacatgtcagtggaatggctcacgcgtagtattttccctagtccatttccacccttcttcacatcacagcgagaaaaaaagagcgaattaaaagcaaaaaaaaaaggaaaataaaggagaaaagagtggcggccatggcggcggcggcggcggcggcggtggagagcgtggtggtggtgcacaacgtggcgaagcggcacaacgtggggacgctggcgcggagcgcgacggcgttcggggtggcggaggtggtggtcgtcggccgccgcgacgtcagcgccttcggcagccacggcgccacctcccacctccgcttccgccacttcgcctccctccccctcgcccgcgcctacctcaaggacgagagggggtgtgacatttgcggcgtggagatcacccacaacgcgctgccggtgacggcccatccgttccgccggagcaccgccttcctcttcggcaatgagggtacaggactctcgcagaaggagtgcgagatctgcgacttttttgtctacatccctcagtatggtggtggaaccgcatcattgaatgttacagttgcagcgtcgattgttcttcatcactttggagtctgggctggctttccagaacgagggcgagaaggtaataaattcgttgtagctgataaaccaaagggccaatctaggggactctactgtacagactcaattgaagaagtgattgaagaacggaagatgcgaagagaaaatgcctgtgacatatttgaggaaaatggaagtagcgagcatcaggaatcaaatgttttaggcacgatgctgtcagactagagtatcccatctcttctttgcttaccaatccagtctctgcattggttgagggatgaaactaatttgcaataccacatacagcacaatatccagcactggtttctcttttccagggtggcacaaatatatgtagagtaaatttcagagaactccatttttatggtcaaagttgcagtttcgcgactcggtaaggagcataatagcaccctttcaaaccaaattcttgtggcaatgattaagagaataccttcaaaccacgggtaaagccaaagttctgcgttttgctctgaaatttatgtgtggcccccgatatatgttccaatcaggttgtgtgactatcacctgaacttttttgttgtactattaggagtcccccttttttttttttgaaaacttattaggagtctgacctctgttagcgtcaggcttcctcactggattgtactgtaatgttttgtttctccaccaactctggattagtttgttttccactacctaacatgaaaattgttcataggaattttggcatgaactttccactttc

SEQ ID NO: 4036 - DNA, 697 bp, Oryza sativa
ggcggccatggcggcggcggcggcggcggcggtggagagcgtggtggtggtgcacaacgtggcgaagcggcacaacgtggggacgctggcgcggagcgcgacggcgttcggggtggcggaggtggtggtcgtcggccgccgcgacgtcagcgccttcggcagccacggcgccacctcccacctccgcttccgccacttcgcctccctccccctcgcccgcgcctacctcaaggacgagagggggtgtgacatttgcggcgtggagatcacccacaacgcgctgccggtgacggcccatccgttccgccggagcaccgccttcctcttcggcaatgagggtacaggactctcgcagaaggagtgcgagatctgcgacttttttgtctacatccctcagtatggtggtggaaccgcatcattgaatgttacagttgcagcgtcgattgttcttcatcactttggagtctgggctggctttccagaacgagggcgagaaggtaataaattcgttgtagctgataaaccaaagggccaatctaggggactctactgtacagactcaattgaagaagtgattgaagaacggaagatgcgaagagaaaatgcctgtgacatatttgaggaaaatggaagtagcgagcatcaggaatcaaatgttttaggcacgatgctgtcagactagagtatcccatctctt

SEQ ID NO: 4037 - DNA, 1027 bp, Cenchrus ciliaris
gggtaccgggcccccccacaacgtggggacgctggcgcggagcgccacggcgttcggcgtcgcggaggtggtcgtcgtcggccgccgcgacgtcagcgccttcggcagccacggcgccacctcgcacctccgcttccgccacttcacctcgcttgccctcgcccgcgcttacctcaaggatgagagagggtgtgacatttgtggtgtggagataaccgacgacgcgcagcctgtgaccgcgcacccgttccgccggagcaccgcgttcctattcggcaatgagggtacaggactctcacaaaaagagtgcgacttctgtgacttctttgtctacatccctcagtatggtggtggaacagcatctctgaatgttacagttgcagcttcaatcgttctccaccactttgctgtctgggctggctttcctgaacgaggcagggagggcaacaaattcgttgtagctgatagaccacaggggcactcaagggggctttactgtacagactctattgaagcagtggttgaagagcggaaaatgcgaaaagaaaatgcctgtgatatattcgaggaaaatggaagcagccatcctcaggaatcaaatggcctagatttgatgtttacagagtaggcttatcagcagacagcggtattacatcttgtttgttgaaacaaaatccttgtgttggggttgatgatgcagatttgcaatactacagtgcaaaacagaaatgtatttccaaaagagcaagaagtagagatgtagagcacagattttctttccaaccttggcatggagcagaagggcgcactgagcttttgtgaggccagggggtgggtgaaagtgtgccttgaaatccagggagtggacaaaacttcgtttcaccttactgttttatgttcctctgtaaatcaagatgtggtgcctgttgcttattagaactgctctgttgtaacttagccacctagggggtgtttgtatttgatctttgaatatgaaatttatgttcatcttttcttttttcttgca

SEQ ID NO: 4038 - DNA, 824 bp, Secale cereale
tccatttttccttagtgagaaatagcaccaggaaaacggacggccgatggcggcagctgcggcggcgagcggggcgacggcggcggtggagagcgtggtcgtggtgcacaacgtggccaaacggcacaacgtggggacgctggcgcggagcgcgacggccttcggcgtggcggaggtggtggtggtcggccgccgcgacgtcagcgccttcggcagccacggatccacctcccacctccgcttccgacacttcacctccctcgccaccgcttgcgcctacctcaaggacgagagggggtgtgacatctgcggcgtggagatcaccgacgacgcgctgcctgtgactgcccacccgttccgcaggagcaccgcgttcctctttggcaatgagggtacaggactctcacaaaaggaatgtgaggtctgtgacttcttcgtctacatccctcagtatggtggtggaactgcatcactcaatgttaccgttgcagcatcgattgttctccaccactttggggtctgggctggctttactgaaagaggccgagaaggcagtaaatttgtggtagctgagaaaccaaaggggcagtcaagggggctctactgctcagattcaattgaagacgtgattgaagagcgcaaggcacgcagagaaaatgcctgtgatatattcgaggaaaatggaagtagccatccgcaagaatcaaatggtctaggaatgatgtttacagactagtgtttattccgtctcatctctgtttctaaacaagcccctggatgataagggcttgataaggtgaatttgcaatacatgagacatgatg

SEQ ID NO: 4039 - DNA, 946 bp, Secale cereale
atggcgacagctgcggcggcgagcggggcgacggcggcggtggagagcgtggttgtggtgcacaacgtggccaaacggcacaacgtggggacgctggcacggagcgcgacggccttcggcgtggcggaggtggtggtggtcggccgccgcgacgtcagcgccttcggcagccacggatccacctcccacctccgcttccgacacttcacttccctcgccaccgcctgcgcctacctcaaggacgagagggggtgtgacatttgcggcgtggagatcaccgacgacgcgctgcctgtgacggcccacccgttccgcaggagcaccgcgttcctcttcggcaatgagggtacagggctctcacaaaaggagtgtgaggtctgtgacttcttcgtctacatccctcagtatggtggcggaactgcatcactcaatgttaccgttgcagcatcgattgttctccaccacttcggggtctgggctggctttcctgaaagaggccgagaaggcaataaatttgtggtagctgagaaaccaaaggggcagtcgaggggactctactgctcagagtcagttgaagacgtgattgaagagcgcaaggctcggagagaaaatgcctgcgatatatttgaggagaatggaagtagccatccgcaagaatcaaatggtctaggaatgatgtttacagactagagtgtttattccgtctcatctctgtttctaaacaagcccctggatgataagggcttgataaggtggatttgcaatacataagacatgatggtttctgtttcaccaagggagggcagaacttttattataatttatttgttgttccaacaaaagtgaaaggagacacaagtgcaatatatgcctaccctaaaaaatgacttgtgatatcagggaacgggaaattaaaaaaaaaaaaactagaagactagacaacgga

SEQ ID NO: 4040 - DNA, 1257 bp, Panicum virgatum
  misc_feature (502)..(502): n is a, c, g, or t
  misc_feature (816)..(816): n is a, c, g, or t
  misc_feature (830)..(830): n is a, c, g, or t
  misc_feature (985)..(985): n is a, c, g, or t
  misc_feature (992)..(993): n is a, c, g, or t
ggcgcggagcgcgacggcgttcggcgtcgcggaggtggtcgtcgtcggccgccgcgacgtcagcgccttcggcagccacggcgccacctctcacctccgcttccgccacttctcctcgctcgccctcgcccgtgcctacctcaaggatgaaagaggatgtgacatttgcggtgttgagatcactgacaacgcgcagccggtgactgctcacccgttccgtcggagcaccgccttcctattcggcaatgagggcacaggactctcacaaaaagagtgtgagatctgtgactttttgtctacatccctcaatatggtggtggaacagcatctctcaatgttacagttgcagcttcaattgttctccaccactttgcagtctgggctggctttcccgaacgaggcagagagggcaacaaattcattgtagctgatagaccacaggggcactcgagggggctctactgtacggactcaattgaagcagtgattgaagagcgtaaantgcgaaaagaaaatgcatgtgatatactagaggaaaatggaagcagccatccccaagaatcaaatggcctagatttgatgtttacagactaggcttatgactggacgacattgttacatcatggttgttgaatcaagtcccgggttggggttgatggagcaaatttgcgatactgcaacgcataacagaaatgtctttccaaggccgagagtagaacatgcatgttttttcaaccttggcatggagcagaaaaggatgcactgagcttttgggaagccagggggtgagtgtaccttgaaacagagggcgtggangaagctctgtttcnctccgattgtttgccttttatgttgtacaaaacaagatgtggtgcctgctatcagaattcctcagttgtaatgtagccatgaaggtggttgatacctcattcctgacatagaactacctcacattgcacgaagttggatggtagacttcaatggnttttttnnattagcctttggatcatctagtctttgttatacctcaatacgacaaagactggtgagatgcccttcaggtgttgacatttttggatggtagacctcgatggttctttttcaacattggcctgggtcatttagtctattctttttttttggggttagaggatcatgttactggaactggaagtagtagtagctgtagcatgtgcctccgctatgggataaggcagcggggcatatttctcttttccagttacctctcagttatat

SEQ ID NO: 4041 - DNA, 2469 bp, Sorghum bicolor
aaactctcgagtctcgaagttagcgcgaaattccttctaatattctatgtccggtgagctgtgacccagcccatcccgtacaccccgatccccgagtggcccaactagcccacgtatatactccaaacctaaccctagcaatacatttcgctccccagcggcggcggccacagccacacgcccacacgtctcgcgcgggatctaattcgaaacagcactgccctttcttctacggttccccaagggcacgctctctccctcgcggcgactactgggcgaccgctgccgctgcccaggtgcccatcggtccgttcgccaggtcttcttcgggctcttcgccgccgacaagcgctgccaggttgctgtgttaagtccaaacttgtcacatggattcaacacaagatttccaacccaggacattctctataaagttgtggccaccaagtgagagcacacggctcatgcttgttgagaagatgacaaagaatctgtccacagagtccattttctctcgcaagtatggtcttttgggcaagcaagaggctcatgagaatgcaaaaaggattgaagaactttgctttgcctcggctgatgagcatttcaaaagggagccagatggtgatgggagttctgctgtccagctatatgcaaaggaaacgagcaagctgatgttggaagttctgaaaaaaggcccaagcactactgcagaactggagacacctgtagctgatacacctcttgtgcctgctgatactgtactggatatatctggtggcaagcgtgcttttattgaggcagatgaagcaaaggaactgctgagtccactcaccaaaccaggaaattcgtataaaagaatttgctttagcaacaggagctttggtattggtgctgctaatgttgcagggccaattcttgaggcagttaagaatcagctcacagaggttgatatctcagattttgtggcaggaaggcctgaggatgaagcacttgatgtgatgcgcatattctccaaagcgttagagggttctgtcctgagatatctgaacatctctgacaatgctttgggtgagaagggtgtcagggcattcagtgagctcctgaaatcacaggaatccctggaagaactctatgtgatgaatgatggtatatcagaggaagctgcaaaagctctatctgagcttattcctgcaactgagaagctcaaggttcttcacttccacaacaatatgactggagatgaaggtgctatgtatatcgctgagatggttaagcgttctccaaatgtagagagtttcaggtgctcagcaacaaggataggatctgatggtggagtcgcattgtctgaggcattagggacatgcactcgtctgaagaaacttgatctcagggacaacttgtttggtgttgatgcagggttagctctcagcaaaaccctttcaaagcttcatgatcttgttgaactttatctcagtgatctcaatcttgagaatgagggcacaatatcaattgtcaaagccctcaaacagtcagcaccgcagttggaggtccttgaaatggcaggaaatgaaataaatgccaaagcagccctagatttggcagaatgcctaacagcaatgcaatcactgaagaagctgaccttggctgaaaatgaactgaaggatgacggtgctgtgattattgcaaaatcattggaagatggccacacagatctcaaggaacttgatgtgagcacgaacatgctgcagagggttggagctcggtgctttgcgcgggcagtcgcagataaaccagcttttgtgcaactgaacatcaatggaaatttcatctccgatgaagggattgatgaggtgaaggaaattctgaaggctggtaagaaatccctggatgttctgggctcactagatgagaatgaacctgacggggagcctgatgatgaggaagaggacgaggatgctgaggacaatgaggacgagctggatttgaagctacagagcgtgaaggttgagcaggatgattgaccaagttggttttaaggtataagtgctgttgatccttggttccttagtcagtttttgttatgtaaaaccattgcaatctgattatagattagaacttcacttatttattctgttatattcaggtcattgctccattataattggtctgatttatagatgatacctattttctcaacaagtctttttgggtaactgttcgctggtagttgacctactactgctcgctggtagtctttattacacaagatttttttttttttggggggggggggaagggggggggcatcacttgtcgagaggatgttctgggcattcattggtagataaacctcttggttccttgatataagccggtaaatacctcgctactcaaaggatctggggggggttcccacatgggaacctttaaatctcttccacaggccctgaactgtggatttaatcctgaacc

SEQ ID NO: 4042 - DNA, 2192 bp, Setaria italica
cctcgccgagtcgtcgacctgcggcagtgcagcgcctccatcttcaccgtccgccgttcaactggtgcacgggggcaaggtgcttctccggccggctagacgcctgaaaaactccgacggaggaaccgtgcaacggtgctgtgtcagttttgaagcttttcacatggattcagcagcacaagacttccaacccaggacattctccatcaagctgtggccaccaagtgaaagcacacgcctcatgcttgtagagaggatgacgaagaacctgtcttccgagtccatattttcccgcaagtatggacttttgggcaaggaagaggctcatgagaatgctaaaaggattgagcagctgtgtttcacatctgcagatgagcatttcaagatggaacctgatggtgatgggagttctgctgtccagctatatgctaaggaaactagcaagatgatgttggaagttcttaagagaggcccaaggactgctgcagaatcagaagcaccagtagctgatgcacctcttgagcctggtgatactgtattggatatatctggtggcaagcgtgcctttattgaggcagatgaagccaaggaattgctgagtccacttaccaaaccaggaaactcatataaaaggatttgctttagcaacaggagctttggtgttgatgctgctaatgttgctggacctattctcgagtcagttaagaatcagcttacagaggtagatatatcagattttgttgcaggaaggcctgaggatgaagctcttgatgtgatgcgcatattctccaaagcactagagggttctatactaagatatctgaacatctctgacaatgcactgggtgagaagggtgtcagagcattcagtgagctcctgaagtcacaggaaaatctggaagaactctatgtcatgaacgatggcatatcagaggatgctgcaaaagctctttctgagcttattccttccactgagaagcttaaggttctccacttccataacaacatgactggagatgaaggtgctgtgtatgttgctgagatggttaaacggtctccaaatctagagagtttcaggtgctcagcaacaagaataggatctgatggtggcgtcgctttgtccgaggcattagggacatgcacgcgtctgaagaaactggatctcagggataacttgttcggtgttgatgcagggattgctctcagcaaaacccttccaaagcttcctgatctcgttgagctttacctcagcgacctcaatcttgagagttgtacagtagcaattgtcaatgccctcaaacagtcagcacctcagttggaagtccttgagttggctggaaatgaaataaatgccaaagcagccccagctgtagcagaatgcctaacggccatgcagtcactcaagaagctaaccttggctgagaatgaactgaaggatgagggtgctgtgattatcgcaaaatcattggaagatggccacacagatttgaaggaacttgatgtaagcacaaacatgcttcagagggttggagcacgctgctttgcacgggcagttgcaaataaacctggttttgtgcaactgaacatcaatggtaatttcatctccgatgaagggattgatgaggtgaaagacattttgaaggctggcaagaattcgctggatgtactgggctcactagatgagaacgatcctgagggggagcctgatgatggtgatgaggaggaagatgatgaagatgcagaggatggtgacgacgaggacgggcttgattcgaagctgcagaatgtacaggtggatcgggatgattaaccatgcttaggtttggtctagtaatcttctgaatgtgctaggctagatttttagttataaacagatgcgctgtggctccacctttgtcgtttcatggaacccttttgtagcttctgaacttcggtatctgtgttgtcgccatgtcggggtcaggtgaagctcgcttgaacttgttttatgggccctatttagtactccaacttatttgctgtgatgttttggggcgctttgttggtttatttggaatccgtgctattgtggcatgcctggatgctgctatctattactgaatttcaggatcacctgaattgcaaaatggcagttcttcctgtaacgctgggcaatgtttcaaccctgcttttgttcaactggtagtagtttc

SEQ ID NO: 4043 - DNA, 2253 bp, Setaria italica
cgcaaagcctcagaaatttcaaaaaacgccccctctcccctctcccctccgtattccggaaccccagctaaaatcctccgcccgctccctcacacccacatccactggcggcggcgcggcgatacgggcgccacagatcggcgcctgcttcctcccggccaacccaatccacgcctctcccctgagcacgcacgcctccgggcctccttccaccggagctgagcgtgatctcgtggggattcatctgttcgtggagcggagatccatccgggctttggtcgttctctcgttttgccgggtgctgtgagaagtcgtagcattcacatggattcaacagcgcaagacttccatcccaggacattctccatcaagctgtggccaccaagtgaaagcacacgcctcatgcttgtagagaggatgaccacgaacctgtccactgagtccatattttcccgcaagtatggacttttgggcaaggaagaggctcatgagaatgctaaaaggatagagcagctgtgctttgcgtcggcagacgagcattttaagaaggaacctgatggtgatgggagttctgctgtccagctgtatgctaaagaaaccagcaaaatgattatggaagttcttaagaaaggcccaatgactactgctgaaccagaagcacctgtagcagatacacctattgagcctggtgatactgtattagatatatctggtggcaagcgtgcctttatagaggcagatgaagcaaaggaattgctgagtccacttactgaaccaggaaactcgtataaaaggatttgctttagcaataggagcttcggtgttgatgctgctaatgttgctggacctattcttgagtcagttaagaatcagcttacggaggtagatatatctgattttgttgcaggaaggcctgaggatgaagcccttgatgtgatgcgcatattctccaaagcactagagggttctgtactgagatatctgaacatctctgataatgcattgggtgagaagggtgtcagggcattcagtgagctcctgaagtcacaggaaaaactggaagagctctatgtcatgaacgatggcatatcagaggacgctgcaaaagctctttctgagcttattccttcaaccgagaatcttaaggttctccagttccataacaacatgactggagatgaaggtgctgtgtatgttgctgagatggttaagcggtctccaaatctagagagtttcaggtgctcagcaacaaggataggagctgatggtggtgttgctttgtctgaggcattagggacatgcacgcatctgaagaaacttgatctcagggataacttgttcggtgttgatgcagggattgctctcagcaaaacccttccaaagcttcctgatcttgttgagctttacctcagtgacctcaatcttgagaataagggtaccatagcaattgtcaatgccctcaaacagtctgcacctcagttggaagtccttgaattagctggaaatgaaataaatgccaaagcagccccagctttagcagaatgcataacagctatgcagtcattaaagaagctgaccttggctgagaatgagctcaaggatgatggtgctgtgattattgcacaatcattggaagatggccatgcagatctgaaggagcttgatgtgagcacaaacatgcttcagcgggttggagctcgctgctttgcacgggcagttgcaaataagcctggttttgtgcaactgaacatgaatggcaatttcatctccgatgaagggattgatgaggtgaaagacattttgaaggctggcaagaattcactagatgtcctgggctcactagatgagaatgatcctgagggagagcctgatgatgatgaggaggacgacgacgaagatgccaaggatgatgatgacgaggacgggctggattcgaagctgcagaacgtaaaggttgagcaggatggctagcatgcttaggttaaccagctctagcttttggtccgataatcttctgaaagcccaccagctaggctaaatttttatagttataaagaaaaatgtactgtggctccaccatttagaagtgagtcgagcagcctggtgatctatccttgtcgtttatcagaacctttagtagctcctgaattctgaactgtggtatctgtattgtcagggtcaggtgaagctgactcttgaagctggcatgaacttatttcatggaccctatttactactccaacttatttgctg

SEQ ID NO: 4044 - DNA, 2027 bp, Setaria italica
ggtgccgtgtcaatttcaaagcttttcacatggatgcagcagcgcaagacttccaaccgagaacattctccatcaagctctggccaccaagtgaaagcacacgcctcatgcttgtagagaggatgacaaagaacctgtccaccgagtccatattttcccgcaagtatggacttttgggcaaggaagaggctcatgagaatgctaaaaggattgagcagctgtgctttgcatctgcagatgagcatttcaagaaggaaccagatggtgatgggagttctgctgtccagctgtatgctaaagaaactagcaagatgatgctggaggttcttaagaaaggcccaaggactactgcagaaccagaagcaccagtagctgatacacttgagcctggtgatactgtattagatatatctggcagcaagcgtgcctttatcgaggcagatgaagcaaaggaactactaagtccacttaccaaacccggaaactcatataacagaatttgctttagcaacaggagctttggtcttgatgctgctaatgtcgcgggacctattctagagtcagttaagaatcagcttacggaggtagatatatcagattttgttgcaggaaggcctgaggatgaagctcttgatgtgatgcgcatattctccaaagcactagagggttctgtactgagatatctgaacatctctgacaatgcactgggtgagaagggtgtcagggcattcagtgagctcctgaagtcacaggaaaatctggaagaattctatgtcatgaacgatggcatatcagaggacgctgcaaaagctctttctgagcttattccttcaactgagaatcttaaggttctccacttccacaacaacatgactggagatgaaggtgctgtctatgttgctgagatggttaagcggtctccaaatcttgagagtttcaggtgctcagcaactaggataggatctgatggtagtgttgctttgtctgaggcattagggacatgcacacatctgaagaaactggatctcagggataacttgtttggtgttgatgcagggattgctctcagcaaaaccctttcaaagcttcctgatcttgttgagctttacctcagcgacctcaatcttgagaataagggtacagtagcaattgccaatgccctcaaacagtcagcacctcagttggaagtccttgaattggctggaaatgaaataaatgcaaaagcagccccagctttagcagaatgcttaacagccatgcagtcactcaagaagctgatcttggctgagaatgaactcaaggatgatggtgctgtgatcattgcaaaatcattggaagttggccacgcagatctgaaggagcttgatgtaagcacgaacatgtttcagagggttggggcacgctgctttgcacgggcagttgcaaataaacctggatttatgcaactgaacatcaacggtaacttcatctccgatgaagggattgatgaggtgaaagacattttgaaggctggtaagaattcgctggatgtcctgggctcactagatgagaacgatcctgagggggagcctgatgatggtgatgaggaagatgatgaagatgccaaggatgatgacgatgaggatgggctgaattcgaagctgcagaatgtacaggtggagcaggaggattaaccatgcttaggttaactggctctagctcttgatccagtaatcttctgaataccagcaaggctagatttttagttataaacaaatgcactgtggctccaccatttataaacgagtcattgccgtttgtcagaacccttttgtagcttctgaacaagtatttgtattgccatgatcaggtgaaactgactcttgaagctggcttgaacttatttcatgaaccctatttagtactccgatttattctctgtgattttttctgaggctttgttagtttatttggaatctgtgctattgtggcatgtccgcatgtatggatgttcctatgtggctttgttagtttattgtggaatctgc

SEQ ID NO: 4045 - DNA, 2263 bp, Panicum virgatum
atctcctccctttttcttaaaccttcctcttctctcggactctctcctcccttgctcctccttccctggcggcgcgactgggcgagcggcggcgccatttgtcacgtcttcgcccagcccttttgcagccgacgagcatcaaccagggtgcggtgtcaattttgaagcttttcaaatggattcagcaggacaagacttccaacccaggacattctccatcaagctgtggccaccaagtgaaagcacacgcctcatgcttgtagagagaatgacagtgaatctgtccactgagtccatattttctcgcaagtatggacttttgggcaaggaagaggctcatgagaatgctaaaaggattgaacaactgggctttacatctgcagatgagcatttcaagagagaacctgatggtgatgggagtgctgctgtccagctgtatgccaaagaaactagcaagatgatgttggaagttctaaagaaaggcccaaggattactgcagaatcagaagcaccagtgtctgatacacctcttggtggtgattctgtattagatatatctggtggcaagcgtgcctttatcgaggcagaggaagcaaaggaactgctgagtccactaaccaaaccaggaaactcatataaaaggatttgctttagcaataggagctttggtattgatgctgctaatgttgctggacctattctcgagtcagttaagaatcagcttacggaggtagatatatccgattttgtcgcaggaaggccagaggacgaagctcttgatgtgatgcgcatattctccaaagcactagagggttctgtactgagatatctaaacatatctgacaatgcactaggtgagaagggtgtcagggcattcagtgagctcctgaagtcacaggaaaatttggaggaattctatgtcatgaacgatggcatatcagaagatgctgcaaaagctctttctgagcttattccttcaactgagaagcttaaggttctccacttccacaacaacatgactggagatgaaggtgctgtgtatgttgctgaaatggttaagcggtcaccaaatctggagagtttcaggtgctcagcaacaaggatagggtctgatggtggtgtcgcattgtctgaggcattggggacatgtacacatctgaagaaactagatcttagggataacctgttcggtgttgatgcagggattgctcttagcaaaacccttccaaagcttcctgatcttgttgagctttacctcagtgacctcaatcttgagaataagggtgcagttgcaattgtcaatgccctcaaacagttagcaccacagttggaagtccttgaaatggctggaaacgaaataaatgccaaagcagccccagctatagcagaatgcttaacggtcatgcagtcactcaagaagctgaccttggctgagaatgaactcaaggatgctggtgctgtgattattgcaaaatctttggaagatggccacgcagatctgaaggaacttgatgtaagcacaaacatgtttcagagggctggagcacgttgctttgcacgggcagttgcaaataaacctggttttgtgcaactgaacatcaatggtaatttcatctccgatgaagggattgatgaggtgaaagatattttgaaggctggtaagaattcgctggatgttctgggctcactagatgagaacgatcctgagggggagcctgatggcggtgatgaggaggaggacgacgaagatgccaaggacgatgacgatgaggacgggctcgatttgaagctgcagaacgtacaggtggagcaggatgattaaccatgcttaggttatttagatctagcttttggtccagtaatcttctgaataccagctatcctagacttttagttatgagcaaatgcactatggctctaccatttagagctgagtcgagcagcctggtgatgtatccttgccgtttatcagaactttttgtaactcctgaactttggtatctgtggttgtcagggtcaggtgaagctgacttggaacttatttcatggaccctatttagtactccaacctatttgttgtggtgttttcgggcgcttcattggtttatttgcaatattgtggcatgtatggatgttgtctatgatttcctttacataatgctgttgcctatgtgtggtgtgggaacaactgcacagcaacgggtgaatcatgtcgttttactagaatattgccgttcccttttcgagcatattgttagacgaa

SEQ ID NO: 4046 - DNA, 2101 bp, Panicum virgatum
cttaaaccttcctcttctctcggactctctcctcccttgctcctccttccctggcggcgcgactgggcgagcggcggcgccatttgtcacgtcttcgcccagcccttttgcagccgacgagcatcaaccagggtgcggtgtcaattttgaagcttttcaaatggattcagcaggacaagacttccaacccaggacattctccatcaagctgtggccaccaagtgaaagcacacgcctcatgcttgtagagagaatgacagtgaatctgtccactgagtccatattttctcgcaagtatggacttttgggcaaggaagaggctcatgagaatgctaaaaggattgaacaactgggctttacatctgcagatgagcatttcaagagagaacctgatggtgatgggagtgctgctgtccagctgtatgccaaagaaactagcaagatgatgttggaagttctaaagaaaggcccaaggattactgcagaatcagaagcaccagtgtctgatacacctcttggtggtgattctgtattagatatatctggtggcaagcgtgcctttatcgaggcagaggaagcaaaggaactgctgagtccactaaccaaaccaggaaactcatataaaaggatttgctttagcaataggagctttggtattgatgctgctaatgttgctggacctattctcgagtcagttaagaatcagcttacggaggtagatatatccgattttgtcgcaggaaggccagaggacgaagctcttgatgtgatgcgcatattctccaaagcactagagggttctgtactgagatatctaaacatatctgacaatgcactaggtgagaagggtgtcagggcattcagtgagctcctgaagtcacaggaaaatttggaggaattctatgtcatgaacgatggcatatcagaagatgctgcaaaagctctttctgagcttattccttcaactgagaagcttaaggttctccacttccacaacaacatgactggagatgaaggtgctgtgtatgttgctgaaatggttaagcggtcaccaaatctggagagtttcaggtgctcagcaacaaggatagggtctgatggtggtgtcgcattgtccgaggcattggggacatgtacacatctgaagaaactagatcttagggataacctgttcggtgttgatgcagggattgctcttagcaaaacccttccaaagcttcctgatcttgttgagctttacctcagtgacctcaatcttgagaataagggtgcagttgcaattgtcaatgccctcaaacagttagcaccacagttggaagtccttgaaatggctggaaacgaaataaatgccaaagcagccccagctatagcagaatgcttaacggtcatgcagtcactcaagaagctgaccttggctgagaatgaactcaaggatgctggtgctgtgattattgcaaaatctttggaagatggccacgcagatctgaaggaacttgatgtaagcacaaacatgtttcagagggctggagcacgttgctttgcacgggcagttgcaaataaacctggttttgtgcaactgaacatcaatggtaatttcatctccgatgaagggattgatgaggtgaaagatattttgaaggctggtaagaattcgctggatgttctgggctcactagatgagaacgatcctgagggggagcctgatggcggtgatgaggaggaggacgacgaagatgccaaggacgatgacgatgaggacgggctcgatttgaagctgcagaacgtacaggtggagcaggatgattaaccatgcttaggttatttagatctagcttttggtccagtaatcttctgaataccagctatcctagacttttagttatgagcaaatgcactatggctctaccatttagagctgagtcgagcagcctggtgatgtatccttgccgtttatcagaactttttgtaactcctgaactttggtatctgtggttgtcagggtcaggtgaagctgacttggaacttatttcatggaccctatttagtactccaacctatttgttgtggtgttttcgggcgcttcattggtttatttgcaata

SEQ ID NO: 4047 - DNA, 2062 bp, Panicum virgatum
ctgtactattagggtcccgtgtcaatttcgaaggtttacacatggattcagcagcacaaaacttccaacccaggacattctccatcaagctgtggccaccgagtgaaagcacacgcctcatgcttgtagagaggatgaccaagaacctgtccactgagtccatattttcccggaagtatggacttttgggcaaggaagaggctcatgagaatgctaaaaggattgaacagctgtgctttgtagctgcagatgaggatttcaagaaagaacctgatggtgacgggagttctgctgtccagctgtatgctagagaaactagcaagatgatgctggaagttcttaagaaaggcccaagggttactgcagaatcagaagtgccagtagctgatacacctcttgtgcctggtgatactgtattagatatatctggtggcaagcgtgcctttatcgaggcagatgaagcaaaggaactgttgagtccacttaccaaaccaggaaactcgtataaaaggatttgctttagcaacaggagttttggtgttgatgctgctaatgttgcaggatccattctcgaatctgttaagaatcagcttacagaggtagatatatctgattttgttgcaggaaggccagaagacgaagctcttgatgtgttgcgcatattctccaaagcactagagggttgtgtactgagatatctaaacatctctgacaatgcactaggtgagaagggtgtcagggcattcagtgagcttctgaaatcacaggataatctggaagaactctatgtcatgaatgatggcatatcagaggacgctgcaaaagctctttctgagcttattccttcgactgagaaacttaaggttctccacttccacaacaacatgactggagatgaaggtgctgtgtatgtcgctgagatggttaagcggtctccaaatctggagagtttcaggtgctcagcaacaaggataggatctgacggtggtgtcgcgttgtccgaggcattagggacatgcacacatctgaagaaactggatcttagggataacttgttcggtgttgatgcagggattgctctcagcaaaacccttccaaagcttcctgatctcgttgaactttatctcagtgacctcaaccttgagaataagggtacactagcaattgtcaatgccctcaaactgtcagcacctcagttggaagtccttgaattggctggaaatgaaataaatgccaaggcagccccgggtatagcagaatgcctaacagccatgcagtcacttaagaagctgaccttggctgagaatgaactcaaggatgccggtgccgtgattattgcaaaatctttggaagatggtcatacaaatctgaaggaacttgatgtaagcacaaacatgtttcagagggctggagcacgctgctttgcacgggcagttgcaaacaaacctggttttgtgcaactgaacatcaatggtaatttcatctccgatgaagggattgatgaggtgaaagatattttgaaggctggtaagaattcgctggatgttttgggctcactagatgagaacgaacctgagggggagcctgatgatggtgatgaggatgatggtgacgaagatgccaaggatgataacgtcgaggacgggctggattcgaagctgcagaacgtacaggtggagcaggacgatgaaccatgattaggctaactagttctagctttttgtccagtaatcttctgaataccagctaggctagacttttagttatgagcaaatgcactgtgtcaccaccatttagaaccgagtcaagcagcctggtgatctatcctttccgtttatgggaaccttttgtatcttctgaacttggtatctgtggttgtcagggtcaggaagctgactttgaacattatttcatggaccctatttagtactacaacttattcgctgtgatgttttcgggcgcttcattagtttatttgcaatatgtgctattgtggcatgtatgaatgttgcccgtatttttcttttatataataatgttgcctatgttggtgtctgcacaa

SEQ ID NO: 4048 - DNA, 2026 bp, Panicum virgatum
gtgtcaatttcgaaggtttacacatggattcagcagcacaaaacttccaacccaggacattctccatcaagctgtggccaccgagtgaaagcacacgcctcatgcttgtagagaggatgaccaagaacctgtccactgagtccatattttcccggaagtatggacttttgggcaaggaagaggctcatgagaatgctaaaaggattgaacagctgtgctttgtagctgcagatgaggatttcaagaaagaacctgatggtgacgggagttctgctgtccagctgtatgctagagaaactagcaagatgatgctggaagttcttaagaaaggcccaagggttactgcagaatcagaagtgccagtagctgatacacctcttgtgcctggtgatactgtattagatatatctggtggcaagcgtgcctttatcgaggcagatgaagcaaaggaactgttgagtccacttaccaaaccaggaaactcgtataaaaggatttgctttagcaacaggagttttggtgttgatgctgctaatgttgcaggatccattctcgaatctgttaagaatcagcttacagaggtagatatatctgattttgttgcaggaaggccagaagacgaagctcttgatgtgttgcgcatattctccaaagcactagagggttgtgtactgagatatctaaacatctctgacaatgcactaggtgagaagggtgtcagggcattcagtgagcttctgaaatcacaggataatctggaagaactctatgtcatgaatgatggcatatcagaggacgctgcaaaagctctttctgagcttattccttcgactgagaaacttaaggttctccacttccacaacaacatgactggagatgaaggtgctgtgtatgtcgctgagatggttaagcggtctccaaatctggagagtttcaggtgctcagcaacaaggataggatctgacggtggtgtcgcgttgtccgaggcattagggacatgcacacatctgaagaaactggatcttagggataacttgttcggtgttgatgcagggattgctctcagcaaaacccttccaaagcttcctgatctcgttgaactttatctcagtgacctcaaccttgagaataagggtacactagcaattgtcaatgccctcaaactgtcagcacctcagttggaagtccttgaattggctggaaatgaaataaatgccaaggcagccccgggtatagcagaatgcctaacagccatgcagtcacttaagaagctgaccttggctgagaatgaactcaaggatgccggtgccgtgattattgcaaaatctttggaagatggtcatacaaatctgaaggaacttgatgtaagcacaaacatgtttcagagggctggagcacgctgctttgcacgggcagttgcaaacaaacctggttttgtgcaactgaacatcaatggtaatttcatctccgatgaagggattgatgaggtgaaagatattttgaaggctggtaagaattcgctggatgttttgggctcactagatgagaacgaacctgagggggagcctgatgatggtgatgaggatgatggtgacgaagatgccaaggatgataacgtcgaggacgggctggattcgaagctgcagaacgtacaggtggagcaggacgatgaaccatgattaggctaactagttctagctttttgtccagtaatcttctgaataccagctaggctagacttttagttatgagcaaatgcactgtgtcaccaccatttagaaccgagtcaagcagcctggtgatctatcctttccgtttatgggaaccttttgtatcttctgaacttggtatctgtggttgtcagggtcaggaagctgactttgaacattatttcatggaccctatttagtactacaacttattcgctgtgatgttttcgggcgcttcattagtttatttgcaatatgtgctattgtggcatgtatgaatgttgcccgtatttttcttttatataataatgttgcct

SEQ ID NO: 4049 - DNA, 2268 bp, Panicum virgatum
gacagccctcccgcccagggctcggatctcctccctctgtttcttaaacctttctcttcagagttaaaaaaaaaaacctttctcttctctcggactcgctcctcgcttgcgcttccttccctggcggcggcgacgactgggcgagcggcggcgccatttgtcgcgtcttcgcccagcccttttgcctgcgaggagcatccaccagggttgtcaatttcgaagcttttcacatggattcagcaccgcaagacttccaacccaggacattctccatcaagctgtggccaccaagtgaaagcacgcgcctcaagcttgtagagaggatgaccaagaacctgtccactgagtccatattttctcgcaagtatggacttttgggcaaggaagaggctcatgagaatgctaaaaggattgaacaactgtgctttgcatctgcagatgagcacttcaagagagaacctgatggtgatgggagttctgctgtccagatgtatgctaaagacactagcaagatgatgttggaagttcttaagaaaggcccaaggattactgcagaatcagaagcaccagtatctgatacacctcttggtggtgatactgtattagatatatctggtggcaagcgtgcctttatcgaggcagatgaagcaaaggaactgctgagtccacttaccaaacctggaaactcatataaaaggatttgctttagcaataggagctttggtactgatgctgctaatgttgctggacctatccttgagtcaattaagaatcagcttacagaggtagatatatccgattttgtcgcaggaaggtcagaggatgaagcacttgatgtgatgcgcatattctccaaagcactagagggcgctgtactgagatatctaaacatatccgacaatgcactaggtgagaagggtgtcagggcattcagtgagctcctgaagtcacaggaaaatttggaggaactctatgtcatgaacgatggcatatcagaagacgctgcaaaagctctttctgagcttattccttcaactgagaagctcaaggttctccacttccacaacaacatgactggagatgaaggtgctgtgtatgtcgctgaaatggttaagcggtctccaaatctggagagtttcaggtgctcagcaacaaggataggatctgatggtagtgtcgcattgtccgaggcattggggacatgtacacatctgaagaaactggatcttagggataacttgttcggtgttgatgcagggattgctctcagcaaaacccttccaaagcttcctgatcttgttgagctttacctgagtgacctaaatcttgaaaataagggtacagtagcaattgtcaatgccctcaaacagtcagcaccacagttggaagtccttgaaatggctggaaatgaaataaatgctgaagcagccccagatatagcagaatgcctaacgaccatgcagtcactcaagaagctgaccttggctgagaatgaactcaaggatgccggtgctgtgattattgcaaaatctttggaagatggccatgcagatctcaaggaacttgatgtaagcacaaacatgtttcagagggctggagcacgctgctttgcacgggcagttgcaaataaacctggttttgtgcaactgaacatcaatggtaatttcatctctgacgaagggattgaagaggtgaaaggtattttgaaggctggtaagaattcgctggatgttctgggctcactagatgagaacgatcctgagggggagcctgataacggtgatgaggaggaggatgacgaagatggcaaggacgatgacgacgatgacgggctggatttgaagctgcagagcgtacaggtggagcatgatgattaagcatgcttaggttaactaggtctagcttttggtccagtaatcttctgaataccagctaccctagacttttagttatgagcaaatgcactatggctcgaccatttagcactgagtcaggcagcctggtgatctatccttgcggttatcagaaccttttgtaactcttgaactttggtatctgtagttgtcagggtcaggtgaagctgacttcaacttgtttcatggacgctatttagtgctccaacttatttgctgtgatgttttcgggcacttcattggtttatttgcaatctgcactattgtggcatttatggatgttgtctatgtatttcttttatgtaatgatgttgcctatgttagtgtgggaataaactgcatagtaacgggcgaa

SEQ ID NO: 4050 - DNA, 2155 bp, Oryza sativa
ccacgcgtccgcccacgcgtccgcgcccgccgcatcaaccaaaattccaaagagccaaaaaccctagcgcgccgcatcccccgccgccgcctccgcctccgccgcgggtaaatccctcctcgtcgtctcctccgctcctcgtgccatctcgcggctgaacaggggaggggatcctggttgctgttactgccatattttcacatggattcgactaagcaagatttccaaccccggacattctccatcaaactgtggccaccaagtgaaagcactcgtctcatgcttgtggagaggatgaccaagaacctttccacagagtccatattttctcgcaagtacggccttttgggcaaggaagaggctcatgataatgctaaaaggatcgaagaggtatgctttgcctctgcagacgagcatttcaaggaggagcctgatggggatgggagttctgctgtccagctgtacgcaaaggaaactagcaagttgatgctggaagttctgaaaagagggccaaggaccactgtggaaccagaagtacctgttgctgatacacctcttgagcctgctgattctgtatttgatatatctggtggcaagcgtgcgtttattgaggcagatgaagcgaaggaacttttgagcccgcttatcaaaccaggaaatgcatataaacggatttgcttcagcaacaggagctttggtattggtgctgccaatgttgctggacctattctggaatcaatcaaaaagcaactcacagaggtggatatatcagattttgttgctggcagacctgaggatgaagcccttgatgtgatgcgcatcttctcaaaagctttagaaggcgctgtactgagatacttgaacatctctgataatgctttaggtgagaagggtgtcagagcatttgaagagctcctgaaatcacaggacaacctggaagaactatatgtgatgaatgatggtatatcagaggaagccgcacaagctctttctgaacttattccttcaactgagaagcttaagatcctccacttccacaacaatatgacgggggatgaaggtgctatgtttattgctgagatggttaaacgttctcctaatctagagagtttcaggtgctcagcaacaaggataggatctgatggtggggtggctctggctgaggcattagggacttgtactcgtctgaagaaacttgatctcagggacaacttgtttggagttgaggcagggttggctctcagcaaaaccctttcaaaacttcctgatcttgttgagctgtatctcagtgatctcaatcttgagaacaagggcactgtagcaattatcaataccctcaaacagtcagcaccccagttggaggtccttgaaatggctgggaatgaaattaacgccaaagcatcccaagctttagcagaatgcctgacagcaatgcaatcacttaagaagttgaccttggcagagaatgaactgaaggatgatggtgctgtggtgattgcaaaatcactggaagatggacaccaggatctgaaggagcttgatgttagcacgaatatgctgcagagggtgggagctcggtgctttgcccaggcaatcgcaaacaagccaggttttgtgcaactgaacataaacgggaatttcatctcggacgaagggattgatgaggtgaaagatattctgaagagtggtgagaactctgtggaggtgcttggtccactagatgagaacgaccctgagggggaggctgaagatgatgaggaagaggaagaggaggaagaggatgacggtgagctggactcgaagcttcagagcctgaaggttgagcaggacgattagtcatgtttaggttaaacttgaactatcttttttctttcttgaattagcttcaaaacgttttgctgccaggttgtactttcactttgatgtttgaacagacgcactgcaggcagatggtttatagcctggtggtttatctatgcctgtgtaacttccattagaatttgtttcatgtattagcaacaacctggttagtcaagaccaaaggtcagctgtagctggatccttgcatcattggcattcatttgctgtgacatcttttgttggtgtgtttgttgttgtttgctactattccgtgatatagtggtatagtatccgt

SEQ ID NO: 4051 - DNA, 2382 bp, Hordeum vulgare
cggacggccacggagcgacctcgccagtcacgtccgcgtccgcgtccagaaagagaaaccctccccccacacaacacaaacccacgctccgccggccgccgcttcttccccttccagtaccgtgcccctccccttccccccaccctcttcttccggcgagtcctctccgtccactctccccgtcgcgccgcccgaacctcccgtcgacgcagccggcctcggggggaagccgccgcctctcgcctccagtctgccgccgcgatcgttgtccttgagtaggttgctgtgtgaagtgccacctttccacatggattcaactgcgcaagatttccaaccccggacattcaccatcaaactgtggccaccgagtgaaagcactcgtctgatgcttgtagagaggatgaccaagaacctatccgacgagtccatcttttctcgcaagtatggcattttgggcaaagaggaggctcatgagaatgctaagaggatcgaagaagtgtgctttgcttctgcagatgagcatttcaagaaggagcctgatggtgatgggagttctgctgtccagctatatgcaaaagaaactagcaagctgatgcttgaagtcctgaaaaaaggcccaaggacaaccgcagaaccagaagcacctgttattgatgcacctcttgagcctgctgctactgtgtttgatatatctggtggcaagcgcgctttcattgaggcagaggaagcaaaggaacttctcagtccactaacaaaaccaggaaactcgtataaaaggatttgtttcagcaacaggagctttggtattggtgctgccaatgttgctggaccaattcttgaatcaataaaatcgcagctcacagaggtagatatctcagattttgtcgctggaagacccgaggacgaagcccttgatgtgatgcgcatattctccaaagctttagcagggtctgtactgaggtacctgaacatctccgacaatgctttaggcgagaagggtgtgagggcattcaccgagctgctgaaatcacagggcgacctggaagaactatatgtgatgaacgatggcatatcaggagaagctgcaaaagctctatctgagcttattccttcaacagagaagcttaaggttctccacttccacaacaatatgactggtgatgaaggtgctatgccaatcgctgagatggttaagcgttctccaaacctagagagtttcaggtgctcagcgacaaggataggatctgatggtggagtggcactggctgaggcattagggacatgtactcgtctgaagaaacttgatatcagggacaacttatttggtgtggaggcaggggtagctctcagcaaaacccttccaaagcttggtggtctcgttgagctgtatctcagtgacctcaatcttgagaacgaggggacaatagcaattgtggatgtcctgaagcagtcagcacctcagctggaggtccttgaaatggcaggaaatgaaataaccgccaaagcagccaaggctgtagcagaatgcttaacagcaatgcagtcgctcaagaagctgaccttggccgagaatgaactgaaggatgccggggcggtgacaattgccaaatctctgcaggaaggccacccaggtctggaggagcttgatgtgagcacgaatctgtttcagaggtctggagcccggtgctttgctcaagcagtcgcgaacaagccaggtttcgcattgctgaacatcaattcgaatttcatctccgacgaagggatagacgaggtgaaggagatcctaaagggaggcgagaactcgctggaggtgcttggcccgctggatgagaacgatcccgagggggaccctgaagatgacgaagaagaggaggacgacgaggacgaggaaaaggacgggaacgataacggcgacggtggcctgggctcgaagctgcagggcctgaaggtggaggaggaggactagtcgtgtgctagggtggtggactggccactatatctttttgctccggttagcttctgaaatgtccacagtatgggttaaaattttcacatgaagagagctcactgtggctcaattgttttgaactgagccaagcgcaagcagccagacgggcggcttatctgcacttttgtaacttcggttgaacattttcttcttcttcatgcttttagcaccttctcggttctctggtaaaaaatatttgctgagacattggcatggcatgtgtttgccgagatattttaggaacgtacactacgccgtgctgtgatatccgctggatccatggggttgactagatgctgcctacaccatgtcggcagtggcagattgatccaagcaccgtgtgcgtgtggtttctatccatccacagaataatg

SEQ ID NO: 4052 - DNA, 2099 bp, Triticum aestivum
aggttgctgtgtgaagtgccacctttccacatggaatcaacagcggaaggtctccagccccgaacattctccgtcaaactgtggccaccgagtgaaagcactcgtctgatgcttgtagagaggatgaccaagaacctgtccgctgagtgcatcttctctcgcaagtatggcattttgagcaaagaagaggctcatgagaatgctaagaggatcgaagaggtgtgctttgcttctgcggaggagcatttcaagaaggagcctgatggtgatggtagttctgctgtccagctatacgcaaaagaaactagcaagctgatgcttgaagtcctgaaaaaaggcccaaggacaaccgaggaaccagaagcacctgttgttgatacacctcttgagcctgctgatactgtgtttgacatatctggtggcaagcgcgctttcattgaggcagaagaagcaaaggaacttctcagtccactaacaaaaccaggaaactcgtataaaaggatttgtttcagcaacaggagctttggtattggtgctgccaatgttgctggcccaattcttgaatcaataaaatcgcagctcacagaggtagatatctcagattttgtcgctggaagacccgaggacgaagcccttgatgtgatgcgcatattctccaaagctttagcagggtctgtactgagttacctgaacatctctgacaatgctttaggtgagaagggtgtgcgagcattcacagagctgctgaaatcacagggcgacctggaagagctatatgtgatgaacgatggcatatcagaggaagctgcaaaagctctatctgagcttattccttcaactgagaagcttaaggttctccacttccacaacaatatgactggtgatgaaggtgctatgccaattgctgagatggttaagcgttctccaaacctagagagcttcaggtgctccgcgacaaggataggctctgatggtggagtggcactggctgaggcattagggacatgtactcgtctgaagaaacttgatatcagggacaacttatttggtgtggaggcaggggtagctctcagcaaaacccttccaaagctcggtggcctcgttgagctctatctcagtgacctcaatcttgagaatgagggtacaatagcaatagtgaatgtcctcaaacagtcagcgcctcagttggaggtccttgaaatggcaggaaatgaaataaccgccaaagcagccaaagctgtagcagaatgcttaacagcaatgcagtcgctcaagaagctgaccttagctgagaatgagctgaaggatgatggggcagtgacaatcgcaaaatctctggaggaaggccacccaagtctgaaggagcttgacgtgagcacgaatctgtttcagaggtctggagcccggtgctttgctcaagctgtcgcaaacaagccaggtttcgtgttgctgaacatcaattcgaatttcatctccgacgaaggggtcgacgaggtgaaggagatcctgaagggaggcaagaactcgctggaggtgcttggcccgctggatgagaacgaccccgagggcgaccctgaagatggcgaggaagaggaggatggggaggacgacgatgacgaggagaaggacggcgacgacggtggcctgggctcgaagctgcagggcctgaaggtggaggaggactagccatgtctatggactatggtggtggactagcccctatatcttttgctccggttaccttcttaaatgatcactggaggggttaaaatttcacaaaaatctgtggctcaattgttttgaaccgagtcaagcagacagacgggaggtttatctgtactttgtaacttccgttccgttgttacttttctttcttccatgttttagaccatcttggttctctggtgaatgtttgctgagacattagcaatttggcatggcatgtgtttgctgagatattttgggaacctacgctatgcggtgatgtggtatccgttggatccatggggttgactagatggtgcctatgtcggcagtggcagattgatccaagcaccgtgtgcgtgtggtttctatctatctacagacacagaatattg

SEQ ID NO: 4053 - DNA, 1989 bp, Secale cereale
tcgatccaagtaggttattgtgtgaagtgccacgtgtccacatggcttcagcggcgcaagatttccagccccggacattctccatcaagctgtggccaccgagtgaaagcactcgtctgatgcttgtggagaggatgaccaagaacctgtcctccgagtcaatcttttctcgcaagtatggccttctgggcaaagaagaggcccatcagaacgctaaaaggattgaagagatgtgctttgcttccgcagatgagcatttcaacaaggagcctgatggtgatgggagttctgctgtccagctatatgcaaaagaaacgagcaagctgatgctggaggtcctgaaaaaaggcccaggggcgactgcggaacctgaagcacctgttgttgatacacctattgagcctgctgaaactgtgtttgatatatccggtggcaagcgtgctttcattgaggcagacgaagcaaaggaacttctgagtccactaacagaaccaggaaactcgtacagcaggatttgcttgagcaacaggagctttggcattggtgctgccaatgttgctgggccaattcttgaatcaataaaatctcagctcaaggaggttgacatctcagattttgtcgccggaaggcctgaggatgaagcccttgatgtgatgcggatattctccaaagctttagcagggtctgtactgagatacctcaacatctctgacaatgctttaggcgagaagggtgtgagggcattcacagagctgctaaaatcacagggtgacctggaagaactatatgtgatgaacgatggtatatcaggggaagctgctaaggctctatctgagcttattccttcaactgagaagcttaaggttctccacttccacaacaatatgactggtgatgaaggtgctatgttcattgctgagatggttaagcgttctccaaatctcgagagctttaggtgctcggcaacaaggattgggtctgatggtggagtggcattggctgaggcattgggcacatgtactcgtctgaagaagcttgatatcagggacaacttatttggtgtggaggcaggggtggctctcagcgaaacccttccaaagcttggtgaccttgttgagctgtacctcagcgacctcaatctggagaacgagggtaccatagcaatcgtgaatgtcctcaaagagtcagcacctcagctggagatccttgagatggcaggaaacgagataaccgccgaggcagccaaacctctggcggaatgcttgaccgcaatgcagtcgctcaagaagctgaccttggctgagaatgagctgaaggatgccggggcggcggcggtcgcgaagtctctgcaggagggccacccagatctgaaggagcttgacgtgagcaccaacctgtttcagaggtccggagcccgctgctttgcccaggcggtcgcaaacaagccaggcttcgtgcagctgaacatgaacgcgaactacatccctgaggaagggattgacgaggtgaggaagatcctgaaggcaggcgagaactcggcggacgtgcttggcccgctggacgagaacgagcccgaggggaaccctgatgacgaggacgaagaagaggacgaggatgatgaggcaaagtatggggacgataacgggaaggatgctgggctcggctcgaagctgcaggacctcaaggtggaggcggaggaggactaagccctctctactatcttctgctctggttttagcttttgctggaccgattggaatttcgcagaatggtaaggaactcctcgctgtggccgggtcaattgtctttgaaccgacccaagcggcctgttttggtgtagcctggcgcggtttggttttatctgtaactttggttggaaccttttctcttcttcatgttttagcaccgtcttggttctctggtcgaggtccggcctggacccttaaatcatcatcaaactgtgatatgttgggaggaaccacctatcta

SEQ ID NO: 4054 - DNA, 2122 bp, Triticum aestivum
agcaggttattgtgtgaagtgccacgtgtccacatggcttcagcggcgcaagatttccagccccggacattctccatcaaactgtggccaccgagtgaaagcactcgtctgatgcttgtagagaggatgaccaagaacctgtcctccgagtcaatcttttcccgcaagtatggccttttgggcaaagaagaggcccataagaatgccaaaaggattgaagagatgtgctttgcttctgcagatgagcatttcaaaaaggagcctgatggtgatgggagttctgctgtccagctatatgcaaaagaaacaagcaagctgatgctggaagtcctgaaaaaaggtccagtgacgactgcagaaccagaagcgcctgttattgatacacctattgagcctgctgatactgtgtttgatatatctggtggcaagcgtgctttcattgaggcggacgaagcaaaggaactcctgagtccactaacagaaccaggaaactcatatagcaggatttgcttgagcaacaggagctttggtattggtgctgccaatgttgctgggccaattcttgaatcaataaaatctcagctcaaggaggtagatatctcagattttgtcgccggaagacctgaggatgaagcccttgatgtgatgcggatattctccaaagctttagcagggtctgtactgagatacctcaacatctctgacaatgctttaggcgagaagggtgtgagggcattcacagagctgctaaaatcacagggcgacctggaagaactatatgtgatgaacgatggtatatcaggggaagctgctaaggctctgtctgagcttattccttcaactgagaagcttaaggttctccacttccacaacaatatgactggtgatgaaggtgctatgttcattgctgagatggtcaagcgttctccaaatctcgagagttttaggtgctcagcaaccaggataggatctgacggtggagtggcattggccgaggccctggggacatgcactcgtctgaagaagcttgatatcagggacaacttgtttggcgtcgaggcaggggtggctctcagcgaaacccttccaaagcttggagatcttgttgagctgtacctcagcgacctcaatctcgagaacgagggcaccatagcaatcgtgaatgtcctcaaagagtctgcacctcagctggagatccttgagatggcaggaaatgagattaccgccgaggcggccaaacctttggcggaatgcttgaccgcaatgcagtcgctcaagaagctgaccttggctgagaatgagctgaaggatgccggggcggcggcggtcgcgaagtctctgcaagagggccacccagatctgaaggagcttgacgtgagcaccaacctgtttcagaggtctggagcccgctgctttgctcaggcggtcgcaaacaagccaggctttgtgctgctgaacatgaacgcgaactacatcccagacgaagggattgatgaggtgaggaagatcctgaaggcaggcgagaattcggcggacgtgcttggcccgctggacgagaacgagcccgaggggaaccctgatgacgaggacgaagaggaggatgatgatgatgaggcaaagtatggggacgataatgggaaggatgctggtctcggctcgaagctgcaggacctgaaggtggaggcggaggaggactaggcccgccactatcttttgctccggtcttgggttctgaaatgtttggtgtaccggctggaatttcgcataaaagagaaggaacacctcgctgtggcccggctcaattgattttgaaccgagccaagcggcctgttgctgtggtctggcggttcggtttatctgtaactttgttggaacttcctttcatgtttttagcaccgtcttggttctgtgggagaacttgcgtggtcaaggtcaagcctggaccctttaaaaatttaaatccgtggaatatttggcatggcatgtgtttgtttgctgtgatatgctgggaacctatctatgctgtgatgtctctttcggagctgtgagtatctgtgtgatattatcatttggttgctgcatatgacctttgatgaggtccaagggcgtggcgccccatgta

SEQ ID NO: 4055 - DNA, 2106 bp, Secale cereale
ttcttccccttccattaccgtgcccccgcccaaaccctcccacctcgaggactcgacctcccgccccgctggtatattccggcgagccctctccacgctccccgtcgcgccgccccacctcccatcgacgcagccggcctcgctggaagccgccgcctcttgcctcgagtccgtcgccgcggccgttgtccctcaagccgccgtctggatccaataggttgctgtgtgaagtgccacctttccacatggaatcaacagcagaagatttccagccccgaacattctccgtcaaactgtggccaccgagtgaaagcactcgtctgatgcttgtagagaggatgaccagaaacctgtccgcagagtgcatcttctctcgcaagtatggcattttgagcaaagaagaggctcatgagaatgctaagaggatcgaagaggtgtgctttgcttctgcagaggagcatttcaagaaggagcctgatggtgatggtagttctgctgtccagctatacgcaaaagaaactagcaagctgatgcttgaagtcctgaaaaaaggcccaaggacaaccgaggaaccagaagcacctgttgttgatacacctcttgagcccgctgatactgtgtttgacatatctggtggcaagcgcgctttcattgaggcagaagaagcaaaggaacttctcagtccactaacaaaaccaggaaactcgtataaaagaatttgtttcagcaacagaagctttggtattggtgctgccaatgttgctggcccaattcttgaatcaataaaatcgcagctcacagaggtagatatctcagattttgtcgctggaagacccgaggacgaagcccttgatgtgatgcgcatattctccaaagctttagcagggtctgtactgagttacctgaacatctctgacaatgctttaggcgagaagggtgtgagggcattcacagagctgctgaaatcacagggcaacctggaagagctatatgtgatgaacgatggcatatcaggggaagctgcaaaagctctatctgagcttattccttcaactgagaagcttaaggttctccacttccacaacaatatgactggtgatgaaggtgctatgccaattgccgagatggtgaagcgttctccaaacctggagagcttcaggtgctcagcgacaaggataggatctgatggtggagtggcactggctgaggcattagggacatgtactcgtctgaagaaacttgatatcagggacaacttatttggtgtggaggcaggggtagctctcagcaaaacccttccaaagcttggtggcctcgttgagctctatctcagtgacctcaatcttgagaatgagggtacaatagcaattgtgaatgccctcaaacagtcagcacctcagctggaggtccttgaaatggcgggaaatgaaataaccgccaaagcagccaaagccgtagcagaatgcttaacggcaatgcagtcgctcaagaagctgaccttagctgagaatgagctgaaggatgacggggctgtgacagtcgcaaaatctctgcaggaaggccacccaggtctgaaggagcttgatgtgagcacaaacctgtttcagaggtctggagcccggtgctttgctcaagctgtcgcaaacaagccagatttcgtgttgctgaacatcaattcaaatttcatctcggacgaaggggtcgatgaggtgaaggagatcctgaagggaggcaagaactcgctggaggtgcttggcccgctggatgagaacgatcccgagggggaccctgaagatggcgaggaagaggaggatggggagatgacgatgacgaggagaaggacggggatgataacggcgacggtggcctgggctcgaagctgcagggcctgaaggtggtggaggaggaggactagtcgtgtctaggtttgtggcaagatcagcccctgtcttttgctccggttaccttctaaaatgatcactggaggggttaaaaatttcccacaaatctgtagctcaattgttttgaaccgagtcaagcagccagatgggcggtttatctgcacttttgtagcttccgttggacaaattttcatcttcttagcac

SEQ ID NO: 4056 - DNA, 2183 bp, Secale cereale
cgcggcgcgggcgcgcgccactgccactgcccctgcccctccacgagtagacggttgccgccgtctcgatccaaggttattgtgtgaagtgccacgtgtccacatggcttcagcggcgcaagatttccagccccggacattctccatcaagctgtggccaccgagtgaaagcactcgtctgatgcttgtggagaggatgaccaagaacctgtcctccgagtcaatcttttctcgcaagtatggccttctgggcaaagaagaggcccatgccaatgctaaaaggattgaagagatgtgctttgcttccgcagacgagcatttcaacacggagcctgatggtgatgggagttctgctgtccagctatatgcaaaagaaacaagcaagctgatgctggaagtcctgaaaaaaggcccaggggcgactgcggaacctgaagcgcctgttgttgatacacctattgagcctgctgaaactgtgtttgatatatccggtggcaagcgtgctttcatcgaggcggacgaagcaaaggaacttctgagtccactaacagaaccaggaaactcgtatagcaggatttgcttgagcaacaggagctttggcattggtgctgccaacgttgctgggccaattcttgaatcaataaaatctcagctcaaggaggttgacatctcagattttgtcgccggaaggcctgaggatgaagcccttgatgtgatgcggatattctccaaagctttagcagggtctgtactgagatacctcaacatctctgacaatgctttaggtgagaagggtgtgagggcattcacagagctgctaaaatcacagggtgacctggaagaactatatgtgatgaacgatggcatatcaggggaagctgcaagagctctatctgagcttattccatcaactgagaagcttaaggttctccacttccacaacaatatgactggtgatgaaggtgctatgttcattgctgagatggttaagcgttctccaaatctcgagagctttaggtgctcagcaacaaggattgggtctgatggtggagtggcattggctgaggcattgggcacatgtactcgtctgaagaagctcgatatcagggacaacttatttggtgtcgaggcaggggtggctctcagcgaaacccttccaaagcttggtgaccttgttgagctgtacctcagcgacctcaatctggagaatgagggcaccatagcaatcgtgaatgtcctcaaagagtcagcacctcagctggagatccttgagatggcaggaaatgagataaccgtcgaggcagccaaacctctggcggaatgcttgaccgcaatgcagtcgctcaagaagctgaccttggctgagaatgagctgaaggatgccggggcagcggcggtcgcgaagtctctgcaggagggccacccagatctgaaggagcttgacgtgagcaccaacctgtttcagaggtccggagcccgctgctttgcccaggcggtcgcaaacaagccaggcttcgtgcagctgaacatgaacgcgaactacatccccgaggaaggcattgacgaggtgaggaagatcctgaaggcaggcgagaactcggcggacgtgcttggcccgctggacgagaacgagcccgaggggaaccctgatgacgaggatgaggaagaggacgatgatgacgaggcaaagtatggggacgataacgggaaggatgctggcctcggctcgaagctgcaggacctcaaggtggaggcggaggaggactaagccctctctactatcttctgctctggttttagcttttgctggaccggttggaatttcgcagaatggtaaggaactccttgctgtggccggctcaattgtgtttgaaccgagccaagcggcctgttttggtgtagcctggcgcggtttggttttatctgtaacttcggttggaacttttttttccttcatgttttagcaccgtcttggttctctggtcgaggtcaggcccggacccttaaatcatcaaactgtgatacgttgggaacctatctatatgctgtcacctctctttcgaagctgtgatgcctgtggcgtgcatttttcttcttgtttcggtgctgcataagtctgtagtggcaacaaattttgatttacgtggagaataatacaccctttccccggccgtgcagacaga

SEQ ID NO: 4057 - DNA, 2000 bp, Secale cereale
tcgatccaagtaggttattgtgtgaagtgccacgtgtccacatggcttcagcggcgcaagatttccagccccggacattctccatcaagctgtggccaccgagtgaaagcactcgtctgatgcttgtggagaggatgaccaagaacctgtcctccgagtcaatcttttctcgcaagtatggccttctgggcaaagaagaggcccatgccaatgctaaaaggattgaagagatgtgctttgcttccgcagacgagcatttcaacacggagcctgatggtgatgggagttctgctgtccagctatatgcaaaagaaacaagcaagctgatgctggaagtcctgaaaaaaggcccaggggcgactgcggaacctgaagcgcctgttgttgatacacctattgagcctgctgaaactgtgtttgatatatccggtggcaagcgtgctttcatcgaggcggacgaagcaaaggaacttctgagtccactaacagaaccaggaaactcgtatagcaggatttgcttgagcaacaggagctttggcattggtgctgccaatgttgccgggccaattcttgaatcgataaaatctcagctcaaggaggttgacatctcagattttgtcgccggaaggcctgaggatgaagcccttgatgtgatgcggatattctccaaagctttagcagggtctgtactgagatacctcaacatctctgacaatgctttaggtgagaagggtgtgagggcattcacagagctgctaaaatcacagggtgacctggaagaactatatgtgatgaacgatggcatatcaggggaagctgcaagagctctatctgagcttattccttcaactgagaagcttaaggttctccacttccacaacaatatgactggtgatgaaggtgctatgttcattgctcagatggttaagcgttctccaaatctcgagagctttaggtgctcagcaacaaggattgggtctgatggtggagtggcattggctgaggcattgggcacatgtactcgtctgaagaagcttgatatcagggacaacttatttggtgtggaggcaggggtggctctcagcgaaacccttccaaagcttggtgatcttgtggagctgtacctcagcgacctcaatctggagaatgagggtaccatagcaatcgtgaatgtcctcaaagagtcagcacctcagctggagatcctcgagatggcagggaatgaaataaccgccgaggcagccaaacctctggcggaatgcttgaccgcaatgcagtcgctcaagaagctgaccttggctgagaatgagctgaaggatgccggcgcggcggcggtcgcgaagtctctgcaggagggccacccagatttgaaggagcttgacgtgagcaccaacctgtttcagaggtccggagcccgctgctttgcccaggcggtcgcaaacaagccagggttcgttctgctgaacatgaacgcgaactacatccctgaggaagggattgacgaggtgaggaagatcctgaaggcaggcgagaactcggcggacgtgcttggcccgctggacgagaacgagcccgaggggaaccctgatgacgaggatgaggaagaggacgatgatgacgaggcaaagtatggggacgataacgggaaggatgctggcctcggctcgaagctgcaggacctgaaggtggaggcggaggaggactgagtcctctctactatcttctgctctggttttagctgttgctggaccgtttggaatgtcgaagaatggtaaggaactccttgctgtggccggctcaattgtccttgaaccgagccaagcagcctgttttggtgtagcctggcgcggtttggttttatctgtaacttcggttggaacttttttttttcttcatgttttagcaccgtcttggttctctggttgaggtcaggcctggacccttaaatcatcatcaaactgtgatatgtttgggaggaaccacctatctatatgctgcca

SEQ ID NO: 4058 - DNA, 2321 bp, Hordeum vulgare
aggcgatcccccggcgagcccctctccgctctccccgtcgcgccgcctccgcctccgcccccggtcgacgtagctggcctcaggtggaagcggccgcctctgtcccctagcccgacgccgacgccgccgcggccgttccccctcctcgagtaaacggtcgccgccgtctggatccaaggttgttgtgtgaagtgccacgtaaccacatggcttcagtggtgcaagatttccagccacggacattctccatcaaactgtggccaccgagtgaaagcactcgtctgatgcttgtggagaggatgaccaagaacctgtgcaatgagtcaatcttttctcgcaagtatggccttttgggcaaagaagaggctcatgagaatgctaaaaggattgaagagatgtgctttgcttctgcagatgagcatttcaagactgtgcctgatggtgatgggagttctgcagtccagctatatgcaaaagaaacaagcaagctgatgctggaagtcctgaaaaaaggtccaaggacgactgcggaaccagaagcgcctgttattgatacacctatggagcctgctgatactctatttgatatttctggtggcaagcgtgcattcattgaggcggacgaagcaaaggaacttctgagcccactaatgaaaccaggaaactcgtatagcaggatttgcttgagcaacaggagctttggtatcggtgctgccaatgttgctgggccaattcttgaatcaataagaactcagctcaaggaggttgatatctcagattttgttgccggaaggcctgaggatgaagcccttgatgtgatgcggatattctccaaagctttagcagggtctgtactgagatacctgaacatctctgacaatgctttaggtgagaagggtgtgagggcattcacagagctgctaaaatctcagggcaacctggaagaactgtatgtgatgaacgatggcatatcaggggaagctgcaaaagctctatctgagcttattccttcaactgagaagcttaaggttcttcacttccacaacaatatgactggtgatgaaggtgctatgttcattgctgagatggttaaacgttctccaaatcttgagagctttaggtgctcagcaacacggataggatctgatggtggagtggcattggctgaggcactggggacatgtactcgtctgaagaagcttgatatcagggataacttatttggtgtcgaggcaggggtggctctcagcgaaacccttccaaagcttggtgatcttgttgagctgtacctcagcgacctcaatcttgagaacgagggcaccatagcaattgtgaatgtcctcaaggagtcggcacctcagctggagatcctagagatggcaggaaacgagataaccgccgacgcagccaaacctttggcagaatgcttgactgcaatgcagtcgctcaagaagctgactctggctgagaatgaactgaaggatgctggggcggtggcggttgcgaaatctctgcaagagggccacccagatttgaaggagcttgacgtgagcacaaacctgtttcagaggtctggagcccgctgctttgcccaggcggtggcaaacaagccaggctttttgctgctgaacatgaacgcgaactacatccctgaggaaggcattgacgaggtgaggaagatcctgaaggcaggcgagaactcggcggacgtgcttggcccgctggacgagaacgagcccgaggggaaccctgatgacgaggatgaagaggaggacgaagatgacgaggcaaagtatggggacggtaacgggaaggatgctggtctcggctcgaagctgcaggacttgcaggtggaggcggaggaggactaaagcccgccagtatcttttgctccggttttagcttcttctgaaatgttttgccggatcggatggaatttggcatgaagagaaggaactcctagctgtggccggctcaactgaattttgaaccgaatcaagcggccagtttggtttatctgcaacttttcggatggaacttttgtttcgcgttttagcaccgtctttgttctgtcaaagtactagtctggtcaaggtcaagcctggacccttttaaaaatttaaatccatgggatattggcacggcatgtgtttgctgtgatatgtttgggaacctatatctatgctctgtcctctctttttcgaagctgtgatatctgtgtaactatcctttggttgctgcatatgaccatgattaggtccaagggcgtgccgccgcacgcaacctttgtgcgttcgccgccagtccagttatctttgccg

SEQ ID NO: 4059 - DNA, 2965 bp, Zea mays
cacctccgcctctcgctccacttcctctccccaccactccgccatcattcccccgctcggcccgcgaaaccgtaccctgagaccactccctccgccgccatgccggacctcccctgcgacggcgatggcgtctgcatggtctgccgcgtcacctccccgccggaggtcgacctcctccattgctccacctgcgccacgccctggcactccccgtgcctctccaaggctcccgccctggccgacgccgccagctggagctgccccgactgctccctggactccgccaccgtcgccgctccctcggcccctgctaacaccctcgttgccgccatccgcgccatcgagtccgacaacaccctctccgaccaggagaaggcgcgccgccgccaggccctcctcgccggcgacgcccccgacgtcgcggacgacgacgacgcggccgacgataccctcgaaatcgtcggcaaaaacttcagctgcgttttctgcatgaagctccctgaacgacccgtcaccacaccatgtgggcataacttctgcttgaaatgcttccagaagtggattcaaagcaagaagagaacctgtgggaaatgtcgggcaccgatccctgccaaaatggccgagcagccaagaatcaactctgcgctagttgaagttatcaggatggctaagatttcaaagaatcataactctgctggctcagctgttccataccactatatgcgaaatgatgataggcctgataaggcatttacaactgacagagctaagaaggctggaaaagcaaacgcatcgagtggccagatctttgtgaccattgcacctgatcattttggccctatacttgcagaaaatgacccccgcaggaatatgggtgttcgagtcggggaaacgtgggaggacaggcttgagtgcaggcaatggggtgctcactttcctcatgtggctggtattgccggccagtctacgcatggggctcaatcagtagccctctccggagggtatgaagatgatgaagaccatggggagtggtttctttacactggaagcggcgggagggacctaagtggtaacaagcgaacaaacaaggagcagtcatctgatcagaaatttgagaagctgaatgctgctttacgcattagttgcttgaagggctaccctgttagggttgtacggtcgcacaaagagaagcgatcctcgtatgctcctgaatctggtgtgaggtatgatggggtttacagaattgagaagtgttggaggaagattggtattcagggtaagttcaaggtctgcaggtatctctttgtacgctgtgacaatgaaccagctccttggaccagcgatgatcatggtgaccgtccgagacccttgccaaagataaaggagctacaaggtgcaactgatataacagagaggaaagggcgtccttcatgggattatgatgagaaagatggctggaaatggatggtgcctccgccagtcagcaagaggcctgttctctctggtgatcctgagaccgacaagctaatccggaaagcaacaaagcgtgctcatttatctgttgctgaaaggctgcttaaagagtttggttgttctatctgccgggcggtgattaaagagccacttacaacaccatgtgctcacaacttctgcaagacttgtttgcttggtgcatatgatagccagtcctctatgagggaaagaagccgtggtggtcggactctaagggcacagaagattgtgaagacgtgcccttcctgccctactgacatctgcgacttcttagaaaatccccagatcaaccgagaaatgatggagttgattgagtccttgcaacgcaaggctgttgaagaaggcaagatggctgcaggtgatgccgaggaatctggtgatggtgactcggaggaaaatggtggtgctttggtgaagggagaagatgatagcaatttgaacgaggaaggtcaagacggtgtagacgctgatggttctgtgaagattgtggttgaaatggagggtgcaaaagatgataaaaagtcaaagatgggcgcggctgaagtggtggatgtgttagttgaagatgctgctgcgaaacagccgaagaagcgcacggctgatgaagatgctgctgcgaaacagacgaagcacaaggctgatgctgagactggtggcaagagggtgaagagcagtgctgcagtggaagaggttgatgtgtgcgtcactcctatgaaacggaccaggaagagtggtgatatgcatgatgacggcaacggcagccctgctgtgagcagcggccgcagggtgactcggagcagtgtgaatgccacgggagctgatgacagtccagcgaggaggaccagaagccgtggcagagcatgctgaaggtagtgggtgctgggcgccctcttttttgggtgtggaacctttgctgtgcgcagtgttgcagccatttcttttggtttgggggagaccgacctgctacaggtattccccatgcttctttcttccaggatgcaattcctatttaatttcaaggtagctgctgcactcgatctgcgagatgcaattttgttaactggcagccaggtgttggcttacgccatgattttggcacaacaggttcctagagagaaacaagatagctgatgttcttgcaaaaaaaaagcaagacgggcaactaccccaaatccatgccttttctctaggggcttcattctccaacctgtaatatctagcatgtgttttgaaacttggattgttcggggcaacatgaccccccatctttgtaacatgtttatgatgtaataaatcttgaatttgaaaaacaaaagaggacatggaatgaaccagcacaccagaatctgaggtttgagagaaattgcacaaagacaaggcattcaaacatttgggctcacaccgtggacacatgacacgcacataaacgagatcaaacatagcaagaagaacc

SEQ ID NO: 4060 - DNA, 2961 bp, Panicum virgatum
gacgcgggcaggaaagggagcggaccgtgaggtgggccccaccacctctccccctcttcccggccgggccatccatcgcatttcccccttgcgcgtcgacagaagggaggaagtggcggggggaattggagaattggagagccgccgcgcccgcccgcccagcctcaaacccaaaaaaatttgaacccgcccctcccatcgcctcctccacttctcatcatctcccctcccaccccacgcaatccccatcccccattccgcccgcgcaaaaccctagctccaggctccagcgtcccccgcgaaccctctccctcgcagccgccgccacctctccaccatgccggacctcccctgcgacggcgatggtgtctgcatggtctgccgcgtcgcctccccgcccgaggtcgatctgctccgctgctccacctgcgccaccccgtggcactccccgtgcctctccaagccccccgccctcgccgacgccgccagctggagctgccccgactgctcccccgactcctccccggccccggctcccgccggccccgggaacgacctcgtcgccgccatccgcgccatcgaggccgaccacaccctctccgaccaggagaaagcgcggcgccgccaggccctcctcgccggctccgcccccgcggccgccgatgacgacgaggacgacaacgcggcggacgacgccctcgagatcgtggggaagaacttcagctgcgtcttctgtatgaagcttcctgaacgtcccgttacgacaccttgtggccataacttctgcttgaaatgcttccagaagtggattcagaatgggaaaaggacgtgtgggaaatgtcgggcgcagatcccggccaaaatggctgagcaaccaagaattaactctgcactagttgaagttatccggatggctaagatttcaaagaatcccaactcatcaggctctacagctccatatcactatattcggaatgatgataggcctgacaaggcatttacaactgacagagctaagaaggctgggaaagctaacgcttctagtggccagatctttgtgaccattgcacctgatcattttggccccattcttgcagaaaatgatccccgaaggaatattggtgttcgagttggggaaacatgggaagaccgtcttgagtgcaggcaatggggtgcccattttcctcatgtagctggtattgctggccagtctacatatggcgcacaatcagtagccctctcaggagggtatgaagatgatgaagaccatggagagtggtttctttacactggaagtggtggaagggatctaagcgggaacaagcggacaaacaaggagcaatcatcagatcagaaattcgagaagctaaatgctgctttacgtattagttgcttgaggggctaccctgtcagggttgtgcggtcgcacaaagagaagcgttcctcatatgctcctgaatctggtgtgaggtatgatggagtttatagaattgagaaatgttggaggaagattggtattcagggtacgttcaaggtctgcaggtatctctttgtacgctgtgacaatgaacctgccccctggaccagtgatgatcatggtgaccgtccaaggccattgccgaagataaaagagctgcaaggtgcaactgatataacggagaggaaaggacgcccttcatgggactatgttgagaaagaaggctggaaatgggtggtgcctccaccaatcagcaagaagcctgttctctctggggatcctgacactgacaaacaaatccggagagcaacaaagcgtgctcatatgtctgttgctgagaggctactgaaagagtttggctgttccatctgccgggccgtgattaaagaaccccttactactccatgtgctcacaacttttgcaaggcttgtttgcttggggcatatgatagccaggcttctatgagggaaagaagccgtggtggtcgaacccttagggcacagaagattgtgaagaaatgcccttcctgcccaactgacatctgtgacttcctagaaaatccccagatcaaccgagaaatgatggagctgattgagtctttgcaacgcaaggctgatgaaggtgacaccaaggtggcttcagatgatgctgaggagtgtggtgatggcgagtcagagggaaatgatggtgctttggtgaaggaagaggatgatagcagcatgaatgaggatgagcaagacagtgctgatgctgatgctaatgctgatggctctgtgaaaattgtggttgaaatcgaggaaggaaaagatgataagaaggccaagatgggtgtgactgaagtggcggatgtgttagttgaagaaaaggctgtgaaagagacaaagaaacgcaagggcgatgctgagactggcacagatgttgctcctgctaaaaggatgaagaaaaacattgctgctgtggaagaggctacttgcactccagtgaaacggatcagtaagagtggtgatgtggatagtgaaggcaatagtagtccggttgtgagcagtggccgtcgggtgactcggagcagtgcgaatgctagtgaagctgatgatagtctggcaaggaggaccagaagccgtgctagagctgatgctggttgctgatggtgatggaagcagggaagtgtggaagctggtggcctggagccagatgatgttctagggaggcttcgttttttggggaggttgtatgtagtctgggaagtttgcttcttttggttggggtgattgctgtgcctgggggggaactggattgcgtgtcgcgctgcatctgtttcttttggtttggtttggggaaaccgattgcggccttggtgattccctggccgcgcctcctggaatctggaattctggatggtggtttatccaagatgcttaaactatctaagttaccagctccattgaacatgcaattcctgtgtatgcctatgcctatgtttttt

SEQ ID NO: 4061 - DNA, 2551 bp, Zea mays
atggggggaaactggtctgggaaggagagtggtggccgtgcctgccctccccccgcccggccagcggcaaacccaaaatttgaacccgccgcttcgactgactactaccccaccatccaaaaccccactccggcctccgccgtcatttcctctccccgccaatccgccaccatttccagttccgaccgacctcgaaaccctagcccccagaccatcccactcgcaaccgccatgccggacctcccctgcgacggcgatggcgtctgtatggtctgccgcgtcgcatccccgccggaggtcgacctcctcacctgctccacctgcaccacgccctggcactctccgtgcctctccaagccccccgccctcgccgacgccgccagctggagctgccccgactgctcccccgactccgctgccgtcgccgctccctcgggccccgccaacaccctggtcgccgccatccgcgccatcgaggctgaccacacactctccgaccaggagaaggcgcgccgccgccaggccctcctcaccggcgacgcccccgacggcgcggacgacgatgacgacgaagcgtccgacgatgcccttgagatcgtcggcaagaacttcagctgcgttttctgcatgaagctccctgaacgacccgtcacgacaccctgtggccataacttctgcttgaaatgcttccagaagtggattcaaaatcagaagaggacgtgtgggaaatgtcgggcgcagatcccggccaaaatggctgagcagccaagaatcaactccgcactagtcgaagttatcaggatggctaagatttcaaagaatcctaactctgctggctcagcagttccatatcactatctacgaaatgatgataggcctgataaggcctttacaactgacagggctaagagggctggaaaagcaaacgcatcaagtggccagatctttgtgactattgcacctgatcattttggccccattcttgcagaaaatgacccccgcaggaatatgggtgttcgagtcggggaaacatgggaagaccgacttgagtgcaggcaatggggtgctcactttcctcatgtggctggcattgctggccagtctacgcatggtgctcaatcagtagccctctcaggagggtatgaagatgatgaagaccatggagagtggtttctttacaccggaagcggtgggagggatctaagtggtaacaagcggacaaacaaggaacagtcatctgatcagaaatttgagaagctgaatgctgctttacgcattagttgcttaaagggctaccctgttagggttgtacggtcgcacaaagagaagcggtcctcatatgctcctgaatctggtgtgaggtacgacggggtttacaggattgagaagtgctggaggaagattggtattcagggtaagttcaaggtctgcaggtatctctttgtacgctgtgacaatgaaccagctccttggaccagtgacgatcacggtgaccgtccaagaccattgccaaagataaaggagctgcaaggtgcaactgatataacagagaggaaagggcgcccttcatgggattatgatgataaagatggctggaaatgggtggtgcctccgccagtcagcaggaagcctgttctatctggggatcctgagaccgacaagcaaatccgtagagcaacaaagcgtgttcatttgtctgttgctgaaaggctgcttaaagaatttgcttgttcgatatgccgggcggtgattaaagaaccacttacgactccatgtgcccacaacttttgcaagacttgtttgcttggggcatatgatagccagtcttctataagggaaagaagccgtggtggtcggactctaagggcacagaagattgtgaagacgtgcccttcttgcccaactgacatctgtgattttttagagaatccccagatcaaccgagaaatgatggagctgattgagactttgcaacgcaaggctgttgaagaagccaagatgacttcagatgatgctgaggaatgtggtgatggtgattcggaggaaaatgatggtgatttggtgaagggagaggatgttagtggtttgaatgagggagagcaagacagtgcagacgctgatgctaatgttgaaggttctgtgaagattgtggttgaaatcaaggaggaaggaaaagatgataaaaggtcaaagatgggcgcgactgaagtggtggatgtgttagttgatgaagatgctgtgaagcagacgaaaaagcgcaaggttgatgctgaggctggcaccaacggtggcaagaggatgaagagcagtagtaccgtggaagaggttgctgtgtgcgtcactcctgtgaaacggagcaggaagagtggtgatatggatgatgagcgcaacggcagtcctgctgtgagcagcggccgcaggtgactcgcagcagtgtggatgacactggatctgctgatagtccggcgaggaggactagaagcccgtgccagagctgatgctggttgctgaaggggtagaaggaagcggggaagcggaaaaccagccgagc

SEQ ID NO: 4062 - DNA, 2825 bp, Panicum virgatum
ggaagtggcggggggatttggagaattggagagcccgccgcgcccgcccgcccgccccagcggccaaacccaaaaatttgaacctgcccctcccaccgcctcctcccctcctcatcatctcctcccccaccccccggcaatccccatcccccattccgcccgcgcaaaaccctagctccagcgcccccgcgaaccctccccctcgcagccgccgccacctctccgccatgccggacctcccctgcgacggcgatggcgtctgcatggtctgccgcgccgcctccccgcccgaggtcgacctgctccgctgctccacctgcgccaccccgtggcactccccgtgcctctccaagccccccgccctcgccgacgccgccagctggagctgccccgactgctcccccgactcctccccggccccggctcccgccggccccgggaacgacctcgtcgccgccatccgcgccatcgaggccgaccagaccctctccgaccaggagaaagcgcggcgccgccaggccctcctcgccggctccgcccccgcggccgccgatgacgacgaagacgacaacgcggcggacgacgccctcgagatcgtggggaagaacttcagctgcgtcttttgtatgaagcttcctgaacgtcccgtcacgacgccttgtggccataacttctgcttgaaatgcttccagaagtggattcagaatgggaaaaggacgtgtggaaaatgtcgggcgcagatcccggccaaaatggctgagcaaccaagaattaactctgcactagttgaagttatccggatggctaagatttcaaagaatcctaactcatcaggctctactgcaccatatcactatattcggaatgatgataggcctgacaaggcatttacaactgacagagctaagaaggctgggaaagcgaacgcttctagtggccagatctttgtgaccattgcacctgatcattttggccccattcttccagaaaatgatcctcgaaggaatattggagttcgagttggggaaacatgggaagaccgtcttgagtgcaggcaatggggtgcccattttcctcatgtagctggtatcgctggccagtctacatatggcgcacaatcagtagccctctccggagggtatgaagatgatgaagaccatggagagtggtttctttacactggaagtggtggaagggatctaagtgggaacaagcggacaaacaaggagcaatcatcagatcagaaatttgagaagctaaatgctgctttacgcattagttgcttgaggggataccctgtcagggttgtgcggtcacacaaagagaagcgttcctcatatgctcctgaatctggtttgaggtatgatggaatttatagaattgagaaatgttggaggaagattggtattcagggtaagtttaaggtctgcaggtatctctttgtacggtgtgacaatgaacctgctccatggaccagtgatgatcatggtgaccgtccgaggccattgccgaagataaaggagctgcaaggtgcaactgatataacggagaggaaaggacggccttcatgggactatgttgagaaagaaggctggaaatgggtggtgcctccaccaatcagcaaaaagcctgttctgtctggggatcctgagactgacaaacaaatccggagagcaacaaagcgtgctcatatgtctgtggctgagagactgctgaaagagtttggttgttccatctgtcgggcgttgattaaagaaccccttactactccatgtgctcacaacttttgcaaggcttgtttgcttggggcatatgatagccaggcttctatgagggaaagaagccgtggtggtcggaccctaagggcacagaagattgtgaagaaatgcccttcctgcccaactgacatctgtgacttcctagaaaatccccagatcaaccgagaaatgatggagctgattgagtctttgcaacgcaaggctgttgaagaaagtgacaccaaggtggcttcagatgatgctgaggaatgtggcgatggcgagtctgagggaaatgatggtgctttggtgaaggaagaggatgatagtagcatgaatgaggatgggcaagacagtgctgatgctaaagctgatggctctgtgaaaattgtggttgaaatcgaggaaggaaaagatgaaaatgccaagatgggtgtgactgaagtggtggatgtgttaattgaagaaaaggctgtgaaggagacaaagaagcgcaagggtgatgctgagaccggcacagatggtgctcctgctaaaaggatgaagaaaaacgttgctgctgtggaagaggctactagcactccagtgaaacggatcaggaagagtggcgatgtggatagtgaaggcaatggtagtcctgttgtgagcagtggccgtcgggtgactcggagcagtgcgaatgctagtgaagctgatgatagtccggcaaggcggaccagaagccgtgtcagagctgatactggttgctgatgggtgatggaagcagggaagtgcggaagctgggtggtttggagctggatgatgttgaagggaggctccatttttttggggaggtatgtattccgggaagtttgctttcttttggttggggtgattgctgcgcctgtgggtgaactggatcgcgtgccacgccgcatctgtttcttttggtttggtaaacctattgccggccttggtgattccctggtcgtgcctcctggaatctggacggttgtttatccaagatgcttaaactataacctaagttaccagctccattggacgtgcaatccctgtgtatgcctatgc

SEQ ID NO: 4063 - protein, 129 aa, Zea mays
MAAAARAGFRRLFSVSAFAAPPPPAARPAANPCNNLFVSGLNKRTTSEGLKEAFSKFGQVIEARVITDRISGYSRGFGFVKYATVQEAGEAIKGMDGKFLDSWVIFAETPHNHHNKEHQLMIEVAIHGR

SEQ ID NO: 4064 - protein, 890 aa, Brachypodium distachyon
MEHARLVTPTALAAVPFFFLFLLLCLHADAATTLLQGQSLGRNDKLVSPNGAFLLAFFVPRGGGDGSRAYLGVLYARAAEETVPWVANRDAPVSASSALYSATVTSSGQLQILEGDRVVWQTSNTPPSSSSGNNNNFTLTIQDTGNLVLGNGGQNTAPLWQSFDHPTDTFLPGMSITLDRRDGAVASNTLFTSWASPGDPAPGNFTLGQDPLGSAQLYIWRHTPGNTPNNSGIKYWRSGQWANTKFVGIPWRSLYVYGFRLAGDASRGSGTRGGVMSYTFSAYNESQFRFVLKPNGTETCYMLLESTGAWEVVWSQPTIPCHAYNTCGPNAGCAAADDHGRAAACKCLQGFEPRSEEEYYGRGNWTRGCVRSKPLTCSERNVEVSGGDAFAALPGVKLPDFAVWESTVGGADACKGWCLANCTCGAYSYSDGTGCLTWSGRDLVDVYKFPNGEGYDLHIKVPASLLETGAKRRRWTAVIVSVVTALAVVLAACGILLWKCRRRIGEKLGVGGREEKKPRPSMLHPRREAKNDFSGPKQQPDLEEAENGDSCELPLFPLETLAEATGGFSDSNKLGEGGFGHVYKGSLPGGEEVAVKRLSKSSGQGCEEFKNEVILISKLQHRNLVRILGCCIQGHEKMLVYEYMPNKSLDAFLFDPARRGLLDWKTRLSIIEGIARGLLYLHRDSRLRVVHRDLKASNILLDHDMNPKISDFGMARIFGGDQKQENTNRVVGTLGYMSPEYAMEGLFSVRSDVYSFGILVLEIITGQKNSSFHHMEGSLNIVGYAWQMWNADKGSELIDPSIRSSSASREALRCVHMALLCVQDHACDRPDIPYVVMALGSDSSVLPMPKPPTFTLQCTSSDREGFLGGNADYYESYSASDLTVTMLQGR

SEQ ID NO: 4065 - protein, 133 aa, Oryza sativa
MAAAAARAGFRRMFSVSGFTPPPPPAARPLADPCNNLFVSGLNKRTTSDGLREAFSKFGQVIEARVITDRISGYSRGFGFVKYATVEEAGEGIKGMDGKFLDGWVIFAEYAKQREAQQPAQPAASTSYQYSNQ

SEQ ID NO: 4066 - protein, 140 aa, Triticum aestivum
MAAVAAARAGAARAGFRRMFSVSAFAPPPPPTARPAAEPCNNLFVSGLNKRTTSDGLREAFSKFGQVTDARVITDRISGYSRGFGFVRYATVEEAGEGIKGMDGKFLDGWVIFAEYAKQREAQQPPQSAGTQSSGYQYPS

SEQ ID NO: 4067 - protein, 138 aa, Brachypodium distachyon
MAAVASRAGAARAGFRRMFSVSAFSPPPPPAARPAAEPCNNLFVSGLNKRTTTDGLREAFSKFGQVTEARVITDRISGYSRGFGFVKYATVEEAGEGIKGMDGKFLDGWVIFAEYAKQREAQQPPQSAGTPSGYQYSS

SEQ ID NO: 4068 - protein, 140 aa, Secale cereale
MAAVAAARAGAARVGFRRMFSVSAFAPPPPPTARPAAEPCNNLFVSGLNKRTTSDGLREAFSKFGQVIDARVITDRISGYSRGFGFVKYATVEEAGEGIKGMDGKFLDGWVIFAEYAKQREAQQPPQSAGTQTSGYQYPS

SEQ ID NO: 4069 - protein, 360 aa, Saccharum officinarum
MGKEGASGGGGGDGGMSESVIRKVLISYMYVAVWIFLSFSVIVYNKYILDPKMYNWPFPISLTMVHMAFCSSLAVALVRVLRVVDLPSSPAMTSQLYVSSVVPIGALYSLSLWFSNSAYIYLSVSFIQMLKALMPVAVYSIGVLFKKENFKSSAMLNMLSISFGVAIAAYGEARFDARGVALQLAAVAFEATRLVLIQILLTSKGISLNPITSLYYVAPCCLAFLVVPWVFVELPRLRAVGSFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSLGDRKTDNQA

SEQ ID NO: 4070 - protein, 360 aa, Zea mays
MGKEGASGGGGDGGMSASVIRKVLVSYMYVAVWIFLSFSVIVYNKYILDPKMYNWPFPISLTMVHMAFCSSLAVALVRVLRVVDLPSSPAMTSQLYLSSVVPIGALYSLSLWFSNSAYIYLSVSFIQMLKALMPVAVYSIGVLFKKETFRSSAMLNMLSISFGVAIAAYGEARFDARGVALQLAAVAFEATRLVLIQILLTSKGISLNPITSLYYVAPCCLAFLVVPWVFVELPRLRAVAGGFQPDLFVFGTNSLCAFALNLAVFLLVGKTSALTMNVAGVVKDWLLIAFSWSVIRDTVTPVNLFGYGIAFLGVGYYNHVKLQALKAKEAQKKAAQADEEAGSLLQERDSHGDRKTDDQA

SEQ ID NO: 4071 - protein, 355 aa, Zea mays
MGKEGASDGGMSESVIRKVLVSYMYVAVWIFLSFSVIVYNKYILDPKMYNWPFPISLTMVHMAFCSSLAVALVRVLRVVDLPSSPAMTSQLYVSSVLPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLAFLVVPWVFVELPRLRAVGIFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDNQA

SEQ ID NO: 4072 - protein, 360 aa, Setaria italica
MGKEGAGSGGGGDGGMSESVIRKVLVSYMYVAVWIFLSFSVIVYNKYILDPKMYNWPFPISLTMVHMAFCSSLAVALVRVLRVVDLPSSPAMTPQLYVASVLPIGALYSLSLWFSNSAYIYLSVSFIQMLKALMPVAVYSIGVLFKKENFKSSAMLNMLSISFGVAIAAYGEARFDVRGVALQLAAVAFEATRLVLIQILLTSKGISLNPITSLYYVAPCCLAFLVVPWVFVELPRLRAVGTFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDNQA

SEQ ID NO: 4073 - protein, 359 aa, Panicum virgatum
MGKEGAGSGGGDSGMSESVIRKVLVSYMYVAVWIFLSFAVIVYNKYILDPKMYNWPFPISLTMVHMAFCSSLAVALVRVLRVVDLPSSPAMTPQLYVASVLPIGALYSLSLWFSNSAYIYLSVSFIQMLKALMPVAVYSIGVLFKKETFKSSSMLNMLSISFGVAIAAYGEARFDVRGVALQLAAVAFEATRLVLIQILLTSKGISLNPITSLYYVAPCCLAFLVVPWVFVELPRLRAVGTFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHADRKTDNQA

SEQ ID NO: 4074 - protein, 98 aa, Oryza sativa
MTVKERKIHTATYMYDTSTFRITESDMPPSPPAPPPPSFPTAILLPAARRSVSPAPARRWIWAGWRAVPRRRAREMECEIWEGAGEEEEADLAGKEER

SEQ ID NO: 4075 - protein, 361 aa, Oryza sativa
MAVGKEGGGGAGGEGGMSDSVIRKVLVSYMYVAVWIFLSFTVIVYNKYILDPKMYNWPFPISLTMVHMAFCSSLAIALVRLLRVVELPSSPAMTPQLYTSSVLPIGALYSLSLWFSNSAYIYLSVSFIQMLKALMPVAVYSIGVLFKKENFKSSAMLNMLSISFGVAIAAYGEARFDARGVALQLAAVAFEATRLVLIQILLTSKGISLNPITSLYYVAPCCLAFLVIPWAFVELPRLRAVGTFQPDFFIFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGERKSDNQA

SEQ ID NO: 4076 - protein, 361 aa, Brachypodium distachyon
MAKEAGGGGGGGGDAALSDSVLRKVLVSYCYVAVWIFLSFTVIVYNKYILDPKMYNWPFPISLTMVHMAFCSSLAVALVRVFRVVDLPSSPAMTPQLYTSSVIPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLAFLFVPWVFVELPRLRAVGMFEPDFFVFGTNSLCAFALNLAVFLLVGKTSALTMNVAGVVKDWLLIAFSWSVIRDTVTPINLFGYGIAFLGVGYYNHVKLQALKAKEAQKKVAQADEEAGSLLQERESHGERKTDSQS

SEQ ID NO: 4077 - protein, 355 aa, Panicum virgatum
MGRDGGGAGGMSESVLRKVLLSYCYVAVWIFLSFSVIVYNKYILDPKMYNWPFPISLTMVHMAFCSSLAVALVRVLRVVDLPTSPAMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRLVLIQILLTSKGISLNPITSLYYVAPCCLCFLVVPWAFVELPRLRAVGTFQPDFFIFGTNSLCAFALNLAVFLLVGKTSALTMNVAGVVKDWLLIAFSWSVIRDTVTPINLFGYGIAFLGVAYYNHVKLQALKAKEAQKKAAQADEEAGSLLQERDGHSDRKSDNQA

SEQ ID NO: 4078 - protein, 354 aa, Setaria italica
MGRDGGGGGMSESVLRKVLLSYCYVAVWIFLSFSVIVYNKYILDPKMYNWPFPISLTMVHMAFCSSLAVALVRVLRVVDLPTSPAMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRLVLIQILLTSKGISLNPITSLYYVAPCCLCFLVVPWAFVELPRLRAVGTFQPDFFIFGTNSLCAFALNLAVFLLVGKTSALTMNVAGVVKDWLLIAFSWSVIRDTVTPINLFGYGIAFLGVAYYNHVKLQALKAKEAQKKAAQADEEAGSLLQERDGHGDRKSDNQA

SEQ ID NO: 4079 - protein, 357 aa, Zea mays
MGRDGGGGVAGGMSESVLRKVLLSYLYVAVWIFLSFSVIVYNKYILDPKMYNWPFPISLTMVHMGFCSSLAVALVRVLRVVDLPTSPSMTPQLYTSSVVPIGALYAMSLWFSNSAYIYLSVSFIQMLKALMPVAVYSIGVLFNKETFRSSSMLNMLSISFGVAIAAYGEARFDVRGVALQLAAVAFEATRLVLIQILLTSKGISLNPITSLYYVAPCCLCFLVVPWVFVELPRLRAVGTFQPDFFVFGTNSLCAFALNLAVFLLVGKTSALTMNVAGVVKDWLLIAFSWSVIRDTVTPINLFGYGIAFLGVAYYNHVKLQALKAKEAQKKAAQADEEVGSLLQERDGHGDHKSDNQA

SEQ ID NO: 4080 - protein, 355 aa, Hordeum vulgare
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIAFLGVGYYNHVKLQALKAKEAQKKVAQADEEAGSLLQERDSHGERKTETQS

SEQ ID NO: 4081 - protein, 357 aa, Sorghum bicolor
MGRDGGGGVAGGMSDSVLRKVLLSYFYVAVWIFLSFSVIVYNKYILDPKMYNWPFPISLTMVHMGFCSSLAVVLVRVLRVVDLPTSPSMTPQLYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLVVPWAFVELPRLRAVGTFQPDFFIFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDGHGDRKSDNQA

SEQ ID NO: 4082 - protein, 357 aa, Saccharum officinarum
MGREGGGGVAGGMSDSVLRKVLLSYFYVAVWIFLSFSVIVYNKYILDPKMYNWPFPISLTMVHMGFCSSLAVALVRVLRVVDLPTSPSMTPQLYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLVVPWAFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGSLLQERDGHGDRKSDNQA

SEQ ID NO: 4083 - protein, 355 aa, Secale cereale
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIAFLGVGYYNHVKLQALKAKEAQKKVAQADEEAGTLLQERDSHGERKTETQS

SEQ ID NO: 4084 - protein, 357 aa, Triticum aestivum
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIAFLGVGYYNHVKLQALKAKEAQKKVAQADEEAGSLLQERDSHGGERKTETQSS

SEQ ID NO: 4085 - protein, 357 aa, Cenchrus ciliaris
  misc_feature (79)..(79): Xaa can be any naturally occurring amino acid
  misc_feature (95)..(95): Xaa can be any naturally occurring amino acid
  misc_feature (99)..(99): Xaa can be any naturally occurring amino acid
  misc_feature (103)..(107): Xaa can be any naturally occurring amino acid
  misc_feature (292)..(292): Xaa can be any naturally occurring amino acid
MGRDGGGGGAGGMSDSVLRKVLLSYCYVAVWIFLSFSVIVYNKYILDPKMYNWPFPISLTMVHMAFCSSLAVALVRVLXVVDLPSSPAMTPQLYXSSVXPIGXXXXXSLWFSNSAYIYLSVSFIQMLKALMPVAVYSIGVLFKKENFKSSSMLNMLSISFGVAIAAYGEARFDARGVVFLLAAVAFEATRLVLIQILLLSKGTSLNPITSLYYGAPCCLAFLVVPWVFVELPRLRAVATFQPDLFVFGTNSLCAFALNLAVFLLVGKTSALTMNVAGVVKDWLLIAFSWSVXRDTVTPINLFGYGIAFLGVGYNNHVKLQALKAKEAQKKAAQADEEAGSLLQERDSHGERKTDNQA

SEQ ID NO: 4086 - protein, 357 aa, Zea mays
MGRDGGGGVAGGMSDSVLRKVLLSYFYVAVWIFLSFSVIVYNKYILDPKMYNWPFPISLTMVHMGFCSSLAVALVRVLRVVDLPTSPSMTPQFYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLLVPWAFVELPRLRAVGTFQPDFFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDNQA

SEQ ID NO: 4087 - protein, 355 aa, Avena sativa
MAKEAGGEGALSESVLRKVLVSYCYVAVWIFLSFTVIVYNKYILDPKMYNWPFPISLTMVHMAFCSSLAVALVRVFRVVDLPASPAMTPQLYYTSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLCFLFVPWVFVELPRLQAVGMFEPDFFVFGTNSLCAFALNLAVFLLVGKTSALTMNVAGVVKDWLLIAFSWSVIRDTVTPINLFGYGIAFLGVGYYNHVKLQALKAKEAQKKLAQADEEAGSLLQERDSHAERKTDTQS

SEQ ID NO: 4088 - protein, 354 aa, Oryza sativa
MAGGGGAGGMSESVLRKVLLSYCYVGVWIFLSFAVIVYNKYILDPKMYNWPFPISLTMVHMAFCSSLAVALVRLLRVVEPPSSPAMTPQLYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCLGFLLVPWVFVELPRLRAVGTFRPDFFVFGTNSLCAFALNLAVFLLVGKTSALTMNVAGVVKDWLLIAFSWSVIRDTVTPINLFGYGIAFLGVAYYNHVKLQALKAKEAQKKISQADEEAGSLLQERDGHSDRKSDNQA

SEQ ID NO: 4089 - protein, 354 aa, Hordeum vulgare
MAGGGGAGGLSESVMRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVAYYNHIKLQALKAKEAQKKSAQADEEAGSLLQERDSHSDRKSDNQA

SEQ ID NO: 4090 - protein, 353 aa, Brachypodium distachyon
MAGGGGAGGMSESVLRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCLGFLLVPWIFVELPRLRAVGTFQPDFFVFGTNSLCAFALNLAVFLLVGKTSALTMNVAGVVKDWLLIAFSWSVIRDTVTPINLFGYGIAFLGVAYYNHIKLQALKAKEAQKKSAQADEEAGSLLQEREHSDRKSDNQA

SEQ ID NO: 4091 - protein, 354 aa, Triticum aestivum
MAGGGGAGGLSESVMRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGSLLQERDSHSDRKSENQA

SEQ ID NO: 4092 - protein, 354 aa, Avena sativa
MAGGGGAGGLSESVLRKVLLSYCYVAVWIFLSFAVIVYNKYILDPKMYNWPFPISLTMVHMTFCSSLAVGLVRVLRVVEPPSSPPMTPQLYTSSVVPIGALYAMSLWFSNSAYIYLSVSFIQMLKALMPVAVYSIGVLFKKETFRSASMLNMLSISFGVAIAAYGEARFDVRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVAYYNHIKLQALKAKEAQKKNAQADEEAGSLLQERDGHSDRKSDNQA

SEQ ID NO: 4093 - protein, 351 aa, Secale cereale
MAGAGGLSESVMRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVAYYNHIKLQALKAKEAQKKSAQADEEAGSLLQERDSHSDRKSENQA

SEQ ID NO: 4094 - protein, 85 aa, Pseudoroegneria spicata
  misc_feature (5)..(5): Xaa can be any naturally occurring amino acid
  misc_feature (7)..(7): Xaa can be any naturally occurring amino acid
  misc_feature (9)..(10): Xaa can be any naturally occurring amino acid
  misc_feature (15)..(15): Xaa can be any naturally occurring amino acid
  misc_feature (20)..(20): Xaa can be any naturally occurring amino acid
  misc_feature (34)..(34): Xaa can be any naturally occurring amino acid
  misc_feature (62)..(62): Xaa can be any naturally occurring amino acid
  misc_feature (70)..(70): Xaa can be any naturally occurring amino acid
  misc_feature (75)..(75): Xaa can be any naturally occurring amino acid
  misc_feature (79)..(80): Xaa can be any naturally occurring amino acid
MAGGXGXGXXSESVXRKVLXSYCYVAVWIFLSFXVIVYNKYILDPKMYNWPFPISLTMVHMXFCSSLAVXLVRVXRVVXXPSSPP

SEQ ID NO: 4095 - protein, 355 aa, Musa acuminata
MGREGSGGGAEGGGGDGGVVRKVLLSYAYVAIWIFLSFTVIVYNKYILDPKMYNWPFPISLTMVHMAFCSSLAVLLVRVLRLVDPPSSPPMTRDLYVASVIPIGALYSLSLWFSNSAYIYLSVSFIQMLKALMPVAVYSIGVLLKKESFKTSSMLNMLSISLGVAVAAYGEARFVAWGVALQLGAVAFEATRLVLIQILLTSKGISLNPITSLYYVAPCCFAFLLVPWFVVELPLLRNRSSFHPDLLVFITNSFCAFALNLAVFLLVGKTSALTMNVAGVVKDWLLIAFSWSVIRDTVTPINLFGYGIAFLGVAYYNHVKLQALKAKEAEKKAQQADEEAGKLLQEMKGDRQNDS

SEQ ID NO: 4096 - protein, 376 aa, Hordeum vulgare
MAGGGGAGGLSESVMRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSLYTSSVLPIGALYSLSLWFSNSAYIYLSVSFIQMLKALMPVAVYSIGVLFKKETFRSSSMLNMLSISFGVAIAAYGEARFDLRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVAYYNHIKLQALKAKEAQKKSAQADEEAGSLLQERDSHSDRKSDNQA

SEQ ID NO: 4097 - protein, 360 aa, Musa acuminata
MGREGSGGGGGAVSEGVLKKVLLSYAYVAIWIFLSFTVIVYNKYILDPKMYGWPFPISLTMIHMAFCSTLAILLVRVLRLVDPPSSPPMTRALYLSSVVPIGALYSLSLWFSNSAYIYLSVSFIQMLKALMPVAVYSIGILFKKESFRTSSMLNMLSISFGVAIAAYGEARFNGTGVGLQLGAVAFEATRLVLIQILLTSKGISLNPITSLYYVAPCCLAFLLVPWSVVELPILRARSASSLRPDLLIFGTNSLCAFALNLAVFLLVGKTSALTMNVAGVVKDWLLIAFSWSVIRDTVTAINLFGYAIAFLGVAYYNHVKLQALKAKEAQKKAAQADDEAGKLLDQVDGSGGDRKGDSQA

SEQ ID NO: 4098 - protein, 391 aa, Arabidopsis lyrata
MVKLLELFITSSKPVVEILLITSVGFYMALDGVNLLGQDARKYLNNIVFYVFGPSLIGSRLADSVTYESLVKMWFMPVNVLLTFIIGSLLGWIVIVITKPPSHLRGLILGCCAAGNLGNMPLIIIPAVCKEKGGPFGDPESCQKYGMGYVALSMAMGSIYIWTYVYNLMRVLSNSPVETPPSVESNYDSYKVPLISSKEEEEDNQKAGRWEIVKRRLVSLSEKVNLKTIFAPSSIAAMIALVIGLITPLRKLIIGTEAPLRVLQDSVTLVGDGAVPAMTMIIGGNLLKGLRSSGMKMSSIIGVLVARYVLLPMSGVLIVRGAYKLDLVTSEPLYQFVLLLQYAVPPAMNLGTITQLFGTGESECSVIMLWTYSLASISLTVWPTFFMWLVA

SEQ ID NO: 4099 - protein, 388 aa, Brassica rapa
MKLLNLFITSSKPVVEILLITIVGFYLALDGVNLLGQDARKYLNNIVFYVFSPSLIGSRLADSVTYESLVKMWFMPVNVLLTFIIGSLLGWIVIVITKPPSHLRGLIVGCCAAGNLGNMPLIIVPAICKERGGPFGDPENCQKYGMGYVALSMAMGSVYIWTYVYNLMRVLNSPIETQPSIESNYDTCKVPLIPSKEEEDNQKAGRWDRIKRRIVSLSEKVNLRTIFAPSTIAAMIALVIGLITPLRKLIIGNGAPLGVLQDSVTLVGDGAIPAMTLIIGGNLLKGMRSSGMKKSSIIGVLVARYILLPISGVLIVRGAYKLDLITSEPLYQFVLLIQYAVPPAMNLGTITQLFGAGESECSVIMLWTYALASVSLTAWPTFFMWLVA

SEQ ID NO: 4100 - protein, 389 aa, Eutrema halophilum
MKLLDLFITSSKPVVEILLITSVGFYMALDGVNLLGQDARKYLNSIVFYVFSPSLIGSRLADSVTYESLVKMWFMPVNVLFTFIIGSLLGWIVIVITKPPSNLRGLILGCCAAGNLGNMPLIIIPAVCKEKGGPFGDPESCQKYGMGYAALSMAMGSVYIWTYVYNLMRVLSNSPIETQPSIESNYDSCKVPLISSKQEEDNHKVGRWEKVKRRWVSLSEKVNLRTIFAPSTIAAIIALVVGLVTPFRKLIIGNVAPLRVLQDSVTLVGDGAIPATTLIIGGNLLKGMRSSGMKKSSIIGVLVARYIFLPISGVLLVRGAYKLDLITSEPLYQFVLLIQYVVPPAMSLGTITQLFGAGENECSVILLWTYALASISLTVWPTFFMWLVA

SEQ ID NO: 4101 - protein, 386 aa, Brassica rapa
MKLLHLFITSSKPVVEILLITTVGFYMALDGVNLLGQDARKFLNNIVFYVFSPSLIGSRLANSVTYESLMQMWFMPVNVLLTFIIGSFLGWIVILITKPPSHLRGLIVGCCAAGNLGNMPLIIVPAVCKEKGGPFGDPENCQKYGVGYVALSMAMGSIYIWTYVYNLMRVLTNSPIETQPSIESSCKVPLISSKEEEDNQKVGRWDKVKRRMVSLSGKVNLRTIFAPSTIAAMIALVVGLITPIRKLIIGNGAPLGVLQDSVTLVGDGAIPAMTLIIGGNLLKGMRSSGMKKSSIVGVLVARYIFLPISGVLIVRGAYKFDLITSEPLYQFVLLLQYAVPPAMNLGTITQLFGAGESECSVILLWTYALASVSLTVWPTFFMWLVA

SEQ ID NO: 4102 - protein, 386 aa, Brassica napus
MKLLHLFITSSKPVVEILLITTVGFYMALDGVNLLGQDARKFLNNIVFYVFSPSLIGSRLANSVTYESLMQMWFMPVNVLLTFIIGSFLGWIVILITKPPSHLRGLTVGCCAAGNLGNMPLIIVPAVCKEKGGPFGDPENCQKYGVGYVALSMAMGSIYIWTYVYNLMRVLTNSPIETQPSIESSCKVPLISSKEEEDNQKVGRWDKVKRRMVSLSGKVNLRTIFAPSTIAAMIALVVGLITPIRRLIIGNGAPLGVLQDSVTLVGDGAIPAMTLIIGGNLLKGMRSSGMKKSSIVGVLVARYIFLPISGVLIVRGAYKFDLITSEPLYQFVLLLQYAVPPAMNLGTITQLFGAGESECSVILLWTYALASVSLTVWPTFFMWLVA

SEQ ID NO: 4103 - protein, 387 aa, Raphanus sativus
MKLLHLFITSSKPVVEILLITTVGFYMALDGVNLLGQDARKVLNNIVFYVFSPSLIGSRLANSVTYESLMQMWFMPVNVLLTFIIGSFLGWIVILITKPPSHLRGLIVGCCAAGNLGNMPLIIVPALCKEKGGPFGDPENCQKYGVGYVALSMAMGAVYIWTYVYNLMRVLSNSPIETQPSIESNSCKVPLISSREEEANQKVGRWDKVKLRMVSLADKVNLRTIFAPSTIAAMIALVVGLITPIRKLIIGNGAPLGVLQDSATLVGDGAIPAMTLIIGGNLLKGMRSSGMKKSSIIGVLVARYIFLPISGVLIVRGAYKFDLITSEPLYQFVLLLQYAVPPAMNLGTITQLFGAGESECSVILLWTYAFASISLTVWPTYFMWLVA

SEQ ID NO: 4104 - protein, 388 aa, Brassica rapa
MLKLLHLFITSSKPVVEILLITSVGLYMALDGVNLLGPDARKYLNDIVFYVFNPSLVGSRLADSVTYDSLVKMWFMPINLLLTFIIGSLLGWIVILITKPPSNLRGLIVGCCAAGNLGNMPLIIIPAVCKDKGGPFGDPENCNKYGMGYVALSMAMGSVYIWTYVYNIMRVLSNSVIETQPSIESNCKVPLISSREEEEDNHKVGRWDRFKRRMVSLSEKVNLSTIFAPTTIAAIIALVIGLINPVRELIIGNVAPLGVLQDSVTLVGDGAIPATTLIIGGNLLKGMRSSGMKRSSIVGVLVARYILLPISGVLIVRGAYKLDLITSEPLYQFVLLIQYAVPPAMSLGTITQLFGAGESECSVIMLWAYGLASVSLTAWPTFFMWLVA

SEQ ID NO: 4105 - protein, 292 aa, Raphanus sativus
  misc_feature (85)..(85): Xaa can be any naturally occurring amino acid
  misc_feature (131)..(131): Xaa can be any naturally occurring amino acid
  misc_feature (156)..(156): Xaa can be any naturally occurring amino acid
  misc_feature (173)..(173): Xaa can be any naturally occurring amino acid
MKLLHLFITSSKPVVEILMITSVGFYMALDGVNLLGPDSRKYLNDIVFYVFNPSLVGSRLADSVTYESLVKMWFMPVNLLLTFIXGSFLGWIVILITKPPPHLRGLIVGCCAAGNLGNMPLIIIPAVCKDXEGPFGDPENCHKYGMGYVAFSMAIXSVYIWTYVYNLMRVLSXSPTEAQPSIESSYKVPLISSKEEEEEEDNHKVGRWDRFKRRMVSLSEKVNLSIIFAPTTIAAIIALVIGLINPLRELIIGSVAPLGVLQDSVTLVGDGAIPATTLIIGGNLLKGMRAQE

SEQ ID NO: 4106 - protein, 219 aa, Arabidopsis lyrata
MVMETESKFHVLAVDDSLFDRKMIERLLQKSSCQVTTVDSGSKALEFLGLRVDDNNPNALSTSPQIHQEVEINLIITDYCMPGMTGYDLLKKVKESAALRSIPVVIMSSENVPARISRCLEEGAEEFFLKPVKLADLTKLKPHMMKTKLKNESEKPVAIEEIVVSKPEIEKEEASSVIEILPLHQELEPMLSSNKRKAMEEVISTDRSRPKYNDITTSV

SEQ ID NO: 4107 - protein, 223 aa, Eutrema parvulum
MGMVTESQFHVLAVDDSLFDRKMIERLLQKSSCQVTTVDSGSKALEFLGLRESDEIDDPNAPSSSPETHQEVEINLIITDYCMPGMTGYDLLKKVKESAAFKSIPVVIMSSENVPARISRCLEEGAEEFFLKPVKLADLTKLKPHMMKTKLKKESEKPVEEENAALKPKIEEESQVNETLPLHQELVSEQDEPILSNNKRKAMEEVISTDRSRPKYNDITTPV

SEQ ID NO: 4108 - protein, 216 aa, Brassica rapa
MGVVTESQFHVLAVDDSLFDRKMIERLLQKSSCQVTTVDSGSKALELLGLRESNESDDPNATSTSPEVEINLIITDYCMPGMTGYDLLKRVKESAAFRSIPVVIMSSENVPARISRCLEEGAEEFFLKPVKLADLTKLKPHMMKTKLKKESEKPAEEVKPEIEEEESPVIEILTLHQELESEQQEPMLSNNKRKAMEEAISTGRSRPKYNDITTSV

SEQ ID NO: 4109 - protein, 222 aa, Brassica napus
MGMATESQFHVLAVDDSLVDRKMIERLLQKSSCQVTTVDSGSKALEFLGLRESNESNDPNAPSSSPVTHQEIEINLIITDYCMPGMTGYDLLKRVKESAAFRSIPVVIMSSENVPARISRCLEEGAEEFFLKPVKLADLTKLKPHMMKTKLKKESENSAKEDNAVLKHEIRKEEEPSVIEILPLHQDVEQEPMLSNNKRKAMEEVISTDRSRPKYNDITTLV

SEQ ID NO: 4110 - protein, 228 aa, Eutrema halophilum
MGVVTESQFHVLAVDDSLFDRKMIERLLQKSSCQVTTVDSGSKALEFLGLRESNDESEDPNVLSTSPVTHQEVEINLIITDYCMPGMTGYDLLKRVKESAAFKSIPVVIMSSENVPARISRCLEEGAEEFFLKPVKLADVTKLKPHMMKTKLKKETEKPGKEEIAALKPEIEEDSSVIEILPLHQELESEQHEAMLSSNKRKAMEEVISTDRSRPKYSEITTSDQFFL

SEQ ID NO: 4111 - protein, 73 aa, Brassica napus
MMKTKLKKESEKPAEEVKPEIEEEEESPVIEILTLHQELESEQQEPMLINNKRKAMEEVISTGRSRPKYNDIT

SEQ ID NO: 4112 - protein, 214 aa, Brassica rapa
MGMVRESQFHVLAVDDSQLDREMIERLLQKSSCQVTTVDSGSKALEFLGLRESNDPNSLETHQEVEINLIITDYCMPGMTGYDLLKKVKESAAFRSIPVVIMSSENVPARISRCLEEGAEEFFLKPVKLADVTKLKPHMMKTKLKKEGEKVAEEENATSKPEESLVVEMILPLNQELELEQQEPMLSSNKRKAMEEVISADRSRPKYNDITTSV

SEQ ID NO: 4113 - protein, 214 aa, Brassica napus
MGMVRESQFHVLAVDDSQLDRKMIERLLQKSSCQVTTVDSGSKALEFLGLRESNDPNSLETHQEVEINLIITDYCMPGMTGYDLLKKVKESAAFRSIPVVIMSSENVPARISRCLEEGAEEFFLKPVKLADVTKLKPHMMKTKLKKEGEKVGEEENATSKPEESLVVEMILPLNQELELEQQEPMLSSNKRKAMEEVISADRSRPKYNDITTSV

SEQ ID NO: 4114 - protein, 214 aa, Brassica napus
MGMVRESQFHVLAVDDSHLDRKMIERLLQKSSCQVTTVDSGSKALEFLGLRESNDQNALETHQEVEINLIITDYCMPGMTGYDLLKKVKESVAFRSIPVVIMSSENVPARISRCLEEGAEEFFLKPVKLADVTKLKPHMMKTKLKKEGEKPSEEENATLKPEESLVVEMILPLNQELELEQKEPMLSSNKRKAMEEVISADRSRPKYNDITTSV

SEQ ID NO: 4115 - protein, 208 aa, Raphanus sativus
MITESKFHVLAVDDSLFDRKMIERLLQKSSCQVTTVDSGSKALEFLGLRESNDPNAVETHQEVEINLIITDYCMPGMTGYDLLKKVKESSAFKSIPVVIMSSENVPARISRCLEEGAEEFFLKPVKLADVTKLKPHMMKTKLKKEGEKPSEEENATLKPVIEILPLHQELESEQHESSTLSSNKRKAMEEVISTGRSRPKYNDITTSV

SEQ ID NO: 4116 - protein, 631 aa, Eutrema parvulum
MDLNENVVHFSRANGIAKLDNFGDTALSLKCLGSSQGRLLGSSHHNHKLCSDVSNCPDDGCRLVLGLGPTPSSYYYNVRVNNKNKVSASSGTVQELSSGGNSILQLGPPAVSMDSFSGLDCSMLTYAETNVSQADEGSTSAKRSGGYMPSLLFAPRTENVRKPSRMQECSTNFGTDAYNSQLSHESEFSAGAAFSDRTASATSSQHRTTNPKKCKFMGCVKGARGASGLCIGHGGGQRCQKAGCNKGAESKTTFCKAHGGGKRCQHLGCTKSAEGKTDFCISHGGGRRCGFPEGCAKAARGKSGLCIKHGGGKRCRIEGCTRSAEGQAGLCISHGGGRRCQSSGCTKGAQGSTNYCKAHGGGKRCIFAGCTKGAEGSTPLCKAHGGGKRCMFDGGGICPKSVHGGTSFCVAHGGGKRCVVTGCTKSARGRTDCCVKHGGGKRCKSLGCEKSAQGSTDFCKAHGGGKRCSWGGDWKCEKFARGKSGLCAAHNSMSQDKAGSKIGLIGPGLFRGLVSTSSQTTTTATTTTTTTDHSQSGVSAVSDCTDSIDRSLQRHHHPEKRQKLMIPMQVLVPPSMKSLSFSNTERPETETNKNSSNSNGRNIFDFMIPEERVHGGGLMSLLNGSLKQTLH

SEQ ID NO: 4117 - protein, 663 aa, Arabidopsis lyrata
MDLNQSVVHFSRGNGIAKLDNFGDTALSLKCLGSSAGRFIGSSHHNHKLCSDVSNCPDGGCRLVLGLGPTPPSYYYNVTGNDNNIKGSASSGSVQELSSGGNSILQLGPPAVTMDTFSGLDCSLLTYTDTNVSQAVVDEGSTSARRSGGYMPSLLFAPRTENVRKPSRMQECSTNFGTDAYNSQLSHESEFSVGAFSDRSASATSSQQRLSNPKKCKFMGCVKGARGASGLCIGHGGGQRCQKLGCNKGAESKTTFCKAHGGGKRCQHLGCTKSAEGKTDLCISHGGGRRCGFPEGCAKAARGKSGLCIKHGGGKRCRIESCTRSAEGQAGLCISHGGGRRCQSSGCTKGAQGSTNYCKAHGGGKRCIFAGCTKGAEGSTPLCKAHGGGKRCMFDGGGICPKSVHGGTSFCVAHGGGKRCVVAGCTKSARGRTDCCVKHGGGKRCKSDGCEKSAQGSTDFCKAHGGGKRCSWGGDWKCEKFARGKSGLCAAHNSMSQDKAGSKVGLIGPGLFRGLVSTSSQTTTTATTTTTDHSQSGVSAVSDCTESIDRPLPPLLHQPEKRQKLMIPMQVLVPPSMKSLSFSNTERPEIETNNNSSGSNGRNIFDFMIPEERVHGGGLMSLLNGFVILRSEISVLLLRFIVQSFSILISSSCDDDSRFIGKL

SEQ ID NO: 4118 - protein, 628 aa, Eutrema halophilum
MDMNESVVHLSRANGIAKLDNFGDTALSLKCLGSSAGRLMGSSHHNHKLCSDVSNCPDGGCRLVLGLGPTPPSYYYNVSVNSNKGSASSGIVHSGIVQELSSGGNSILQLGPPAVAMDTFSGLDCSLLTYTETNVSQAVVDEGSTSAKRSGGYMPSLLFAPRTENVRKPSRMQDCSTDFGQTDASQLSHESELSDRTASSQQRTTNPKKCKFMGCAKGARGASGLCIGHGGGQRCQKAGCNKGAESKTTFCKAHGGGKRCQHLGCTKSAEGKTDFCISHGGGRRCGFPEGCTKAARGKSGLCIKHGGGKRCRIEGCTRSAEGQAGLCISHGGGRRCQSSGCTKGAQGSTNYCKAHGGGKRCIFAGCTKGAEGSTPLCKAHGGGKRCMFDGGGICPKSVHGGTSFCVAHGGGKRCVVEGCTKSARGRTDCCVKHGGGKRCKSLGCEKSAQGSTDFCKAHGGGKRCSWGGDWKCEKFARGKSGLCAAHNSMSQDKAGSKIGLIGPGLFRGLVSTSSQTTTTATTTTTTDHSQSGVSAVSDCTDSIDHHPPQLHHHHHPEKRQKLMIPMQVLVPPSMKSLSFSNSERPETETNNNSSSNGRNIFDFMIPEERVHGGGLMSLLNGSLKQTLH

SEQ ID NO: 4119 - protein, 598 aa, Brassica rapa
MDLNESGLHFSRTNGITKLDNYGDTALSLKCLGSTRYNHKLCSDVSNCPDGGCGLVLGLGPTPPSYYYNVNKVSASSGTFQELSSGGNSILQLGPPAVTTMDAFSSLDCSLLTYTETNMSQADEGSTSAKRSGGYMSSLLFAPRTETVRKPSRMQECSNNSQLSHHESEFSERTVSATSSQHRTTNPKKCKFMGCTKGARGASGLCIGHGGGQRCQKAGCNKGAESKTTFCKAHGGGKRCQHLGCTKSAEGKTDYCISHGGGRRCGFPEGCGKAARGKSGLCIKHGGGKRCRIEGCTRSAEGQAGLCISHGGGRRCQSPGCTKGAQGSTNYCKAHGGGKRCIFAGCTKGAEGSTPLCKAHGGGKRCMFDGGGICPKSVHGGTSFCVAHGGGKRCVVAGCTKSARGRTDCCVKHGGGKRCKSIGCEKSAQGSTDFCKAHGGGKRCSWGGDWKCEKFARGKSGLCAAHNSMAQEKGGSKIGLIGPGLFRGLVSTSSQTTATTTTTDHSQSGVSAVSDCTDSIDRSLHHQPEKRQKVMIPMQVLVPPSMKSLSFTEAERPETETNNNSSGRNIFDFMIPEERVHGGGLMSLLNGSMNQTLR

SEQ ID NO: 4120 - protein, 73 aa, Secale cereale
MGKEKTHINIVVIGHVDSGKSTTTGHLIYKLGGIDKRVIERFEKEAAEMNKRSFKYAWVLDKLKAERERGYHH

SEQ ID NO: 4121 - protein, 447 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYQGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4122 - protein, 129 aa, Secale cereale
MTLPREAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4123 - protein, 272 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVPLVPLV

SEQ ID NO: 4124 - protein, 447 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 4125 - protein, 254 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEISQGSLFVPEKVGYNPDKVPFVPISGFEGDNMIERSTNLDWYKGPTLLEALDQINEPKRPSDKPCVSPSGCLQDWWHWNCACWTC

SEQ ID NO: 4126 - protein, 360 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASTPRMTLPRGRQLHLPGHHHEPPWSDRQRLRPSAGLPHLPHCCQVC

SEQ ID NO: 4127 - protein, 447 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 4128 - protein, 444 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAI

SEQ ID NO: 4129 - protein, 447 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4130 - protein, 447 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 4131 - protein, 447 aa, Avena sativa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIVKMIPTKPMVVETFSTYPPLGRFAVRDMRQTVAVGVIKGVEKKDPTGAKVTKAAAKKK

SEQ ID NO: 4132 - protein, 442 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKA

SEQ ID NO: 4133 - protein, 447 aa, Avena sativa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIVKMIPTKPMVVETFSTYPPLGRFAVRDMRQTVAVGVIKGVEKKDPTGAKVTKAAAKKK

SEQ ID NO: 4134 - protein, 447 aa, Brachypodium distachyon
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMIVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGIVKMIPTKPMVVETFAMYPPLGRFAVRDMRQTVAVGVIKGVEKKDPTGAKVTKAAAKKK

SEQ ID NO: 4135 - protein, 437 aa, Secale cereale
VVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4136 - protein, 165 aa, Brachypodium distachyon
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVYMSQVLEGPL

SEQ ID NO: 4137 - protein, 445 aa, Brachypodium distachyon
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVYTPKYSKARYDEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMIVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGIVKMIPTKPMVVETFAMYPPLGRFAVRDMRQTVAVGVIKGVEKKDPTGAKVTKAAAKKK

SEQ ID NO: 4138 - protein, 447 aa, Cajanus cajan
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELITKIDRRSGKELEKEPKFLKNGDAGLVKMIPTKPMVVETFAEYPPLGRFAVRDMRQTVAVGVIKNVEKKDPTGAKVTKAAQKKK

SEQ ID NO: 4139 - protein, 447 aa, Vigna unguiculata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGFVKMIPTKPMVVETFSEYPPLGRFAVRDMRQTVAVGVIKSVEKKDPTGAKVTKAAQKKK

SEQ ID NO: 4140 - protein, 447 aa, Arachis hypogaea
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGLVKMIPTKPMVVETFSEYPPLGRFAVRDMRQTVAVGVIKNVEKKDATGAKVTKAAQKKK

SEQ ID NO: 4141 - protein, 447 aa, Cajanus cajan
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGTLKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGYVKMIPTKPMVVETFSEYPPLGRFAVRDMRQTVAVGVIKNVEKKDPTGAKVTKAAQKKK

SEQ ID NO: 4142 - protein, 447 aa, Glycine max
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGYVKMIPTKPMVVETFSEYPPLGRFAVRDMRQTVAVGVIKSVEKKDPTGAKVTKAAQKKK

SEQ ID NO: 4143 - protein, 447 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPTGAKVTKAAAKKK

SEQ ID NO: 4144 - protein, 447 aa, Triticum aestivum
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 4145 - protein, 169 aa, Brachypodium distachyon
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVYLQAEFSQVLEGPL

SEQ ID NO: 4146 - protein, 450 aa, Brachypodium distachyon
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVYLIFNFTPKYSKARYDEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMIVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGIVKMIPTKPMVVETFAMYPPLGRFAVRDMRQTVAVGVIKGVEKKDPTGAKVTKAAAKKK

SEQ ID NO: 4147 - protein, 447 aa, Phaseolus vulgaris
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGVIKPGMLVTFAPTGLTTEVKSVEMHHEALLEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGYVKMIPTKPMVVETFSEYPPLGRFAVRDMRQTVAVGVIKSVEKKDPTGAKVTKAAQKKK

SEQ ID NO: 4148 - protein, 447 aa, Malus domestica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEAMLEALPGDNVGFNVKNVAVKDLKRGYVASNSKDDPAKEAANFTSQVIIMNHPGQIGQGYAPVLDCHTSHIAVKFAELVTKIDRRSGKELEKEPKFLKNGDAGFVKMIPTKPMVVETFSEYPPLGRFAVRDMRQTVAVGVIKSVEKKDPTGAKITKAAAKKK

SEQ ID NO: 4149 - protein, 447 aa, Vigna unguiculata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDNINEPKRPSDKPLRLPLQDVYKIGGIGTVPVGRVETGVLKPGMVVTFAPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGFVKMIPTKPMVVETFSEYPPLGRFAVRDMRQTVAVGVIKSVEKKDPTGAKVTKAAQKKK

SEQ ID NO: 4150 - protein, 447 aa, Humulus lupulus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPTDKPLRLPLQDVYKIGGIGTVPVGRVETGVIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGIIKMIPTKPMVVETFSEYPPLGRFAVRDMRQTVAVGVIKAVEKKDPSGAKVTKSAVKKK

SEQ ID NO: 4151 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSAYPPLGRFAVRDMRQTVAVGVIKSVEKKDPTGAKVTKAAAKKK

SEQ ID NO: 4152 - protein, 447 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4153 - protein, 447 aa, Cajanus cajan
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGFVKMVPTKPMVVETFSEYPPLGRFAVRDMRQTVAVGVIKSVEKKDPTGAKVTKAAQKKK

SEQ ID NO: 4154 - protein, 447 aa, Oryza sativa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKNVEKKDPTGAKVTKAAAKKK

SEQ ID NO: 4155 - protein, 447 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTCHIAVKFAEIQTKIDRRSGKELEAAPKFLKNGDAGFVKMIPTKPMVVETFAQYPPLGRFAVRDMRQTVAVGVIKSVEKKEPTGAKVTKAAIKKK

SEQ ID NO: 4156 - protein, 435 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKNGPH

SEQ ID NO: 4157 - protein, 432 aa, Secale cereale
VDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4158 - protein, 447 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKELEAAPKFLKNGDAGFVKMIPTKPMVVETFAQYPPLGRFAVRDMRQTVAVGVIKSVEKKEPTGAKVTKAAIKKK

SEQ ID NO: 4159 - protein, 447 aa, Glycine max
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4160 - protein, 447 aa, Triticum aestivum
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSHKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 4161 - protein, 96 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDRPRTS

SEQ ID NO: 4162 - protein, 258 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGQPCLRLWTRSTSPRGLPTSPCVSPFRTCTRLVVLELSLLAVLRLV

SEQ ID NO: 4163 - protein, 447 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGVIVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGLVKMIPTKPMVVETFSEYPPLGRFAVRDMRQTVAVGVIKSVEKKDPTGAKITKAAVKKK

SEQ ID NO: 4164 - protein, 447 aa, Unknown
  Sequence found in Organisms: Gossypium hirsutum, Gossypium raimondii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALTEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMIPTKPMVVETFSEYPPLGRFAVRDMRQTVAVGVIKSVEKKDPTGAKVTKSAAKKK

SEQ ID NO: 4165 - protein, 447 aa, Cucumis sativus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLISEPKRPSDKPLRLPLQDVYKIGGIGTVPVGRVETGVLKPGMVVTFGPTGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSAKELEKEPKFLKNGDAGMVKMIPTKPMVVETFSTYPPLGRFAVRDMRQTVAVGVIKSVEKKDPTGAKVTKSAVKKK

SEQ ID NO: 4166 - protein, 447 aa, Cynodon dactylon
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAASFTSQVIIMNHPGQIGNGYAPVLDCHTSHIAVKFAELLTKIDRRSGKELEKEPKFLKNGDAGMVKMIPTKPMVVETFSQYPPLGRFAVRDMRQTVAVGVIKSVEKKDPTGAKVTKAAAKKK

SEQ ID NO: 4167 - protein, 447 aa, Setaria italica
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMLVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4168 - protein, 447 aa, Zea mays
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSQYPPLGRFAVRDMRQTVAVGVIKSVEKKDPTGAKVTKAAAKKK

SEQ ID NO: 4169 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSQYPPLGRFAVRDMRQTVAVGVIKSVEKKDPTGAKVTKAAAKKK

SEQ ID NO: 4170 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMIPTKPMVVETFSQYPPLGRFAVRDMRQTVAVGVIKSVEKKDPTGAKVTKAAIKKK

SEQ ID NO: 4171 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSAYPPLGRFAVRDMRQTVAVGVIKSVEKKDPTGAKVTKAAAKKK

SEQ ID NO: 4172 - protein, 447 aa, Medicago truncatula
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGIVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIIKMVPTKPMVVETFAEYPPLGRFAVRDMRQTVAVGVIKAVEKKDPTGAKVTKAAAKKK

SEQ ID NO: 4173 - protein, 447 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4174 - protein, 447 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKELEAAPKFLKNGDAGFVKMVPTKPMVVETFAQYPPLGRFAVRDMRQTVAVGVIKSVEKKEPTGAKVTKAAIKKK

SEQ ID NO: 4175 - protein, 447 aa, Triticum aestivum
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKSVEKKDPTGAKVTKAAAKKK

SEQ ID NO: 4176 - protein, 109 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPGDRDFIKNMITGTLPS

SEQ ID NO: 4177 - protein, 447 aa, Aristolochia fimbriata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPSDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGLVKMIPTKPMVVETFSEYPPLGRFAVRDMRQTVAVGVIKSVEKKDPTGAKVTKSAVKKK

SEQ ID NO: 4178 - protein, 447 aa, Musa acuminata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLINEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGFVKMIPTKPMVVETFSGYPPLGRFAVRDMRQTVAVGVIKSVEKKDPSGAKVTKAAQKKK

SEQ ID NO: 4179 - protein, 447 aa, Gossypium hirsutum
MGKEKTHINIVVIGHVDSGKSTTTGHLIYKLGGIDKRVIERFEKEAAEMNKRSFKYAWVLDKLRAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALTEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMIPTKPMVVETFSEYPPLGRFAVRDMRQTVAVGVIKSVEKKDPTGAKVTKSAAKKK

SEQ ID NO: 4180 - protein, 447 aa, Unknown
  Sequence found in Organisms: Gossypium hirsutum, Gossypium raimondii
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALTEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMIKMIPTKPMVVETFSEYPPLGRFAVRDMRQTVAVGVIKNVEKKDPTGAKVTKSAAKKK

SEQ ID NO: 4181 - protein, 447 aa, Cucurbita pepo
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLISEPKRPSDKPLRLPLQDVYKIGGIGTVPVGRVETGVLKPGMVVTFGPTGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGMVKMIPTKPMVVETFSSYPPLGRFAVRDMRQTVAVGVIKSVEKKDPTGAKVTKSAVKKK

SEQ ID NO: 4182 - protein, 447 aa, Cucurbita pepo
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPSDKPLRLPLQDVYKIGGIGTVPVGRVETGVLKPGMVVTFGPTGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGMVKMIPTKPMVVETFSSYPPLGRFAVRDMRQTVAVGVIKSVEKKDPTGAKVTKSAVKKK

SEQ ID NO: 4183 - protein, 447 aa, Setaria italica
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMLVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4184 - protein, 447 aa, Lotus japonicus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGFVVTFAPTGLTTEVKSVEMHHESLTEALPGDNVGFNVKNVAVKDLKRGFVASNSKDDPAKEAANFTSQVIIMNHPGQIGNGYAPVLDCHTSHIAVKFAELLTKIDRRSGKEIEKEPKFLKNGDAGMVKMVPTKPMVVETFSEYPPLGRFAVRDMRQTVAVGVIKSVEKKDPTGAKVTKAAQKKK

SEQ ID NO: 4185 - protein, 445 aa, Pennisetum glaucum
KEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4186 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDNISEPKRPSDKPLRLPLQDVYKIGGIGTVPVGRVETGVIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDPTGAKVTKSAVKKK

SEQ ID NO: 4187 - protein, 200 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKLPLFLSLDSRETT

SEQ ID NO: 4188 - protein, 447 aa, Glycine max
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4189 - protein, 447 aa, Saccharum officinarum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4190 - protein, 447 aa, Saccharum officinarum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4191 - protein, 447 aa, Panicum virgatum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4192 - protein, 447 aa, Malus domestica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDLINEPKRPSDKPLRLPLQDVYKIGGIGTVPVGRVETGVVKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVEKKEPTGAKVTKAAAKKK

SEQ ID NO: 4193 - protein, 447 aa, Musa acuminata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLDALDMIQEPKRPSDKPLRLPLQDVYKIGGIGTVPVGRVETGTLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGFVKMVPTKPMVVETFSTYPPLGRFAVRDMRQTVAVGVIKSVEKKDPTGAKVTKAAQKKK

SEQ ID NO: 4194 - protein, 447 aa, Citrus clementina
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKVPFVPISGFEGDNMIERSTNLDWYKGPTLLDALDNINEPKRPSDKPLRLPLQDVYKIGGIGTVPVGRVETGVLKPGMVVTFGPSGLTTEVKSVEMHHEALQEALPGDNVGFNVKNVAVKDLKRGFVASNSKDDPAREAANFTSQVIIMNHPGQIGNGYAPVLDCHTSHIAVKFSELVTKIDRRSGKELEKEPKFLKNGDAGMVKMIPTKPMVVETFSDYPPLGRFAVRDMRQTVAVGVIKSVEKKDPTGAKVTKSAAKKK

SEQ ID NO: 4195 - protein, 447 aa, Citrus clementina
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKVPFVPISGFEGDNMIERSTNLDWYKGPTLLDALDNINEPKRPSDKPLRLPLQDVYKIGGIGTVPVGRVETGVLKPGMVVTFGPSGLTTEVKSVEMHHEALQEALPGDNVGFNVKNVAVKDLKRGFVASNSKDDPAREAANFTSQVIIMNHPGQIGNGYAPVLDCHTSHIAVKFSELVTKIDRRSGKELEKEPKFLKNGDAGMVKMIPTKPMVVETFSDYPPLGRFAVRDMRQTVAVGVIKNVEKKDPTGAKVTKSAAKKK

SEQ ID NO: 4196 - protein, 447 aa, Gossypium hirsutum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALTEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMIKMIPTKPMVVETFSEYPPLGRFAVRDMRQTVAVGVIKNVEKKDPSGAKVTKSAAKKK

SEQ ID NO: 4197 - protein, 447 aa, Vigna unguiculata
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLSFTLGVKQMICCCNKMDATTPKYSKARYDEIVKEVSSYLKKVGYNPDKIPFVPISGFEGDNMIERSTNLDWYKGPTLLEALDQITEPKRPSDKPLRLPLQDVYKIGGIGTVPVGRVETGVIKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELMTKIDRRSGKELEKEPKFLKNGDAGFVKMIPTKPMVVETFSEYPPLGRFAVRDMRQTVAVGVIKNVEKKDPTGAKVTKAAQKKK

SEQ ID NO: 4198 - protein, 447 aa, Setaria italica
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGVIKPGMLVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4199 - protein, 447 aa, Carpinus betulus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDLISEPKRPTDKPLRLPLQDVYKIGGIGTVPVGRVETGIIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTCHIAVKFAEIVTKIDRRSGKELEKEPKFLKNGDAGFVKMIPTKPMVVETFSDYPPLGRFAVRDMRQTVAVGVIKSVEKKDPTGAKLTKSAVKKK

SEQ ID NO: 4200 - protein, 447 aa, Actinidia deliciosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDLISEPKRPSDKPLRLPLQDVYKIGGIGTVPVGRVETGVIKPGMVVTFGPTGLTTEVKSVEMHHEALLEASPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDSGMVKMIPTKPMVVETFSEYPPLGRFAVRDMRQTVAVGVIKSVEKKDPTGAKVTKAALKKK

SEQ ID NO: 4201 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDIKRGYVASNSKDDPAKEAASFTSQVIIMNHPGQIGNGYAPVLDCHTSHIAVKFAELITKIDRRSGKELEKEPKFLKNGDAGMVKMIPTKPMVVETFSQYPPLGRFAVRDMRQTVAVGVIKSVEKKDPTGAKVTKAAAKKK

SEQ ID NO: 4202 - protein, 447 aa, Cucumis melo
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLISEPKRPSDKPLRLPLQDVYKIGGIGTVPVGRVETGILKPGMVVTFGPTGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGMVKMVPTKPMVVETFSSYPPLGRFAVRDMRQTVAVGVIKSVEKKDPTGAKVTKSAVKKK

SEQ ID NO: 4203 - protein, 447 aa, Quercus alba
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPSDKPLRLPLQDVYKIGGIGTVPVGRVETGIIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMVKMLPTKPMVVETFSEYPPLGRFAVRDMRQTVAVGVIKSVEKKDPSGAKVTKSAAKKK

SEQ ID NO: 4204 - protein, 171 aa, Oryza sativa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVYIDGCHHSQVLQGPLR

SEQ ID NO: 4205 - protein, 429 aa, Secale cereale
HINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPT

SEQ ID NO: 4206 - protein, 445 aa, Secale cereale
KEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKELEAAPKFLKNGDAGFVKMVPTKPMVVETFAQYPPLGRFAVRDMRQTVAVGVIKSVEKKEPTGAKVTKAAIKKK

SEQ ID NO: 4207 - protein, 447 aa, Sorghum bicolor
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4208 - protein, 447 aa, Camellia sinensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDMISEPKRPSDKPLRLPLQDVYKIGGIGTVPVGRVETGLIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVEKKDPSGAKVTKAAQKKK

SEQ ID NO: 4209 - protein, 447 aa, Nicotiana tabacum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASNFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKNVDKKDPTGAKVTKAAQKKK

SEQ ID NO: 4210 - protein, 443 aa, Trigonella foenum-graecum
KVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPTGAKVTKAAAKKK

SEQ ID NO: 4211 - protein, 101 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKT

SEQ ID NO: 4212 - protein, 271 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDCTGPTCLSADQINEPKTALRQAPSDFPLRMSTRLVALELCQWGVLRLVSSSQVWLSPLALLA

SEQ ID NO: 4213 - protein, 449 aa, Gossypium hirsutum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHESLPEALPGDNVGFNVKNVAVKDLKRGYVASNSKDDPAKEAANFTSQVIIMNHPGQIGNGYAPVLDCHTSHIAVKFAELVTKIDRRSGKELEKEPKFLKNGDAGFVKMIPTKPMVVETFSEYPPLGRFAVRDMRQTVAVGVIKSVEKKDPTGAKVTKSAAKKGGK

SEQ ID NO: 4214 - protein, 449 aa, Cajanus cajan
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGTLKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGFVKMIPTKPMVVETFSEYPPLGRFAVRDMRQTVAVGVIKSVEKKEPSGAKVTKAAQKKGGK

SEQ ID NO: 4215 - protein, 293 aa, Malus domestica
MDATTPKYSKARYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEAMLEALPGDNVGFNVKNVAVKDLKRGYVASNSKDDPAKEAANFTSQVIIMNHPGQIGQGYAPVLDCHTSHIAVKFAELVTKIDRRSGKELEKEPKFLKNGDAGFVKMIPTKPMVVETFSEYPPLGRFAVRDMRQTVAVGVIKSVEKKDPTGAKITKAAAKKK

SEQ ID NO: 4216 - protein, 259 aa, Cynodon dactylon
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYRAQHCLRLLTRSTSPRGPRTSPCVSPFRMCTRLVVLVLSLSVVLRLVS

SEQ ID NO: 4217 - protein, 147 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGLRLVSQRMVRLVSTLFLLSPLVSSR

SEQ ID NO: 4218 - protein, 207 aa, Papaver somniferum
MFTRLEVLELCQLDVLKLESSSLVWLYLWTTGLTTEVKSVEMHHEALLEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDPTGAKVTKSAVKKK

SEQ ID NO: 4219 - protein, 447 aa, Nicotiana benthamiana
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPTGLTTEVKSVEMHHEALLEALPGDNVGFNVKNVAVKDLKRGYVASNSKDDPAKGAASFTSQVIIMNHPGQIGNGYAPVLDCHTSHIAVKFAEILTKIDRRSGKELEKEPKFLKNGDAGMVKMMPTKPMVVETFAEYPPLGRFAVRDMRQTVAVGVIKSVDKKDPTGAKVTKAAQKKK

SEQ ID NO: 4220 - protein, 447 aa, Panicum virgatum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4221 - protein, 447 aa, Panicum virgatum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKISFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4222 - protein, 447 aa, Amorphophallus konjac
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPTDKPLRLPLQDVYKIGGIGTVPVGRVETGVLKPGMVVTFGPTGLTTEVKSVEMHHEALPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKAVEKKDPSGAKVTKAAQKKK

SEQ ID NO: 4223 - protein, 447 aa, Aristolochia fimbriata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSATKKK

SEQ ID NO: 4224 - protein, 447 aa, Cannabis sativa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNINEPKRPTDKPLRLPLQDVYKIGGIGTVPVGRVETGVIKPGMVITFGPTGLTTEVKSVEMHHEALLEALPGDNVGFNVKNVAVKDLKRGFVASNSKDDPAKEAANFTSQVIIMNHPGQIGNGYAPVLDCHTSHIAVKFAELQTKIDRRSGKELEKEPKFLKNGDAGIIKMVPTKPMVVETFSEYPPLGRFAVRDMRQTVAVGVIKAVEKKDPSGAKVTKSAAKKK

SEQ ID NO: 4225 - protein, 447 aa, Gossypium hirsutum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALTEALPGDNVGFNVKNVAVKDLKRGFVASNSKDDPAKEAANFTSQVIIMNHPGQIENGYVPVLDCHTSHIAVKFAELLTKIDRRSGKELEKEPKFLKNGDAGMIKMIPTKPMVVETFSEYPPLVRFAVRDMRQTVAVGVIKSVEKKDPTGAKVTKSAAKKK

SEQ ID NO: 4226 - protein, 447 aa, Cynodon dactylon
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFFKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALQEALPGDNVGFNVKNVAVKDIKRGYVASNSKDDPAKEAASFTSQVIIMNHPGQIGNGYAPVLDCHTSHIAVKFAELLTKIDRRSGKELEKEPKFLKNGDAGMVKMIPTKPMVVETFSQYPPLGRFAVRDMRQTVAVGVIKSVEKKDPTGAKVTKAAAKKK

SEQ ID NO: 4227 - protein, 447 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4228 - protein, 447 aa, Euphorbia peplus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQINEPKRPSDKPLRLPLQDVYKIGGIGTVPVGRVETGVIKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGMIKMIPTKPMVVETFAEYPPLGRFAVRDMRQTVAVGVIKSVEKKDPSGAKVTKSAAKKK

SEQ ID NO: 4229 - protein, 447 aa, Zea mays
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4230 - protein, 447 aa, Quercus alba
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHEALLEALPGDNVGFNVKNVAVKDLKRGYVASNSKDDPAKEAANFSSQVIIMNHPGQIGNGYAPVLDCHTSHIAVKFAELLTKIDRRSGKELEKEPKFLKNGDSGMVKMIPTKPMVVETFSEYPPLGRFAVRDMRQTVAVGVIKSVEKKDPSGAKVTKSAAKKK

SEQ ID NO: 4231 - protein, 447 aa, Quercus alba
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPSDKPLRLPLQDVYKIGGIGTVPVGRVETGLIKPGMVVTFGPTGLTTEVKSVEMHHEALLEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMVKMLPTKPMVVETFSEYPPLGRFAVRDMRQTVAVGVIKSVEKKDPSGAKVTKSAAKKK

SEQ ID NO: 4232 - protein, 447 aa, Allium cepa
MGKEKFHISLVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSNNLDWYKGPTLLEALDQINEPKRPSDKPLRLPLQDVYKIGGIGTVPVGRVETGVIKPGMLVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAEILTKIDRRSGKEIEKEPKFLKNGDAGMVKMIPTKPMVVETFSEYPPLGRFAVRDMRQTVAVGVIKSVEKKDPTGAKVTKAAAKKK

SEQ ID NO: 4233 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLDALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDPTGAKVTKSAVKKK

SEQ ID NO: 4234 - protein, 447 aa, Prunus persica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDLINEPKRPSDKPLRLPLQDVYKIGGIGTVPVGRVETGVVKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKEIEKEPKFLKNGDAGMVKMIPTKPMVVETFSEYPPLGRFAVRDMRQTVAVGVIKSVEKKDPTGAKVTKAAAKKK

SEQ ID NO: 4235 - protein, 447 aa, Rosa hybrid cultivar
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFGEILTKIDRRSGKEIEKEPKFLKNGDAGMVKMLPTKPMVVETFSEYPPLGRFAVRDMRQTVAVGVIKSVEKKDPSGAKVTKSAAKKK

SEQ ID NO: 4236 - protein, 447 aa, Silene vulgaris
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCLNKMDATTPKYSKSRYEEIVKEVSSYLKKVGYNPDKVPFVPISGFEGDNMIERSTNLDWYKGPTLLEALDQVSEPKRPSDKPLRLPLQDVYKIGGIGTVPVGRVETGVIRPGMLVTFGPTGLTTEVKSVEMHHESMPEALPGDNVGFNVKNVAVKDLKRGFVASDSKNDPAKEAANFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKNVEKKDPTGAKVTKAALKKK

SEQ ID NO: 4237 - protein, 447 aa, Silene vulgaris
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCLNKMDATTPKYSKSRYEEIVKEVSSYLKKVGYNPDKVPFVPISGFEGDNMIERSTNLDWYKGPTLLEALDQVSEPKRPSDKPLRLPLQDVYKIGGIGTVPVGRVETGVIRPGMLVTFGPTGLTTEVKSVEMHHESMPEALPGDNVGFNVKNVAVKDLKRGFVASDSKNDPAKEAANFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAALKKK

SEQ ID NO: 4238 - protein, 447 aa, Nicotiana tabacum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGAASFTSQVIIMNHPGQIGNGYAPVLDCHTSHIAVKFAEILTKIDRRSGKEIEKEPKFLKNGDAGMVKMIPTKPMVVETFSEYPPLGRFAVRDMRQTVAVGVIKNVDKKDPTGAKVTKAAQKKK

SEQ ID NO: 4239 - protein, 441 aa, Trigonella foenum-graecum
HINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPTGAKVTKAAAKKK

SEQ ID NO: 4240 - protein, 272 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGVIVTFGPTV

SEQ ID NO: 4241 - protein, 101 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPDIVISLRT

SEQ ID NO: 4242 - protein, 184 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKRLVQP

SEQ ID NO: 4243 - protein, 200 aa, Amorphophallus konjac
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKWGTTLIRSHSSRSPDLRATT

SEQ ID NO: 4244 - protein, 334 aa, Amsonia hubrichtii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQISEPKRPSDKPLRLPLQDVYKIGGIGTVPVGRVETGVLKPGMVVTFGPTGLTTEVKSVEMHHESLLEAHPGDNVGFNVKNVAVKDLKRGFVASNSKDDPAKELLASPHRSSS

SEQ ID NO: 4245 - protein, 349 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALSEALPGDNVGFNVKNVAVKDLKRGFVASNSKDDPAKEAASFTSQVIIMNHPGQIGKRICPSP

SEQ ID NO: 4246 - protein, 272 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTSDHLG

SEQ ID NO: 4247 - protein, 230 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINETKKTL

SEQ ID NO: 4248 - protein, 155 aa, Setaria italica
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKV

SEQ ID NO: 4249 - protein, 284 aa, Setaria italica
MVHLNRLHLSSQASWTKGDKHTRLDDTGLNTANRDGSNTTNLVHILKGKTQGLVRRPLGLVDLVKSLKQGWALVPVKVGGPLNHVVTLKTGDGDEGNLVRVVTHLLQVGGDFLHNLIITGLGVLGSGTYLIAAADHLLHSKSESKESMLTGLAILGDTSLKTTSGGVNDKDSTVCLGGTGNHVLDEVTVSRGVNDGAVVLGGLELPQGNINGDTPLTLSLELVKHPRILEGPLVHLSGLLLEPLDHTLVDTSKLVDQVAGGGRLARVDVANDHDVDVGLLLTHG

SEQ ID NO: 4250 - protein, 167 aa, Plantago ovata
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKILQAQI

SEQ ID NO: 4251 - protein, 108 aa, Papaver somniferum
MGKEKVHINIVVIGHVDSGKSTTTGHLIYKLGGIDKRVIERFEKEAAEMNKRSFKYAWVLTSLRLNVSVVLPLILPCGSLRPPSTTAQLLMLLDIVTYQKHDYWYFSG

SEQ ID NO: 4252 - protein, 200 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKLPLFLSLDSREIT

SEQ ID NO: 4253 - protein, 183 aa, Silene vulgaris
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCLNKMDATTPKYSKSRYEEIVKEVSSYLKKVGY

SEQ ID NO: 4254 - protein, 447 aa, Phaseolus vulgaris
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLSFTLGVKQMICCCNKMDATTPKYSKARYDEIVKEVSSYLKKVGYNPDKIPFVPISGFEGDNMIERSTNLDWYKGPTLLDALDQISEPKRPSDKPLRLPLQDVYKIGGIGTVPVGRVETGVIKPGMVVTFAPSGLTTEVKSVEMHHEALTEALPGDNVGFNVKNVAVKDLKRGYVASNSKDDPAKEAANFTSQVIIMNHPGQIGNGYAPVLDCHTSHIAVKFAELMTKIDRRSGKELEKEPKFLKNGDAGFVKMIPTKPMVVETFSEYPPLGRFAVRDMRQTVAVGVIKSVEKKDPTGAKVTKAAQKKK

SEQ ID NO: 4255 - protein, 447 aa, Nicotiana benthamiana
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASSFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKNVDKKDPTGAKVTKAAQKKK

SEQ ID NO: 4256 - protein, 447 aa, Nicotiana benthamiana
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASSFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKNVDKKDPTGAKVTKAAQKKK

SEQ ID NO: 4257 - protein, 447 aa, Prunus mume
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDLINEPKRPSDKPLRLPLQDVYKIGGIGTVPVGRVETGVVKPGMVVTFGPTGLTTEVKSVEMHHEALQEAFPGDNVGFNVKNVAVKDLKRGFVASNSKDDPAKEAANFTSQVIIMNHPGQIGNGYAPVLDCHTSHIAVKFSEILTKIDRRSGKEIEKEPKFLKNGDAGMVKMIPTKPMVVETFSEYPPLGRFAVRDMRQTVAVGVIKSVEKKDPTGAKVTKAAAKKK

SEQ ID NO: 4258 - protein, 447 aa, Aristolochia fimbriata
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLINEPKRPSDKPLRLPLQDVYKIGGIGTVPVGRVETGVLKPGMVVTFAPSGLTTEVKSVEMHHEALQEALPGDNVGFNVKNVAVKDLKRGFVASNSKDDPAKEAANFTSQVIIMNHPGQIGNGYAPVLDCHTSHIAVKFSELLTKIDRRSGKEIEKEPKFLKNGDAGMVKMIPTKPMVVETFSEYPPLGRFAVRDMRQTVAVGVIKSVEKKDPTGAKVTKSAAKKK

SEQ ID NO: 4259 - protein, 447 aa, Chelidonium majus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPTDKPLRLPLQDVYKIGGIGTVPVGRVETGLIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGIIKMIPTKPMVVETFSEYPPLGRFAVRDMRQTVAVGVIKSVEKKDPSGAKVTKSAAKKK

SEQ ID NO: 4260 - protein, 447 aa, Unknown
  Sequence found in Organisms: Gossypium hirsutum, Gossypium raimondii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALSEALPGDNVGFNVKNVAVKDLKRGFVASNSKDDPAKEAASFTSQVIIMNHPGQIGNGYAPVLDCHTSHIAVKFSELLTKIDRRSGKELEKEPKFLKNGDAGMIKMVPTKPMVVETFSEYPPLGRFAVRDMRQTVAVGVIKSVEKKDPTGAKVTKSAAKKK

SEQ ID NO: 4261 - protein, 447 aa, Solanum melongena
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVEKKDPTGAKVTKAAQKKK

SEQ ID NO: 4262 - protein, 447 aa, Solanum melongena
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGIIKPGMVVTFGPTGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVVKNVEKKDPTGAKVTKAAQKKK

SEQ ID NO: 4263 - protein, 447 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGWTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4264 - protein, 447 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLDALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4265 - protein, 447 aa, Eschscholzia californica
MGKEKIHISIVVIGHVDSGKSTTTGHLIYKLGGIDKRVIERFEKEAAEMNKRSFKYAWALDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4266 - protein, 447 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLNWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4267 - protein, 449 aa, Gossypium raimondii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHESLPEALPGDNVGFNVKNVAVKDLKRGYVASNSKDDPAKEAANFTSQVIIMNHPGQIGNGYAPVLDCHTSHIAVKFAELVTKIDRRSGKELEKEPKFLKNGDAGFVKMIPTKPMVVETFSEYPPLGRFAVRDMRQTVAVGVIKSVEKKDPSGAKVTKSAAKKGGK

SEQ ID NO: 4268 - protein, 447 aa, Vitis vinifera
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDMINEPKRPTDKPLRLPLQDVYKIGGIGTVPVGRVETGVLKPGMVVTFGPSGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4269 - protein, 447 aa, Momordica charantia
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDLITEPKRPSDKPLRLPLQDVYKIGGIGTVPVGRVETGVLKPGMVVTFGPTGLTTEVKSVEMHHESLPEALPGDNVGFNVKNVAVKDIKRGFVASNSKDDPAKEAANFTSQVIIMNHPGQIGNGYAPVLDCHTSHIAVKFAEILTKIDRRSGKELEKEPKFLKNGDAGMVKMIPTKPMVVETFSQYPPLGRFAVRDMRQTVAVGVIKSVEKKDPTGAKVTKSAAKKK

SEQ ID NO: 4270 - protein, 447 aa, Tropaeolum majus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDLINEPKRPSDKPLRLPLQDVYKIGGIGTVPVGRVETGVIKPGMVITFGPTGLTTEVKSVEMHHEALQEALPGDNVGFNVKNVAVKDLKRGFVASNSKDDPAKEAANFTSQVIIMNHPGQIGNGYAPVLDCHTSHIAVKFGEILTKIDRRSGKELEKEPKFLKNGDAGMVKMLPTKPMVVETFSQYPPLGRFAVRDMRQTVAVGVIKSVEKKDPSGAKVTKSAAKKK

SEQ ID NO: 4271 - protein, 447 aa, Carica papaya
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDLINEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSQYPPLGRFAVRDMRQTVAVGVIKNVEKKDPSGAKVTKSAAKKK

SEQ ID NO: 4272 - protein, 447 aa, Pisum sativum
MGKEKVHINIVVIGHVDSGKSTTTGHVIYKLGGIDKRVIERFEKEADEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLDALDNINEPKRPSDKPLRLPLQDVYKIGGIGTVPVGRVETGVVKPGMLVTFAPTGLTTEVKSVEMHHEALTEALPGDNVGFNVKNVAVKDLKRGFVASNSKDDPAKEAANFTSQVIIMNHPGQIGNGYAPVLDCHTSHIAVKFAELITKIDRRSGKEIEKEPKFLKNGDAGMVKMIPTKPMVVETFAEYPPLGRFAVRDMRQTVAVGVIKSVEKKDPTGAKVTKAAAKKK

SEQ ID NO: 4273 - protein, 447 aa, Capsicum annuum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKK

SEQ ID NO: 4274 - protein, 444 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDNISEPKRPSDKPLRLPLQDVYKIGGIGTVPVGRVETGVIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDPTGAKVTKSAV

SEQ ID NO: 4275 - protein, 447 aa, Rosa hybrid cultivar
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFGEILTKIDRRSGKELEKEPKFLKNGDAGMVKMLPTKPMVVETFSEYPPLGRFAVRDMRQTVAVGVIKNVEKKDPSGAKVTKSAAKKK

SEQ ID NO: 4276 - protein, 447 aa, Solanum phureja
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPTDKPLRLPLQDVYKIGGIGTVPVGRVETGVIKPGMVVTFGPTGLTTEVKSVEMHHEALLEALPGDNVGFNVKNVAVKDLKRGFVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKK

SEQ ID NO: 4277 - protein, 447 aa, Sorghum bicolor
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVGSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHESMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 4278 - protein, 448 aa, Glycine max
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYMKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHETLTEAHPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGLVKMIPTKPMVVETFSEYPPLGRFAVRDMRQTVAVGVIKSVEKKDPTGAKVTKAAQKKAK

SEQ ID NO: 4279 - protein, 447 aa, Vinca minor
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARFDEIVKEVSSYLKKVGYNPDKIPFVPISGFEGDNMIERSTNLDWYKGPTLLEALDLISEPKRPTDKPLRLPLQDVYKIGGIGTVPVGRVETGVLKPGTVVTFGPTGLTTEVKSVEMHHETLQEALPGDNVGFNVKNVAVKDLKRGFVASNSKDDPAKEAANFTSQVIIMNHPGQIGNGYAPVLDCHTSHIAVKFAEILVKIDRRSGKELEKEPKFLKNGDAGFVKMIPTKPMVVETFSEYPPLGRFAVRDMRQTVAVGVIKSVEKKDPTGAKVTKAAAKKK

SEQ ID NO: 4280 - protein, 447 aa, Citrullus lanatus
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDLISEPKRPSDKPLRLPLQDVYKIGGIGTVPVGRVETGILKPGMVVTFGPTGLTTEVKSVEMHHESLPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGMVKMVPTKPMVVETFSSYPPLGRFAVRDMRQTVAVGVIKSVEKKDPTGAKVTKSAVKKK

SEQ ID NO: 4281 - protein, 101 aa, Ricinus communis
MGKEKVHINIVVIGHVDSGKSTTTGHLIYKLGGIDKRVIERFEKEAAEMNKRSFKYAWVLDKLKAERERGITIDIALWKFETPSTTAPSLMHLDIVTLSRI

SEQ ID NO: 4282 - protein, 447 aa, Panicum virgatum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVASYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHESMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 4283 - protein, 447 aa, Aquilegia formosa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYLKKVGYNPDKIPFVPISGFEGDNMIERSTNLDWYKGPTLLEALDQVNEPKRPSDKPLRLPLQDVYKIGGIGTVPVGRVETGVIKPGILVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAEIQTKIDRRSGKELEKEPKFLKNGDAGYVKMIPTKPMVVETFSEYPPLGRFAVRDMRQTVAVGVIKAVEKKEPTGAKVTKAAAKKK

SEQ ID NO: 4284 - protein, 447 aa, Musa acuminata
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDLIQEPKRPSDKPLRLPLQDVYKIGGIGTVPVGRVETGVLKPGIVVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAEILTKIDRRSGKELEKEPKFLKNGDAGFVKMIPTKPMVVETFAQYPPLGRFAVRDMRQTVAVGVIKSVEKKDPTGAKITKAAVKKK

SEQ ID NO: 4285 - protein, 200 aa, Fagus grandifolia
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPLSPFLVLRVTI

SEQ ID NO: 4286 - protein, 447 aa, Beta vulgaris
MGKEKIHISLVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAILIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDLINEPKRPSDKPLRLPLQDVYKIGGIGTVPVGRVETGVLKPGMLVTFGPTGLTTEVKSVEMHHESLPEALPGDNVGFNVKNVAVKDLKRGFVASDSKNDPAKEAANFTAQVIIMNHPGQIGNGYAPVLDCHTSHIAVKFAELVTKIDRRSGKEIEKEPKFLKNGDAGMVKMIPTKPMVVETFSEYPPLGRFAVRDMRQTVAVGVIKNVEKKDPTGAKVTKAALKKK

SEQ ID NO: 4287 - protein, 447 aa, Unknown
  Sequence found in Organisms: Centaurea maculosa, Cirsium arvense
MGKEKVHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVRQMICCCNKMDATTPKYSKARYDEIIKEVASYLKKVGYNPDKIPFVPISGFEGDNMIERSTNLDWYKGPTLLEALDQLNEPKRPSDKPLRLPLQDVYKIGGIGTVPVGRVETGVIKPGMVVTFGPTGLTTEVKSVEMHHEALLEALPGDNVGFNVKNVAVKDLKRGYVASNSKDDPAKGAASFTAQVIIMNHPGQIGNGYAPVLDCHTSHIAVKFAELLTKIDRRSGKELEKEPKFLKNGDAGMVKMIPTKPMVVETFAEYPPLGRFAVRDMRQTVAVGVIKSVDKKDPTGAKITKAAIKKK

SEQ ID NO: 4288 - protein, 447 aa, Chelidonium majus
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPTDKPLRLPLQDVYKIGGIGTVPVGRVETGLIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGIIKMLPTKPMVVETFAEYPPLGRFAVRDMRQTVAVGVIKSVEKKDPSGAKVTKSAAKKK

SEQ ID NO: 4289 - protein, 447 aa, Chelidonium majus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFSEYPPLGRFAVRDMRQTVAVGVIKSVEKKDPSGAKVTKSAAKKK

SEQ ID NO: 4290 - protein, 449 aa, Cleome gynandra
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPSGLTTEVKSVEMHHEALQEALPGDNVGFNVKNVAVKDLKRGYVASNSKDDPAKEAASFTSQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKNVEKKDPTGAKVTKAAAKKGAK

SEQ ID NO: 4291 - protein, 449 aa, Cleome spinosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPSGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVEKKDPTGAKVTKAAAKKGAK

SEQ ID NO: 4292 - protein, 449 aa, Cleome spinosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPSGLTTEVKSVEMHHEALQEALPGDNVGFNVKNVAVKDLKRGYVASNSKDDPAKEAASFTSQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKSVEKKDPTGAKVTKAAAKKGAK

SEQ ID NO: 4293 - protein, 447 aa, Unknown
  Sequence found in Organisms: Gossypium hirsutum, Gossypium raimondii
MGKEKVHINLVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARFDEIVKEVSSYLKKVGYNPEKIPFVPISGFEGDNMIERSTNLDWYKGPTLLEALDQITEPKRPSDKPLRLPLQDVYKIGGIGTVPVGRVETGVLKPGMVVTFGPTGLTTEVKSVEMHHESLPEAFPGDNVGFNVKNVAVKDLKRGFVASNSKDDPAKEAANFTSQVIIMNHPGQIGNGYAPVLDCHTSHIAVKFSELLTKIDRRSGKELEKEPKFLKNGDAGMVKMIPTKPMVVETFSEYPPLGRFAVRDMRQTVAVGVIKSVEKKDPTGAKVTKSAAKKK

SEQ ID NO: 4294 - protein, 447 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGSIGTVPVGRVETGVLKPGMVVTFGPSGLTTEVKSVEMHHEALSEALPGDNVGFNVKNVAVKDLKRGFVASNSKDDPAKEAASFTSQVIIMNHPGQIGNGYAPVLDCHTSHIAVKFSELLTKIDRRSGKELEKEPKFLKNGDAGMIKMVPTKPMVVETFSEYPPLGRFAVRDMRQTVAVGVIKSVEKKDPTGAKVTKSAAKKK

SEQ ID NO: 4295 - protein, 447 aa, Eucalyptus grandis
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFSELLTKIDRRSGKELEKEPKFLKNGDSGMVKMIPTKPMVVETFSEYPPLGRFAVRDMRQTVAVGVIKNVEKKDPSGAKVTKSAAKKK

SEQ ID NO: 4296 - protein, 448 aa, Euonymus alatus
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSTNLDWYKGPTLLDALDQVNEPKRPSDKPLRLPLQDVYKIGGIGTVPVGRVETGIIKPGMVVTFGPSGLTTEVKSVEMHHEALQEALPGDNVGFNVKNVAVKDLKRGFVASNSKDDPAKEAANFTAQVIIMNHPGQIGNGYAPVLDCHTSHIAVKFAELLTKIDRRSGKELEKEPKFLKNGDAGFVKMIPTKPMVVETFSEYPPLGRFAVRDMRQTVAVGVIKAVEKKDPTGAKVTKSAVKKGK

SEQ ID NO: 4297 - protein, 448 aa, Euonymus alatus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQVNEPKRPSDKPLRLPLQDVYKIGGIGTVPVGRVETGIIKPGMVVTFGPSGLTTEVKSVEMHHEALQEALPGDNVGFNVKNVAVKDLKRGFVASNSKDDPAKEAANFTAQVIIMNHPGQIGNGYAPVLDCHTSHIAVKFAELLTKIDRRSGKELEKEPKFLKNGDAGFVKMIPTKPMVVETFSEYPPLGRFAVRDMRQTVAVGVIKAVEKKDPTGAKVTKSAVKKGK

SEQ ID NO: 4298 - protein, 449 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4299 - protein, 449 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4300 - protein, 449 aa, Gerbera hybrid cultivar
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAANFTSQVIIMNHPGQIGNGYAPVLDCHTSHIAVKFSELLTKIDRRSGKELEKEPKFLKNGDAGMVKMIPTKPMVVETFAEYPPLGRFAVRDMRQTVAVGVIKSVDKKDPTGAKVTKAAVKKGAK

SEQ ID NO: 4301 - protein, 447 aa, Carpinus betulus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDLLSEPKRPSDKPLRLPLQDVYKIGGIGTVPVGRVETGIIKPGMVVTFGPTGLTTEVKSVEMHHEALLEALPGDNVGFNVKNVAVKDLKRGYVASNSKDDPAKEAANFTSQVIIMNHPGQIGNGYAPVLDCHTCHIAVKFAELVTKIDRRSGKEIEKEPKFLKNGDAGIVKMIPTKPMVVETFSEYPPLGRFAVRDMRQTVAVGVIKSVEKKDPSGAKVTKSAAKKK

SEQ ID NO: 4302 - protein, 448 aa, Medicago truncatula
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKAVEKKDPSGGLKQTKSALKKK

SEQ ID NO: 4303 - protein, 448 aa, Medicago truncatula
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYMKKVGYNPDKIPFVPISGFEGDNMIERSTNLDWYKGPTLLEALDQINEPKRPSDKPLRLPLQDVYKIGGIGTVPVGRVETGVIKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPSGGLKQTKSAAKKK

SEQ ID NO: 4304 - protein, 155 aa, Cajanus cajan
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKV

SEQ ID NO: 4305 - protein, 449 aa, Plantago ovata
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPDKIAFVPISGFEGDNMIERSTNLDWYKGPTLLEALDNISEPKRPSDKPLRLPLQDVYKIGGIGTVPVGRVETGVIKPGMVVTFGPTGLTTEVKSVEMHHESMPEALPGDNVGFNVKNVAVKDLKRGYVASNSKDDPAKEAANFTSQVIIMNHPGQIGQGYAPVLDCHTSHIAVKFAELVTKIDRRSGKELEKEPKFLKNGDAGMVKMIPTKPMVVETFAEYPPLGRFAVRDMRQTVAVGVIKNVEKKDPSGAKVTKAAAKKGAK

SEQ ID NO: 4306 - protein, 447 aa, Platanus occidentalis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDLILEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFSEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4307 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIAFVPISGFEGDNMIERSTNLDWYKGPTLLEALDNISEPKRPTDKPLRLPLQDVYKIGGIGTVPVGRVETGFIKPGMVITFGPTGLTTEVKSVEMHHEALLEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGIIKMIPTKPMVVETFSEYPPLGRFAVRDMRQTVAVGVIKAVEKKDPTGAKVTKSAVKKK

SEQ ID NO: 4308 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPTGAKVTKSAVKKK

SEQ ID NO: 4309 - protein, 318 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDNISEPKRPSDKPLRLPLQDVYKIGGIGTVPVGRVETGVIKPGMVVTFGPTGLTTEVKSVEMHHEALLEALPGDNVGFNVKNVAVRISAWFRRLQLKG

SEQ ID NO: 4310 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPSGAKVTKSAIKKK

SEQ ID NO: 4311 - protein, 426 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVI

SEQ ID NO: 4312 - protein, 88 aa, Secale cereale
IVVDWPMSTLAKSTTTGHLIYKLGGIDKRVIERFEKEAAEMNKRSFKYAWVLDKLKAERERGITIDIALWKFETTKYYCTVIDCPWSP

SEQ ID NO: 4313 - protein, 447 aa, Silene vulgaris
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCLNKMDATTPKYSKSRYEEIVKEVSSYLKKVGYNPDKVPFVPISGFEGDNMIDRSTNLDWYKGPTLLEALDQVSEPKRPSDKPLRLPLQDVYKIGGIGTVPVGRVETGIIRPGMLVTFGPTGLTTEVKSVEMHHESMPEALPGDNVGFNVKNVAVKDLKRGFVASDSKNDPAKEAANFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKNVEKKDPTGAKVTKAALKKK

SEQ ID NO: 4314 - protein, 445 aa, Silene vulgaris
KEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCLNKMDATTPKYSKSRYEEIVKEVSSYLKKVGYNPDKVPFVPISGFEGDNMIERSTNLDWYKGPTLLEALDQVSEPKRPSDKPLRLPLQDVYKIGGIGTVPVGRVETGVIRPGMLVTFGPTGLTTEVKSVEMHHESMPEALPGDNVGFNVKNVAVKDLKRGFVASDSKNDPAKEAANFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKNVEKKDPTGAKVTKAALKKK

SEQ ID NO: 4315 - protein, 447 aa, Solanum phureja
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQLNEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKGAASFTAQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDPSGAKVTKAAQKKK

SEQ ID NO: 4316 - protein, 447 aa, Glycine max
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLSFTLGVKQMICCCNKMDATTPKYSKARYDEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGMVVTFAPTGLTTEVKSVEMHHEALTEALPGDNVGFNVKNVAVKDLKRGYVASNSKDDPAKEAANFTAQVIIMNHPGQIGNGYAPVLDCHTSHIAVKFAELMTKIDRRSGKELEKEPKFLKNGDAGFVKMIPTKPMVVETFSEYPPLGRFAVRDMRQTVAVGVIKNVEKKDPTGAKVTKAAQKKK

SEQ ID NO: 4317 - protein, 447 aa, Glycine max
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLSFTLGVKQMICCCNKMDATTPKYSKARYDEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGMVVTFAPTGLTTEVKSVEMHHESLTEAHPGDNVGFNVKNVAVKDLKRGYVASNSKDDPAKEAANFTAQVIIMNHPGQIGNGYAPVLDCHTSHIAVKFAELMTKIDRRSGKELEKEPKFLKNGDAGFVKMIPTKPMVVETFSEYPPLGRFAVRDMRQTVAVGVIKNVEKKDPTGAKVTKAAQKKK

SEQ ID NO: 4318 - protein, 447 aa, Saccharum officinarum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVGSYLKKVGYNPDKIPFAPISGFEGDNMIERSTNLDWYKGPTLLEALDQINEPKRPSDKPLRLPLQDVYKIGGIGTVPVGRVETGLIKPGMVVTFGPTGLTTEVKSVEMHHESMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAGKKK

SEQ ID NO: 4319 - protein, 447 aa, Solanum lycopersicum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQLNEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKK

SEQ ID NO: 4320 - protein, 430 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNFMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 4321 - protein, 449 aa, Ricinus communis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAAKKGGK

SEQ ID NO: 4322 - protein, 449 aa, Populus trichocarpa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQIQEPKRPSDKPLRLPLQDVYKIGGIGTVPVGRVETGVIKPGMVVTFGPTGLSTEVKSVEMHHEALLEALPGDNVGFNVKNVAVKDLKRGFVASNSKDDPAREAANFTSQVIIMNHPGQIGNGYAPVLDCHTCHIAVKFAEILTKIDRRSGKELEKEPKFLKNGDAGMIKMIPTKPMVVETFSAYPPLGRFAVRDMRQTVAVGVIKSVEKKDPSGAKVTKSAAKKGAK

SEQ ID NO: 4323 - protein, 447 aa, Panicum virgatum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVASYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHESMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 4324 - protein, 447 aa, Amborella trichopoda
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYIKKVGYNPDKIPFVPISGFEGDNMIERSTNLDWYKGPTLLEALDLIVEPKRPSDKPLRLPLQDVYKIGGIGTVPVGRVETGLLKPGMVVTFAPTGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAVKKK

SEQ ID NO: 4325 - protein, 447 aa, Malus domestica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVRQMICCCNKMDATTPKYSRARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEAMQEALPGDNVGFNVKNVAVKDLKRGYVASNSKDDPAKEAANFIAQVIIMNHPGQIGQGYAPVLDCHTSHIAVKFAELVTKIDRRSGKELEKEPKFLKNGDAGFVKMLPTKPMVVETFSEYPPLGRFAVRDMRQTVAVGVIKSVEKKDPTGAKITKAAAKKK

SEQ ID NO: 4326 - protein, 447 aa, Malus domestica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDLINEPKRPSDKPLRLPLQDVYKIGGIGTVPVGRVETGIVKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFGEILTKIDRRSGKEIEKEPKFLKNGDAGMVKMLPTKPMVVETFSEYPPLGRFAVRDMRQTVAVGVIKSVEKKDPSGAKVTKSAAKKK

SEQ ID NO: 4327 - protein, 447 aa, Artemisia annua
MGKEKTHISLVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYIKKVGYNPDKVPFVPISGFEGDNMIERSSNLDWYKGPTLLEALDNISEPKRPSDKPLRLPLQDVYKIGGIGTVPVGRVETGVIKPGMVVTFGPTGLTTEVKSVEMHHESLQEALPGDNVGFNVKNVAVKDLKRGYVASNSKDDPAKGAASFTSQVIIMNHPGQIGNGYAPVLDCHTSHIAVKFAELMTKIDRRSGKEIEKEPKFLKNGDAGIVKMIPTKPMVVETFSEYPPLGRFAVRDMRQTVAVGVIKSVDKKDPTGAKITKAAAKKK

SEQ ID NO: 4328 - protein, 447 aa, Musa acuminata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIIKEVSSYLKKVGYNPEKIPFVPISGFEGDNMIERSTNLDWYKGPTLLEALDLIQEPKRPLDKPLRLPLQDVYKIGGIGTVPVGRVETGILKPGMVVTFGPTGLTTEVKSVEMHHEALQEAFPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGLVKMIPTKPMVVETFAEYSPLGRFAVRDMRQTVAVGVIKSVEKKDPTGAKVTKAAQKKK

SEQ ID NO: 4329 - protein, 447 aa, Musa acuminata
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMIQEPKRPSDKPLRLPLQDVYKIGGIGTVPVGRVETGILKPGMVVSFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPSKPMVVETFAAYPPLGRFAVRDMRQTVAVGVIKSVEKKDPTGAKITKAAAKKK

SEQ ID NO: 4330 - protein, 447 aa, Musa acuminata
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPSDKPLRLPLQDVYKIGGIGTVPVGRVETGILKPGMVVTFGPTGLTTEIKSVEMHHEALQEALPGDNVGFNVKNVAVKDLKRGFVASNSKEDPAKEAANFTSQVIIMNHPGQIGNGYAPVLDCHTSHIAVKFAEILTKIDRRSGKELEKEPKFLKNGDAGFVKMIPTKPMVVETFSQYPPLGRFAVRDMRQTVAVGVIKSVEKKDPTGAKITKAAAKKK

SEQ ID NO: 4331 - protein, 448 aa, Fagus grandifolia
MGKEKVHINIVVIGHVDSGKSTTTGHLIYKLGGIDKRVIEKFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDSISEPKRPSDKPLRLPLQDVYKIGGIGTVPVGRVETGVIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGIVKMIPTKPMVVETFSEYPPLGRFAVRDMRQTVAVGVVKGVEKKDPSGAKVTKSAVKKGK

SEQ ID NO: 4332 - protein, 447 aa, Fagus grandifolia
MGKEKVHINIVVIGHVDSGKSTTTGHLIYKLGGIDKRVIEKFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDSISEPKRPSDKPLRLPLQDVYKIGGIGTVPVGRVETGVIKPGMVVTFGPTGLTTEVKSVEMHHEALLEALPGDNVGFNVKNVAVKDIKRGFVASNSKDDPAKEAANFTSQVIIMNHPGQIGNGYAPVLDCHTSHIAVKFSEILTKIDRRSGKELEKEPKFLKNGDAGIVKMIPTKPMVVETFSEYPPLGRFAVRDMRQTVAVGVVKSVEKKDPSGAKVTKSAAKKK

SEQ ID NO: 4333 - protein, 447 aa, Fagus grandifolia
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDLIVEPKRPTDKPLRLPLQDVYKIGGIGTVPVGRVETGIIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGFVKMIPSKPMVVETFSEYPPLGRFAVRDMRQTVAVGVIKSVEKKDPSGAKVTKSAVKKK

SEQ ID NO: 4334 - protein, 447 aa, Beta vulgaris
MGKEKIHISLVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAILIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDLINEPKRPSDKPLRLPLQDVYKIGGIGTVPVGRVETGVLKPGMLVTFGPTGLTTEVKSVEMHHESLPEALPGDNVGFNVKNVAVKDLKRGFVASDSKNDPAKEAANFIAQVIIMNHPGQIGNGYAPVLDCHTSHIAVKFAELVTKIDRRSGKEIEKEPKFLKNGDAGMVKMIPTKPMVVETFSEYPPLGRFAVRDMRQTVAVGVIKNVEKKDPTGAKVTKAALKKK

SEQ ID NO: 4335 - protein, 447 aa, Vaccinium corymbosum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMISEPKRPSDKPLRLPLQDVYKIGGIGTVPVGRVETGVVKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKEIEKEPKFLKNGDAGMVKMIPTKPMVVETFSEYPPLGRFAVRDMRQTVAVGVIKSVEKKDPSGAKVTKSAAKKK

SEQ ID NO: 4336 - protein, 447 aa, Vaccinium corymbosum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMISEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKEIEKEPKFLKNGDAGMVKMIPTKPMVVETFSEYPPLGRFAVRDMRQTVAVGVIKSVEKKDPSGAKVTKSAAKKK

SEQ ID NO: 4337 - protein, 447 aa, Vaccinium corymbosum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLISEPKRPSDKPLRLPLQDVYKIGGIGTVPVGRVETGVVKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFSEILTKIDRRSGKEIEKEPKFLKNGDAGMVKMIPTKPMVVETFSEYPPLGRFAVRDMRQTVAVGVIKSVEKKDPSGAKVTKSAAKKK

SEQ ID NO: 4338 - protein, 449 aa, Theobroma cacao
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTCHIAVKFAELLTKIDRRSGKELEKEPKFLKNGDAGMVKMVPTKPMVVETFSAYPPLGRFAVRDMRQTVAVGVIKNVEKKDPSGAKVTKSAAKKGGK

SEQ ID NO: 4339 - protein, 447 aa, Cannabis sativa
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDNLSEPKRPSDKPLRLPLQDVYKIGGIGTVPVGRVETGVIKPGMVVTFAPTGLTTEVKSVEMHHEALLEALPGDNVGFNVKNVAVKDLKRGYVASNSKDDPAKEAANFTAQVIIMNHPGQIGNGYAPVLDCHTSHIAVKFSEILTKIDRRSGKELEKEPKFLKNGDAGMVKMVPTKPMVVETFAEYPPLGRFAVRDMRQTVAVGVIKSVEKKDPSGAKVTKSAAKKK

SEQ ID NO: 4340 - protein, 447 aa, Cirsium arvense
MGKEKVHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVRQMICCCNKMDATTPKYSKARYDEIIKEVSSYLKKVGYNPDKIPFVPISGFEGDNMIERSINLDWYKGPTLLEALDQLNEPKRPSDKPLRLPLQDVYKIGGIGTVPVGRVETGVIKPGMVVTFGPTGLTTEVKSVEMHHEALLEALPGDNVGFNVKNVAVKDLKRGYVASNSKDDPAKGAASFTAQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKSVDKKDPTGAKITKAAIKKK

SEQ ID NO: 4341 - protein, 447 aa, Unknown
  Sequence found in Organisms: Gossypium hirsutum, Gossypium raimondii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHEALSEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGLIKMVPTKPMVVETFSEYPPLGRFAVRDMRQTVAVGVIKNVEKKDPTGAKVTKSAAKKK

SEQ ID NO: 4342 - protein, 448 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMVPTKPMVVETFSEYPPLGRFAVRDMRQTVAVGVIKSVEKKDPTGAKVTKSAAKKGK

SEQ ID NO: 4343 - protein, 448 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMVPTKPMVVETFSAYPPLGRFAVRDMRQTVAVGVIKSVEKKDPTGAKVTKSAAKKGK

SEQ ID NO: 4344 - protein, 447 aa, Eucalyptus grandis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQISEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAASFASQVIIMNHPGQIGNGYAPVLDCHTSHIAVKFSELLTKIDRRSGKELEKEPKFLKNGDAGMVKMIPTKPMVVETFSEYPPLGRFAVRDMRQTVAVGVIKSVEKKDPTGAKVTKSAVKKK

SEQ ID NO: 4345 - protein, 448 aa, Eucalyptus grandis
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFSELVTKIDRRSGKEIEKEPKFLKNGDAGMVKMIPTKPMVVETFSEYPPLGRFAVRDMRQTVAVGVIKSVEKKDPSGAKVTKSAAKKGK

SEQ ID NO: 4346 - protein, 449 aa, Eucalyptus grandis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAELVTKIDRRSGKELEKEPKFLKNGDSGMVKMIPTKPMVVETFSEYPPLGRFAVRDMRQTVAVGVIKNVEKKDPSGAKVTKSAAKKGGK

SEQ ID NO: 4347 - protein, 449 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4348 - protein, 449 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFSEYPPLGRFAVRDMRQTVAVGVIKSVEKKDPTGAKVTKAAVKKGAK

SEQ ID NO: 4349 - protein, 449 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPPQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4350 - protein, 448 aa, Gossypium raimondii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMVPTKPMVVETFSEYPPLGRFAVRDMRQTVAVGVIKSVEKKDPTGAKVTKSAAKKGK

SEQ ID NO: 4351 - protein, 447 aa, Vitis vinifera
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDMVQEPKRPSDKPLRLPLQDVYKIGGIGTVPVGRVETGILKPGMVVTFGPTGLTTEVKSVEMHHESLVEALPGDNVGFNVKNVAVKDLKRGFVASNSKDDPAKEAANFISQVIIMNHPGQIGNGYAPVLDCHTSHIAVKFAEIMTKIDRRSGKELEKEPKFLKNGDAGLVKMIPTKPMVVETFSEYPPLGRFAVRDMRQTVAVGVIKNVEKKDPSGAKVTKSAAKKK

SEQ ID NO: 4352 - protein, 447 aa, Humulus lupulus
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDNLSEPKRPSDKPLRLPLQDVYKIGGIGTVPVGRVETGVIKPGMVVTFAPTGLTTEVKSVEMHHEALLEALPGDNVGFNVKNVAVKDLKRGYVASNSKDDPAKEAANFTAQVIIMNHPGQIGNGYAPVLDCHTCHIAVKFAEILTKIDRRSGKELEKEPKFLKNGDAGMVKMVPTKPMVVETFAEYPPLGRFAVRDMRQTVAVGVIKNVEKKDPSGAKVTKSAAKKK

SEQ ID NO: 4353 - protein, 447 aa, Lactuca sativa
MGKEKVHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPEKIPFVPISGFEGDNMIERSTNLDWYKGPTLLEALDQLNEPKRPSDKPLRLPLQDVYKIGGIGTVPVGRVETGVIKPGMVVTFGPTGLTTEVKSVEMHHEALVEALPGDNVGFNVKNVAVKDLKRGYVASNSKDDPAKGAANFTAQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKSVDKKDPTGAKITKAAAKKK

SEQ ID NO: 4354 - protein, 447 aa, Lotus japonicus
MGKEKFHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGVLVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKEIEKEPKFLKNGDAGFVKMIPTKPMVVETFSEYPPLGRFAVRDMRQTVAVGVIKSVEKKDPSGAKVTKAALKKK

SEQ ID NO: 4355 - protein, 447 aa, Momordica charantia
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLISEPKRPSDKPLRLPLQDVYKIGGIGTVPVGRVETGILKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGMVKMVPTKPMVVETFSEYPPLGRFAVRDMRQTVAVGVIKNVEKKDPSGAKVTKSAAKKK

SEQ ID NO: 4356 - protein, 449 aa, Lippia dulcis
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQISEPKRPSDKPLRLPLQDVYKIGGIGTVPVGRVETGVIKPGMVVTFGPSGLTTEVKSVEMHHEAMQEALPGDNVGFNVKNVAVKDLKRGYVASNSKDDPAKEAANFTSQVIIMNHPGQIGNGYAPVLDCHTSHIAVKFQELLTKIDRRSGKELEKEPKFLKNGDAGMVKMVPTKPMVVETFSEYPPLGRFAVRDMRQTVAVGVIKSVEKKDPTGAKVTKAAAKKGAK

SEQ ID NO: 4357 - protein, 449 aa, Cajanus cajan
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPRYSKARYDEIVKEVSSYMKKVGYNPDKIPFVPISGFEGDNMIERSTNLDWYKGPTLLEALDQINEPKRPSDKPLRLPLQDVYKIGGIGTVPVGRVETGIMKPGMVVTFAPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGFVKMIPSKPMVVETFSEYPPLGRFAVRDMRQTVAVGVIKSVEKKDPTGAKVTKAAQKKSGK

SEQ ID NO: 4358 - protein, 447 aa, Podocarpus macrophillus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDMINEPKRPSDKPLRLPLQDVYKIGGIGTVPVGRVETGVLKPGTVVTFGPTGLTTEVKSVEMHHESLPEALPGDNVGFNVKNVAVKDLKRGFVASDSKNDPAKEAASFTSQVIIMNHPGQIGNGYAPVLDCHTSHIAVKFAEILTKVDRRSGKELEKEPKFLKNGDAGFVKMIPTKPMVVETFSEYPPLGRFAVRDMRQTVAVGVIKSVEKKEPSGAKVTKAAAKKK

SEQ ID NO: 4359 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPSGAKVTKSAAKKK

SEQ ID NO: 4360 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIAFVPISGFEGDNMIERSTNLDWYKGPTLLEALDNISEPKRPTDKPLRLPLQDVYKIGGIGTVPVGRVETGFIKPGMVITFGPTGLTTEVKSVEMHHEALLEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGIIKMLPTKPMVVETFSEYPPLGRFAVRDMRQTVAVGVIKAVEKKDPTGAKVTKSAVKKK

SEQ ID NO: 4361 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLDALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPTGAKVTKSAVKKK

SEQ ID NO: 4362 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAGILTKIDRRSGKELEKEPKFLKNGDAGIIKMLPTKPMVVETFSQYPPLGRFAVRDMRQTVAVGVIKEVEKKDPTGAKVTKSAVKKK

SEQ ID NO: 4363 - protein, 447 aa, Primula obconica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLDALDLISEPKRPSDKPLRLPLQDIYKIGGIGTVPVGRVETGVIKPGMVVTFGPSGLTTEVKSVEMHHESLLEAHPGDNVGFNVKNVAVKDLKRGYVASNSKDDPAKEAANFTAQVIIMNHPGQIGNGYAPVLDCHTCHIAVKFSEILTKIDRRSGKELEKEPKFLKNGDAGFVKMIPTKPMVVETFSAYPPLGRFAVRDMRQTVAVGVIKSVEKKDPSGAKVTKAAQKKK

SEQ ID NO: 4364 - protein, 447 aa, Pteridium aquilinum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIMKEVSAYLKKVGYNPDKIPFVPISGFEGDNMIERSSNLDWYKGPTLLDALDMILEPKRPSDKPLRLPLQDVYKIGGIGTVPVGRVETGVIKPGMVVTFAPTGLTTEVKSVEMHHEALLEALPGDNVGFNVKNVAVKDLKRGFVASDSKNDPAKEAANFTSQVIIMNHPGQIGNGYAPVLDCHTSHIAVKFAEILTKIDRRSGKELEKEPKFLKNGDAGFVKMIPTKPMTVETFAEYPPLGRFAVRDMRQTVAVGVIKAVEKKEPTGAKVTKAAAKKK

SEQ ID NO: 4365 - protein, 448 aa, Solanum phureja
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPTDKPLRLPLQDVYKIGGIGTVPVGRVETGVIKPGMVVTFGPTGLTTEVKSVEMHHEALLEALPGDNVGFNVKNVAVKDLKRGFVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKGK

SEQ ID NO: 4366 - protein, 447 aa, Fragaria vesca
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFGEILTKIDRRSGKEIEKEPKFLKNGDSGMVKMLPTKPMVVETFSEYPPLGRFAVRDMRQTVAVGVIKNVEKKDPSGAKVTKSAAKKK

SEQ ID NO: 4367 - protein, 448 aa, Solanum lycopersicum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKGK

SEQ ID NO: 4368 - protein, 448 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPSGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPSGGLTKTKSALKKK

SEQ ID NO: 4369 - protein, 447 aa, Tripterygium wilfordii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDMINEPKRPSDKPLRLPLQDVYKIGGIGTVPVGRVETGVVKPGMVVTFGPTGLTTEVKSVEMHHEALLEALPGDNVGFNVKNVAVKDLKRGFVASDSKNDPAKGAASFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDASGAKVTKSAAKKK

SEQ ID NO: 4370 - protein, 449 aa, Utricularia gibba
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLDALDLINEPKRPSDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPTGAKVTKAAAKKGAK

SEQ ID NO: 4371 - protein, 83 aa, Malus domestica
MLTGLTILGNTGLKTTSGGINNEDSTISLGGTSDHVLDEITMSGSINNSAVVLGGLKLPQGNINGNTTLTLSLELVQHPSILE

SEQ ID NO: 4372 - protein, 104 aa, Cannabis sativa
MGFCQGCTQPSSSRKRLPSRFPHTWPWSIWVWWHPSLLQQQIICLTPRVKARRACSRVCPSLEIPASKPPVVESMMRTAQSACEVPVIMFLIKSRWPGASMTVQ

SEQ ID NO: 4373 - protein, 275 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSWIDH

SEQ ID NO: 4374 - protein, 177 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATPPSTQRQGTRKSLRKSHLT

SEQ ID NO: 4375 - protein, 200 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPTKSHLCQSLVSKETT

SEQ ID NO: 4376 - protein, 197 aa, Vitis vinifera
MVHLNRLDFSCQSRGAKGHHHTGLQDTSLHTSHWDSSNPTNLVHILKRESQWLVCGPLGLIDHVQGLKKSWALVPVKVGRPLYHIVTLKARDGDKWNLIRVVSNLLQVGRNFLHDFIVPCLGVLGCCGIHLLQQIICFTPRVKASSACSRVCPSLEIPASKPPVVESIMRTAQSACEVPVIMFLMKSRWPGASITVQ

SEQ ID NO: 4377 - protein, 128 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGYL

SEQ ID NO: 4378 - protein, 155 aa, Sorghum bicolor
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKV

SEQ ID NO: 4379 - protein, 226 aa, Glycine max
MITCASKIAKMQSLLLGGSLCDLGSGGVFLLNTLDDSNSYGLTHVPHSKTTKGRILRESFNHHGLGWNHLNHTSITILQKFGLLLKLLTRSPVNLGQDFRKLHSNVRSVAVKDWCVSITNLARMVHDNDLGCEVGSFLGRVVLGVGCNKTTLEILDCNILHIKSNIVTWKSLCESLMVHLNRLNLSCQPSGTKSHHHTRLHNPSLYTSHWHSTNTTNLVDILQWKP

SEQ ID NO: 4380 - protein, 98 aa, Triticum aestivum
EKTHINILVTGHVDSGKSTTTGHLIYKLGGIDKRVIERFEKEAAEMNKRSFKYAWVLDKLKAERERGITIDIALWKFETTKYTAPSLMPLVTVTSSRT

SEQ ID NO: 4381 - protein, 447 aa, Unknown
  Sequence found in Organisms: Prunus persica, Prunus mume
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDLINEPKRPSDKPLRLPLQDVYKIGGIGTVPVGRVETGIIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKEIEKEPKFLKNGDAGMVKMLPTKPMVVETFSEYPPLGRFAVRDMRQTVAVGVIKSVEKKDPSGAKVTKSAAKKK

SEQ ID NO: 4382 - protein, 447 aa, Amorphophallus konjac
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDLIQEPKRPTDKPLRLPLQDVYKIGGIGTVPVGRVETGILKPGMVVCFGPTGLTTEVKSVEMHHEALVEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVDKKDPTGAKVTKSAAKKK

SEQ ID NO: 4383 - protein, 449 aa, Amsonia hubrichtii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQISEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGAANFTAQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDPSGAKVTKAAAKKGAK

SEQ ID NO: 4384 - protein, 447 aa, Aquilegia formosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDNVSEPKRPSDKPLRLPLQDVYKIGGIGTVPVGRVETGVIKPGILVTFGPSGLTTEVKSVEMHHEALTEALPGDNVGFNVKNVAVKDLKRGYVASNSKDDPAKEAANFTSQVIIMNHPGQIGNGYAPVLDCHTSHIAVKFAEITTKIDRRSGKELEKEPKFLKNGDAGYVKMIPTKPMVVETFSEYPPLGRFAVRDMRQTVAVGVIKAVEKKEPTGAKVTKAAAKKK

SEQ ID NO: 4385 - protein, 447 aa, Aquilegia formosa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDNVSEPKRPSDKPLRLPLQDVYKIGGIGTVPVGRVETGVIKPGILVTFGPSGLTTEVKSVEMHHEALTEALPGDNVGFNVKNVAVKDLKRGYVASNSKEDPAKEAANFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVEKKEPTGAKVTKAAAKKK

SEQ ID NO: 4386 - protein, 447 aa, Musa acuminata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDLIQEPKRPTDKPLRLPLQDVYKIGGIGTVPVGRVETGVLKPGMVVTFGPTGLTTEVKSVEMHHEALQEAFPGDNVGFNVKNVAVKDLKRGFVASNSKEDPTKEAASFTSQVIIMNHPGQIGNGYAPVLDCHTSHIAVKFAELLTKIDRRSGKELEKEPKFLKNGDAGFVKMIPTKPMVVETFSEYPPLGRFAVRDMRQTVAVGVIKSVEKKDPTGAKITKAAAKKK

SEQ ID NO: 4387 - protein, 449 aa, Ocimum basilicum
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYMKKVGYNPEKIPFVPISGFEGDNMIERSTNLDWYKGPTLLEALDGIMEPKRPSDKPLRLPLQDVYKIGGIGTVPVGRVETGIIKPGMVVTFGPTGLTTEVKSVEMHHEALQEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMIKMIPTKPMVVETFSAYPPLGRFAVRDMRQTVAVGVIKSVEKKDPTGAKVTKAAAKKGAK

SEQ ID NO: 4388 - protein, 447 aa, Vaccinium corymbosum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMISEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTCHIAVKFAEILTKIDRRSGKEIEKEPKFLKNGDAGMVKMIPTKPMVVETFSEYPPLGRFAVRDMRQTVAVGVIKSVEKKDPSGAKVTKSAAKKK

SEQ ID NO: 4389 - protein, 449 aa, Vaccinium corymbosum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPEKIPFVPISGFEGDNMIERSTNLDWYKGPTLLEALDMISEPKRPSDKPLRLPLQDVYKIGGIGTVPVGRVETGVIKPGMVVTFGPTGLTTEVKSVEMHHEALPEALPGDNVGFNVKNVAVKDLKRGYVASNSKDDPAKEAANFSSQVIIMNHPGQIGNGYAPVLDCHTSHIAVKFAELLTKIDRRSGKELEKEPKFLKNGDSGMVKMIPTKPMVVETFSEYPPLGRFAVRDMRQTVAVGVIKSVEKKDPTGAKVTKAAAKKGVK

SEQ ID NO: 4390 - protein, 449 aa, Vaccinium corymbosum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMISEPKRPSDKPLRLPLQDVYKIGGIGTVPVGRVETGVIKPGMVVTFGPTGLTTEVKSVEMHHEALPEALPGDNVGFNVKNVAVKDLKRGFVASNSKDDPAKEASNFTSQVIIMNHPGQIGNGYAPVLDCHTSHIAVKFAEILTKIDRRSGKEIEKEPKFLKNGDAGMVKMIPTKPMVVETFSEYPPLGRFAVRDMRQTVAVGVIKSVEKKDPSGAKVTKAAAKKGAK

SEQ ID NO: 4391 - protein, 449 aa, Theobroma cacao
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAASFTSQVIIMNHPGQIGNGYAPVLDCHTSHIAVKFAELLTKIDRRSGKELEKEPKFLKNGDAGMVKMVPTKPMVVETFSEYPPLGRFAVRDMRQTVAVGVIKNVEKKDPTGAKVTKSAAKKGGK

SEQ ID NO: 4392 - protein, 449 aa, Theobroma cacao
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDSGMVKMVPTKPMVVETFSEYPPLGRFAVRDMRQTVAVGVIKNVEKKDPTGAKVTKSAAKKGGK

SEQ ID NO: 4393 - protein, 447 aa, Cedrus atlantica
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDQVSEPKRPSDKPLRLPLQDVYKIGGIGTVPVGRVETGIIKPGMVVTFGPTGLTTEVKSVEMHHEALLEALPGDNVGFNVKNVAVKDLKRGFVASDSKNDPAKEAANFTAQVIIMNHPGQIGNGYAPVLDCHTSHIAVKFAEIMTKVDRRSGKELEKEPKFLKNGDAGFIKMIPSKPMVVETFSDYPPLGRFAVRDMRQTVAVGVIKAVEKKDPTGAKVTKAAAKKK

SEQ ID NO: 4394 - protein, 449 aa, Cirsium arvense
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQISEPKRPSDKPLRLPLQDVYKIGGIGTVPVGRVETGVIKPGMVVTFGPSGLTTEVKSVEMHHEALLEALPGDNVGFNVKNVAVKDLKRGYVASNSKDDPAKGAASFTSQVIIMNHPGQIGNGYAPVLDCHTSHIAVKFQELVTKIDRRSGKEIEKEPKFLKNGDAGMVKMIPTKPMVVETFAEYPPLGRFAVRDMRQTVAVGVIKSVDKKDPTGAKVTKAAVKKGAK

SEQ ID NO: 4395 - protein, 447 aa, Citrus clementina
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPSGLTTEVKSVEMHHESLQEALPGDNVGFNVKNVSVKDLKRGYVASNSKDDPAKGASNFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVDKKDPSGAKVTKSAVKKK

SEQ ID NO: 4396 - protein, 449 aa, Cleome gynandra
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTEKPLRLPLQDVYKIGGIGTVPVGRVETGILKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGFVKMIPTKPMVVETFSEYPPLGRFAVRDMRQTVAVGVIKSVEKKDPSGAKVTKAAAKKGAK

SEQ ID NO: 4397 - protein, 449 aa, Cleome spinosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVASYLKKVGYNPDKIPFVPISGFEGDNMIERSTNLDWYKGPTLLEALDQINEPKRPSDKPLRLPLQDVYKIGGIGTVPVGRVETGVIKPGMLVTFAPSGLTTEVKSVEMHHEALLEALPGDNVGFNVKNVAVKDLKRGYVASNSKDDPAKEAASFTSQVIIMNHPGQIGNGYAPVLDCHTSHIAVKFAELLTKIDRRSGKELEKEPKFLKNGDAGMVKMVPTKPMVVETFSEYPPLGRFAVRDMRQTVAVGVIKSVEKKDPTGAKVTKAAAKKGAK

SEQ ID NO: 4398 - protein, 449 aa, Cleome spinosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMLVTFAPSGLTTEVKSVEMHHEALQEALPGDNVGFNVKNVAVKDLKRGFVASNSKDDPAKEAASFTSQVIIMNHPGQIGNGYAPVLDCHTSHIAVKFAEILTKIDRRSGKELEKEPKFLKNGDAGMVKMVPTKPMVVETFSEYPPLGRFAVRDMRQTVAVGVIKNVEKKDPTGAKVTKAAAKKGAK

SEQ ID NO: 4399 - protein, 449 aa, Coffea canephora
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKINFVPISGFEGDNMIERSTNLDWYKGPTLLEALDQIQEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASSFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKNVDKKDPTGAKVTKAAAKKGAK

SEQ ID NO: 4400 - protein, 448 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIINSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMVPTKPMVVETFSAYPPLGRFAVRDMRQTVAVGVIKSVEKKDPTGAKVTKSAAKKGK

SEQ ID NO: 4401 - protein, 448 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMIKMVPTKPMVVETFSEYPPLGRFAVRDMRQTVAVGVIKSVEKKDPTGAKVTKSAAKKGK

SEQ ID NO: 4402 - protein, 449 aa, Taraxacum officinale
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQINEPKRPSDKPLRLPLQDVYKIGGIGTVPVGRVETGVIKPGMVVTFGPSGLTTEVKSVEMHHESLLEAHPGDNVGFNVKNVAVKDLKRGYVASNSKDDPAKGAASFVSQVIIMNHPGQIGNGYAPVLDCHTSHIAVKFQELVTKIDRRSGKEIEKEPKFLKNGDAGMVKMIPTKPMVVETFAEYPPLGRFAVRDMRQTVAVGVIKSVDKKDPTGAKVTKAAVKKGAK

SEQ ID NO: 4403 - protein, 442 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKS

SEQ ID NO: 4404 - protein, 447 aa, Eucalyptus grandis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKMDATTPKYSKSRFDEIVKEVSSYLKKVGYNPDKIPFVPISGFEGDNMIERSTNLDWYKGPTLLEALDQILEPKRPTDKPLRLPLQDVYKIGGIGTVPVGRVETGVLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMVKMIPSKPMVVETFSEYPPLGRFAVRDMRQTVAVGVIKSVEKKDPSGAKVTKSAAKKK

SEQ ID NO: 4405 - protein, 447 aa, Euphorbia peplus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDNVSEPKRPSDKPLRLPLQDVYKIGGIGTVPVGRVETGVIKPGMVVTFGPSGLTTEVKSVEMHHESLVEGLPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGIIKMIPTKPMVVETFSEYPPLGRFAVRDMRQTVAVGVVKSVEKKDPSGAKVTKSAAKKK

SEQ ID NO: 4406 - protein, 447 aa, Vitis vinifera
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVSSYLKKVGYNPDKIPFVPISGFEGDNMIERSTNLDWYKGPTLLEALDMIHEPKRPSDKPLRLPLQDVYKIGGIGTVPVGRVETGIIKPGMVVTFGPSGLTTEVKSVEMHHESLVEGLPGDNVGFNVKNVAVKDLKRGFVASNSKDDPAKEAANFTAQVIIMNHPGQIGNGYAPVLDCHTSHIAVKFAEITTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4407 - protein, 447 aa, Humulus lupulus
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFIPISGFEGDNMIERSTNLDWYKGPTLLDALDQILEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFSEILTKIDRRSGKEIEKEPKFLKNGDAGFVKMIPTKPMVVETFSEYPPLGRFAVRDMRQTVAVGVIKSVEKKDPSGAKVTKSAAKKK

SEQ ID NO: 4408 - protein, 438 aa, Humulus lupulus
IVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPTDKPLRLPLQDVYKIGGIGTVPVGRVETGVIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFAELVTKIDRRSGKELEKEPKFLKNGDAGIIKMIPTKPMVVETFSEYPPLGRFAVRDMRQTVAVGVIKAVEKKDPSGAKVTKSAVKKK

SEQ ID NO: 4409 - protein, 447 aa, Zea mays
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVGSYLKKVGYNPDKIPFVPISGFEGDNMIERSTNLDWYKGPTLLEALDQINEPKRPSDKPLRLPLQDVYKIGGIGTVPVGRVETGLLKPGMVVTFAPTGLTTEVKSVEMHHETMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 4410 - protein, 447 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMIQEPKRPSDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAASFTSQVIIMNHPGQIGNGYAPVLDCHTSHIAVKFAEILTKIDRRSGKELEKEPKFLKNGDAGFVKMIPTKPMVVETFSQYPPLGRFAVRDMRQTVAVGVIKSVEKKDPSGAKVTKSAAKKK

SEQ ID NO: 4411 - protein, 447 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMIQEPKRPSDKPLRLPLQDVYKIGGIGTVPVGRVETGILKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPTGAKVTKSAAKKK

SEQ ID NO: 4412 - protein, 447 aa, Citrus sinensis
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMVVTFGPSGLTTEVKSVEMHHESLQEALPGDNVGFNVKNVSVKDLKRGYVASNSKDDPAKGASNFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVDKKDPSGAKVTKSAAKKK

SEQ ID NO: 4413 - protein, 449 aa, Orobanche aegyptiaca
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKINFVPISGFEGDNMIERSTNLDWYKGPTLLEALDMIQEPKRPSDKPLRLPLQDVYKIGGIGTVPVGRVETGIIKPGMLVTFGPTGLTTEVKSVEMHHESMPEALPGDNVGFNVKNVAVKDLKRGFVASNSKDDPAKEAANFTSQVIIMNHPGQIGQGYAPVLDCHTSHIAVKFAELVTKIDRRSGKEIEKEPKFLKNGDAGMVKMIPTKPMVVETFSEYPPLGRFAVRDMRQTVAVGVIKSVEKKDPSGAKVTKAAAKKGAK

SEQ ID NO: 4414 - protein, 449 aa, Orobanche aegyptiaca
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPDKINFVPISGFEGDNMIERSTNLDWYKGPTLLEALDMIQEPKRPSDKPLRLPLQDVYKIGGIGTVPVGRVETGVIKPGMLVTFAPTGLTTEVKSVEMHHESMLEALPGDNVGFNVKNVAVKDLKRGYVASNSKDDPAKEAANFTSQVIIMNHPGQIGQGYAPVLDCHTSHIAVKFAELVTKIDRRSGKELEKEPKFLKNGDAGFVKMIPTKPMVVETFSEYPPLGRFAVRDMRQTVAVGVIKSVEKKDPSGAKVTKAAAKKGAK

SEQ ID NO: 4415 - protein, 449 aa, Parthenium argentatum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGVK

SEQ ID NO: 4416 - protein, 448 aa, Capsicum annuum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKGK

SEQ ID NO: 4417 - protein, 447 aa, Phalaenopsis aphrodite
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDLIQEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGFVKMVPTKPMVVETFSEYPPLGRFAVRDMRQTVAVGVIKSVEKKDPSGAKVTKSAAKKK

SEQ ID NO: 4418 - protein, 447 aa, Phalaenopsis aphrodite
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSSNLDWYKGPTLLEALDLIQEPKRPSDKPLRLPLQDVYKIGGIGTVPVGRVETGVLKPGIVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGFVKMIPTKPMVVETFSEYPPLGRFAVRDMRQTVAVGVIKSVEKKDPTGAKVTKSAVKKK

SEQ ID NO: 4419 - protein, 447 aa, Platanus occidentalis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDMILEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFSEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4420 - protein, 447 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIAFVPISGFEGDNMIERSTNLDWYKGPTLLDALDNISEPKRPTDKPLRLPLQDVYKIGGIGTVPVGRVETGFIKPGMVITFGPTGLTTEVKSVEMHHEALLEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGIIKMLPTKPMVVETFSEYPPLGRFAVRDMRQTVAVGVIKAVEKKDPTGAKVTKSAVKKK

SEQ ID NO: 4421 - protein, 424 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVG

SEQ ID NO: 4422 - protein, 448 aa, Picea glauca
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDQLSEPKRPSDKPLRLPLQDVYKIGGIGTVPVGRVETGVIKPGMVVTFGPTGLTTEVKSVEMHHEALLEASPGDNVGFNVKNVAVKDLKRGFVASDSKNDPAKEAANFTAQVIIMNHPGQIGNGYAPVLDCHTSHIAVKFAEIMTKVDRRSGKELEREPKFLKNGDAGFIKMIPSKPMVVETFAEYPPLGRFAVRDMRQTVAVGVIKAVEKKDPTGAKITKAAAKKGK

SEQ ID NO: 4423 - protein, 447 aa, Fragaria vesca
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIDRSTNLDWYKGPTLLEALDQINEPKRPSDKPLRLPLQDVYKIGGIGTVPVGRVETGVIKPGMVVTFGPSGLTTEVKSVEMHHEALPEALPGDNVGFNVKNVAVKDLKRGYVASNSKDDPAKEAANFTSQVIIMNHPGQIGNGYAPVLDCHTSHIAVKFGEILTKIDRRSGKELEKEPKFLKNGDAGMVKMLPTKPMVVETFSEYPPLGRFAVRDMRQTVAVGVIKNVEKKDPSGAKVTKSAAKKK

SEQ ID NO: 4424 - protein, 449 aa, Helianthus annuus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4425 - protein, 449 aa, Tabernaemontana elegans
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDMIQEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASSFNSQVIIMNHPGQIGNGYAPVLDCHTSHIAVKFAELLTKIDRRSGKELEKEPKFLKNGDAGMVKMIPTKPMVVETFAEYPPLGRFAVRDMRQTVAVGVIKNVDKKDPTGAKVTKAAAKKGAK

SEQ ID NO: 4426 - protein, 449 aa, Tabernaemontana elegans
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLINEPKRPTDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVDKKDPTGAKVTKAAAKKSGK

SEQ ID NO: 4427 - protein, 448 aa, Solanum lycopersicum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSEDDPAKGAASFTAQVIIMNHPGQIGNGYAPVLDCHTSHIAVKFAEILTKIDRRSGKELEKEPKFLKNGDAGMVKMIPTKPMVVETFAEYPPLGRFAVRDMRQTVAVGVVKNVDKKDPTGAKVTKAAQKKGK

SEQ ID NO: 4428 - protein, 449 aa, Tragopogon dubius
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFQELLTKIDRRSGKELEKEPKFLKNGDAGMVKMIPTKPMVVETFAEYPPLGRFAVRDMRQTVAVGVIKNVDKKDPTGAKVTKAAVKKGAK

SEQ ID NO: 4429 - protein, 448 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPSGLTTEVKSVEMHHEALIEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKAVEKKDPSGGLNKTKSALKKK

SEQ ID NO: 4430 - protein, 449 aa, Populus trichocarpa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQIQEPKRPSDKPLRLPLQDVYKIGGIGTVPVGRVETGVIKPGMVVTFGPTGLSTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGMIKMIPTKPMVVETFSEYPPLGRFAVRDMRQTVAVGVIKSVEKKDPSGAKVTKSAAKKGAK

SEQ ID NO: 4431 - protein, 212 aa, Eucalyptus grandis
MGGVTVKNRGISISNLARVIHDNNLGGKVGCFLGGIVLRVGCNVATLEILDSNILHVKPNVVTWKSLLESLMVHLHGLNFSGQPRGTKSDNHPRLNDTSLNTADRDSSDTTNLVHVLKWETEGLVRWSLGLINLVEGVEQCWTLVPVKVGRPLNHVVSLESGDGDKWNLVRVISHLLQVRRDFLNNFIIPSLGVLGGGGIHLIPCYSSRSFA

SEQ ID NO: 4432 - protein, 170 aa, Medicago truncatula
MGKEKVHINIVVIGHVDSGKSTTTGHLIYKLGGIDKRVIERFEKEAAEMNKRSFKYAWVLDKLKAECERGITIDIALWKFETTKYYCTVIDAPGHRDFIKNMITGTSQADCAVLIIDSTTGGFEAGISKDGQTREHALLAFTLGVKQMIFAATRWMPLHLSTRRVGMKKL

SEQ ID NO: 4433 - protein, 319 aa, Mimulus guttatus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDLISEPKRPSDKPLRLPLQDVYKIGGIGTVPVGRVETGLIKPGMLVTFGPTGLTTEVKSVEMAPRVYARGSPRRQCWVQCEECCSQGSQAWVRCIELKG

SEQ ID NO: 4434 - protein, 73 aa, Persea americana
MGKEKVHINIVVIGHVDSGKSTTTGHLIYKLGGIDKRVIERFEKEAAEMNKRTFKYAWVLDKLKAERERGNYH

SEQ ID NO: 4435 - protein, 331 aa, Beta vulgaris
MGKEKIHISLVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAILIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDLINEPKRPSDKPPRLPLQDVYKIGGIGTVPVGRVETGVLKPGMLVTFGPTGLTTEVKSVEMHHESLPEALPGDNVGFNVKNVAVKDLKRGFVALTPRMTLPRRQPISLLR

SEQ ID NO: 4436 - protein, 83 aa, Cannabis sativa
MLTSLSILGNTSLKTSSGRVNNEDSTISLGGTSNHVLDKVTMSWGIDDSAVVLGGLKLPQGNINGNTTLTLSLKLVQHPCVLE

SEQ ID NO: 4437 - protein, 292 aa, Eschscholzia californica
MLPPPSTQRQGTRKSLRKSHLNLKKVGYNPDKIAFVPISGFEGDNMIERSTNLDWYKGPTLLDALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4438 - protein, 275 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFWTIWIDH

SEQ ID NO: 4439 - protein, 149 aa, Gossypium raimondii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMI

SEQ ID NO: 4440 - protein, 247 aa, Zea mays
ATTAYKTYAKMEHLSYVLEKQTLHQRQVASFLLGSSLGHLGTGRVLLLHTLDDSNSNRLSHVTDSKPTQGRILRECLHHHGLGGNHLHHTSITVLQELGLFLKLLARTPVDLGNQLSKLDSNMGGMAVQHWGIAVTDLARVVHDDDLGGEAGSLLGRVILGVGGHITTLDILHRDILHVEANVVTRKGLLKSLMVHLNRLHLSSQASWTKGDNHTRLDDTSLHTTNWHSSNTTNLVHILEGETQGLV

SEQ ID NO: 4441 - protein, 197 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPSLGLR

SEQ ID NO: 4442 - protein, 449 aa, Ricinus communis
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEIKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAAKKGGK

SEQ ID NO: 4443 - protein, 449 aa, Olea europaea
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKPRYDEIVKEVSSYIKKVGYNPDKIPFVPISGFEGDNMIERSTNLDWYKGPTLLEALDQILEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKGAANFTSQVIIMNHPGQIGNGYAPVLDCHTSHIAVKFAELQTKIDRRSGKELEKEPKFLKNGDAGLVKMIPTKPMVVETFSEYPPLGRFAVRDMRQTVAVGVIKNVDKKDPTGAKVTKAAAKKGAK

SEQ ID NO: 4444 - protein, 449 aa, Olea europaea
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKPRYDEIVKEVSSYIKKVGYNPDKIPFVPISGFEGDNMIERSTNLDWYKGPTLLEALDQILEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGIVKMIPTKPMVVETFSEYPPLGRFAVRDMRQTVAVGVIKNVDKKDPTGAKVTKAAAKKGAK

SEQ ID NO: 4445 - protein, 449 aa, Populus trichocarpa
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQIQEPKRPSDKPLRLPLQDVYKIGGIGTVPVGRVETGVIKPGMVVTFGPTGLSTEVKSVEMHHEALLEALPGDNVGFNVKNVAVKDLKRGYVASNSKDDPAKEAANFTSQVIIMNHPGQIGNGYAPVLDCHTCHIAVKFAEILTKIDRRSGKELEKEPKFLKNGDAGMIKMIPTKPMVVETFSAYPPLGRFAVRDMRQTVAVGVIKNVEKKDPSGAKVTKSAAKKGAK

SEQ ID NO: 4446 - protein, 449 aa, Ambrosia trifida
MGKEKIHISIVVIGHVDSGKSTTTGHLIYKLGGIDKRVIERFEKEAAEMNKRSFKYAWVLDKLKAERERGTTIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAVKKGAK

SEQ ID NO: 4447 - protein, 449 aa, Unknown
  Sequence found in Organisms: Arabidopsis thaliana, Arabidopsis lyrata
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMIKPGMVVTFAPTGLTTEVKSVEMHHESLLEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4448 - protein, 449 aa, Theobroma cacao
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAASFTSQVIIMNHPGQIGNGYAPVLDCHTSHIAVKFSELLTKIDRRSGKELEKEPKFLKNGDAGMVKMVPTKPMVVETFSEYPPLGRFAVRDMRQTVAVGVIKNVEKKDPTGAKVTKSAAKKGGK

SEQ ID NO: 4449 - protein, 449 aa, Cirsium arvense
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQINEPKRPSDKPLRLPLQDVYKIGGIGTVPVGRVETGVIKPGMVVTFGPSGLTTEVKSVEMHHEALLEALPGDNVGFNVKNVAVKDLKRGYVASNSKDDPAKGAASFTSQVIIMNHPGQIGNGYAPVLDCHTSHIAVKFQELLTKIDRRSGKEIEKEPKFLKNGDAGMVKMIPTKPMVVETFSEYPPLGRFAVRDMRQTVAVGVIKSVDKKDPTGAKVTKAAVKKGAK

SEQ ID NO: 4450 - protein, 449 aa, Cleome spinosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMLVTFAPSGLTTEVKSVEMHHEALQEALPGDNVGFNVKNVAVKDLKRGYVASNSKDDPAKEAASFTSQVIIMNHPGQIGNGYAPVLDCHTSHIAVKFAEILTKIDRRSGKELEKEPKFLKNGDAGMVKMVPTKPMVVETFSEYPPLGRFAVRDMRQTVAVGVIKNVEKKDPTGAKVTKAAAKKGAK

SEQ ID NO: 4451 - protein, 449 aa, Coffea canephora
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKINFVPISGFEGDNMIERSTNLDWYKGPTLLEALDQIQEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASSFTSQVIIMNHPGQIGNGYAPVLDCHTSHIAVKFSEIVTKIDRRSGKELEKEPKFLKNGDAGFVKMIPTKPMVVETFSEYPPLGRFAVRDMRQTVAVGVIKAVDKKDPTGAKVTKAAAKKGAK

SEQ ID NO: 4452 - protein, 449 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMIKMVPTKPMVVETFSAYPPLGRFAVRDMRQTVAVGVIKSVEKKDPSGAKVTKSAAKKGGK

SEQ ID NO: 4453 - protein, 449 aa, Cucumis sativus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPSDKPLRLPLQDVYKIGGIGTVPVGRVETGVLKPGMVVTFGPSGLTTEVKSVEMHHESLPEAVPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGMIKMIPTKPMVVETFSQYPPLGRFAVRDMRQTVAVGVIKSVEKKDPSGAKVTKSAAKKGGK

SEQ ID NO: 4454 - protein, 449 aa, Fraxinus spp
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYIKKVGYNPDKIPFVPISGFEGDNMIERSTNLDWYKGPTLLDALDQIQEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFAEYPPLGRFAVRDMRQTVAVGVIKSVDKKDPTGAKVTKAAAKKGAK

SEQ ID NO: 4455 - protein, 449 aa, Olea europaea
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKPRYDEIVKEVSSYIKKVGYNPDKIPFVPISGFEGDNMIERSTNLDWYKGPTLLEALDQILEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFAEYPPLGRFAVRDMRQTVAVGVIKSVDKKDPTGAKVTKAAAKKGAK

SEQ ID NO: 4456 - protein, 449 aa, Populus trichocarpa
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQIQEPKRPSDKPLRLPLQDVYKIGGIGTVPVGRVETGVIKPGMVVTFGPTGLSTEVKSVEMHHEALLEALPGDNVGFNVKNVAVKDLKRGFVASNSKDDPAREAANFTSQVIIMNHPGQIGNGYAPVLDCHTCHIAVKFAEILTKIDRRSGKELEKEPKFLKNGDAGMIKMIPTKPMVVETFSAYPPLGRFAVRDMRQTVAVGVIKSVEKKDPSGAKVTKSAAKKGAK

SEQ ID NO: 4457 - protein, 449 aa, Helianthus annuus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWNKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4458 - protein, 449 aa, Helianthus annuus
MGKEKIHISIVDIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4459 - protein, 449 aa, Eutrema halophilum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLLEALPGDNVGFNVKNVAVKDLKRGYVASNSKDDPAKGAANFTSQVIIMNHPGQIGNGYAPVLDCHTSHIAVKFSEILTKIDRRSGKELEKEPKFLKNGDAGMVKMTPTKPMVVETFSEYPPLGRFAVRDMRQTVAVGVIKSVDKKDPTGAKVTKAAVKKGAK

SEQ ID NO: 4460 - protein, 449 aa, Triphysaria pusilla
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRFDEIVKEVASYLKKVGYNPDKINFVPISGFEGDNMIERSTNLDWYKGPTLLEALDMISEPKRPSDKPLRLPLQDVYKIGGIGTVPVGRVETGIIKPGMLVTFGPTGLTTEVKSVEMHHESMPEALPGDNVGFNVKNVAVKDLKRGFVASNSKDDPAKEAANFTSQVIIMNHPGQIGQGYAPVLDCHTSHIAVKFAELVTKIDRRSGKELEKEPKFLKNGDAGMVKMIPTKPMVVETFAAYPPLGRFAVRDMRQTVAVGVIKSVEKKDPSGAKVTKAAVKKGAK

SEQ ID NO: 4461 - protein, 449 aa, Valeriana officinalis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPEKVPFVPISGFEGDNMIERSTNLDWYKGPTLLEALDMVSEPKRPSDKPLRLPLQDVYKIGGIGTVPVGRVETGIIKPGMIVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFGQILTKIDRRSGKELEKEPKFLKNGDAGIIKMLPTKPMVVETFSEYPPLGRFAVRDMRQTVAVGVIKSVEKKDPTGAKVTKAAAKKTGK

SEQ ID NO: 4462 - protein, 137 aa, Setaria italica
MLTGLAILGDTSLKTTSGGVNDEDSTVSLGGTSDHVLDEVTVSRGVNDGTVVLGGLELPQGNINGDTPLTLSLELVKHPCILEGPLVHLCSFLLEPLDHTLVDTSKLVDQVAGGGRLARVDVANDHNVDVGLLLTHG

SEQ ID NO: 4463 - protein, 147 aa, Ambrosia trifida
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGIPRTVRPVSTLFLLSPLVSSK

SEQ ID NO: 4464 - protein, 67 aa, Ricinus communis
MHFNRLNFSCQSTGSKGHNHTRLEDTSLHTTHWNCSNTTNLVNVLKWETKRLVCGPLWLIDLVKSFK

SEQ ID NO: 4465 - protein, 96 aa, Vitis vinifera
MMMTWEVKLAASLAGSSLEFEATNPRLRSFTATFFTLKPTLSPGKASGRDSWCISTDLTSVVSPEGPKVTTIPGFRTPVSTRPTGTVPIPPILYTS

SEQ ID NO: 4466 - protein, 188 aa, Papaver somniferum
MSTLENRPPTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIAFVPHLWFRGRQHD

SEQ ID NO: 4467 - protein, 464 aa, Sorghum bicolor
QETRNHGYAGSSSFLLGSRLGHLGSRRVLLLHALYHTDRNRLPHVTNSEAPQWRILREGLHHHGLCGDHLDEAGITILKELGGALQLLARPPVDLGEQLRELDGDVGGVAVQHRGVAVADLPGVVHDDHLRGEAGSLLGGVVLGVGGHVATLQVLDRHVLDVEADVVAGKRLLHRLVVHLHRLDLRRQARGAKGDHHAGLNEAGLHTAHRDGADAADLVHVLQGKAQGLVRGPLGLVNLVQRLKEGGALVPVQVRRPLDHVVTLEPRDGHEGDLVRVVPHLLEVGTHFLDDLVVPSLGVLGGDFYLVAAADHLSDTKSESKECVLTGLAVLGDTSLKATSGGVNDEHRTISLGGAGDHVLDEVTVPRSVDHSAVVLGGLKLPQGNVNGDAPLALGLELVKHPGVLEGPLVHLGSLLLKPLDDTLVDASKLVDEVAGGGGLAGVNMTNDHNVDVNLLLPHGNGTS

SEQ ID NO: 4468 - protein, 170 aa, Valeriana officinalis
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTQNTPRLGTMKS

SEQ ID NO: 4469 - protein, 235 aa, Triticum aestivum
MIERSTNLDWYKGPTLLEALDQINEPKKPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKSAELVTKIDRRSGKELEALPKFLKNGDAGITKMIPTKPMAVETFATYPPLGRFAVRDMRQTVAVGVIKGVEKKDPT

SEQ ID NO: 4470 - protein, 447 aa, Prunus mume
MGKEKIHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALTEALPGDNVGFNVKNVAVKDLKRGFVASNSKEDPAREAANFTSQVIIMNHPGQIGNGYAPVLDCHTSHIAVKFNEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4471 - protein, 448 aa, Abies balsamea
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLDALDQLSEPKRPSDKPLRLPLQDVYKIGGIGTVPVGRVETGVIKPGMVVTFGPTGLTTEVKSVEMHHEALLEAAPGDNVGFNVKNVAVKDLKRGFVASDSKNDPAKEAANFTAQVIIMNHPGQIGNGYAPVLDCHTSHIAVKFGEILTKVDRRSGKELEKEPKFLKNGDAGFVKMIPSKPMVVETFAEYPPLGRFAVRDMRQTVAVGVIKAVEKKEPTGAKVTKAAAKKGK

SEQ ID NO: 4472 - protein, 447 aa, Amorphophallus konjac
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPFDKPLRLPLQDVYKIGGIGTVPVGRVETGVLKPGMVVTFGPSGLTTEVKSVEMHHEALPEALPGDNVGFNVKNVAVKDLKRGFVASNSKEDPAKEAANFTSQVIIMNHPGQIGNGYAPVLDCHTSHIAVKFSEILTKIDRRSGKELEKEPKFLKNGDAGFVKMVPTKPMVVETFSEYPPLGRFAVRDMRQTVAVGVIKSVERKDPTGAKVTKSAAKKK

SEQ ID NO: 4473 - protein, 447 aa, Malus domestica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGIVKPGMVVTFGPTGLTTEVKSVEMHHEALQEALPGDNVGFNVKNVAVKDLKRGFVASNSKDDPAKEAANFTAQVIIMNHPGQISNGYAPVLDCHTSHIAVRFGEILTKIDRRSGKEIEKEPKFLKNGDAGMVKMLPTKPMVVETFSEYPPLGRFAVRDMRQTVAVGVIKSVEKKDPSGAKVTKSAAKKK

SEQ ID NO: 4474 - protein, 447 aa, Artemisia annua
MGKEKVHISLVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAILIIDSTTGGFEAGISKDGQTREHALLAFTLGVKQMICCCNKMDATTPKYSKARFDEIVKEVSSYLKKVGYNPDKVPFVPISGFEGDNMIERSSNLDWYKGPTLLEALDQINEPKRPSDKPLRLPLQDVYKIGGIGTVPVGRVETGMIKPGMVVTFGPSGLTTEVKSVEMHHESLLEALPGDNVGFNVKNVAVKDLKRGYVASNSKDDPAKGAASFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVDKKDPTGAKITKAAIKKK

SEQ ID NO: 4475 - protein, 447 aa, Euonymus alatus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKEAANFTSQVIIMNHPGQIGNGYAPVLDCHTSHIAVKFAEILTKIDRRSGKELEKEPKFLKNGDAGMVKMIPTKPMVVETFSAYPPLGRFAVRDMRQTVAVGVIKSVDKKEASAAKVTKSAAKKK

SEQ ID NO: 4476 - protein, 448 aa, Euonymus alatus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQVSEPKRPTDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAANFTAQVIIMNHPGQIGNGYAPVLDCHTSHIAVKFAELLTKIDRRSGKELEKEPKFLKNGDAGFVKMIPTKPMVVETFSEYPPLGRFAVRDMRQTVAVGVIKAVEKKDPTGAKVTKSAVKKGK

SEQ ID NO: 4477 - protein, 447 aa, Euphorbia peplus
MGKEKIHISIGVIGHVDSGKSTTTGHLIYKLGGIDKRVIERFEKEAAEMNKRSFKFPWVLDKLKADRERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQINEPKRPSDKPLRLPLQDVYKIGGIGTVPVGRVETGIIKPGMVVTFGPSGLTTEVKSVEMHHEALQEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGMIKMIPTKPMVVETFAEYPPLGRFAVRDMRQTVAVGVIKSVEKKDPSGAKVTKSAAKKK

SEQ ID NO: 4478 - protein, 447 aa, Linum usitatissimum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKMDATTPKYSKSRFDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPTGLTTEVKSVEMHHEALQEALPGDNVGFNVKNVAVKDIKRGYVASNSKDDPAREAANFTSQVIIMNHPGQIGNGYAPVLDCHTSHIAVKFSEILTKIDRRSGKELEKEPKFLKNGDAGMVKMIPTKPMVVETFSQYPPLGRFAVRDMRQTVAVGVIKSVEKKDPSGAKVTKSAAKKK

SEQ ID NO: 4479 - protein, 447 aa, Ipomoea batatas
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYMKKVGYNPEKIPFVPISGFEGDNMIERSTNLDWYKGPTLLEALDMIHEPKRPSDKPLRLPLQDVYKIGGIGTVPVGRVETGILKPGMVVTFGPSGLTTEVKSVEMHHEALQEALPGDNVGFNVKNVAVKDLKRGYVASNSKDDPAKGAANFTSQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKNVDKKDPTGAKVTKAAQKKK

SEQ ID NO: 4480 - protein, 447 aa, Ipomoea nil
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYMKKVGYNPDKIPFVPISGFEGDNMIERSTNLDWYKGPTLLEALDLIHEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELLTKIDRRSGKELEKEPKFLKNGDAGMVKMLPTKPMVVETFSEYPPLGRFAVRDMRQTVAVGVIKNVDKKDPTGAKVTKAAQKKK

SEQ ID NO: 4481 - protein, 447 aa, Lolium multiflorum
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGQLVTFGPTGLTTEVKSVEMHHESMLEAGPGDNVGFNVKNVAVKDIKRGYVASNAKDDPAKEAASFVAQVIIMNHPGQIGNGYAPVLDCHTSHIAVKFSEIQTKVDRRSGKEIEAFPKFLKNGDAGFVKMIPTKPMVVETFAQYPPLGRFAVRDMRQTVAVGVIKSVEKKDPTGAKVTKAAAKKK

SEQ ID NO: 4482 - protein, 431 aa, Lolium multiflorum
DSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPEKVPFVPISGFEGDNMIERSTNLDWYKGPTLLEALDQINEPKRPSDKPLRLPLQDVYKIGGIGTVPVGRVETGTIKPGMVVTFGPTGLTTEVKSVEMHHESLLEALPGDNVGFNVKNVAVKDLKRGFVASNSKDDPAKEAASFTSQVIIMNHPGQIGNGYAPVLDCHTSHIAVKFAELVTKIDRRSGKEIEKEPKFLKNGDAGIVKMIPTKPMVVETFATYPPLGRFAVRDMRQTVAVGVIKGVEKKDPTGAKVTKAAAKKK

SEQ ID NO: 4483 - protein, 437 aa, Pennisetum glaucum
VVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4484 - protein, 447 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDMILEPKRPSDKPLRLPLQDVYKIGGIGTVPVGRVETGILKPGMVVTFGPSGLTTEVKSVEMHHEALQEALPGDNVGFNVKNVAVKDLKRGYVASNSKDDPAKEAGSFTSQVIIMNHPGQIGNGYAPVLDCHTSHIAVKFAEILTKIDRRSGKELEKEPKFLKNGDAGFVKMIPTKPMVVETFSAYPPLGRFAVRDMRQTVAVGVIKSVEKKDPTGAKITKAAAKKK

SEQ ID NO: 4485 - protein, 447 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLEWYKGPTLLEALDMIQEPKRPSDKPLRLPLQDVYKIGGIGTVPVGRVETGILRPGMVVTFGPSGLTTEVKSVEMHHEALQEALPGDNVGFNVKNVAVKDLKRGFVASNSKDDPAKEAASFTSQVIIMNHPGQIGNGYAPVLDCHTSHIAVKFAEILTKIDRRSGKELEKEPKFLKNGDAGFVKMIPTKPMVVETFSAYPPLGRFAVRDMRQTVAVGVIKSVEKKDPTGAKITKAAAKKK

SEQ ID NO: 4486 - protein, 447 aa, Phalaenopsis aphrodite
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLDALDLIQEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGFVKMVPTKPMVVETFSEYPPLGRFAVRDMRQTVAVGVIKSVEKKDPSGAKVTKSAAKKK

SEQ ID NO: 4487 - protein, 447 aa, Populus trichocarpa
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKSRFDEIVKEVSSYLKKVGYNPDKIPFVPISGFEGDNMIERSTNLDWYKGPTLLDALDQISEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGFVKMIPTKPMVVETFSAYPPLGRFAVRDMRQTVAVGVIKSVEKKDPSGAKVTKSAVKKK

SEQ ID NO: 4488 - protein, 447 aa, Pseudotsuga menziesii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDQVSEPKRPSDKPLRLPLQDVYKIGGIGTVPVGRVETGIIKPGMVVTFGPTGLTTEVKSVEMHHEALLEASPGDNVGFNVKNVAVKDLKRGYVASDSKNDPAKEAANFTAQVIIMNHPGQIGNGYAPVLDCHTSHIAVKFAEIMTKVDRRSGKELEKEPKFLKNGDAGFIKMMPSKPMVVETFSEYPPLGRFAVRDMRQTVAVGVIKSVEKKDPTGAKVTKAAAKKK

SEQ ID NO: 4489 - protein, 447 aa, Selaginella moellendorffii
MGKEKAHINIVVIGHVDSGKSTTTGHLIYKLGGIDKRTIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLEWYKGPTLLEALDQVTEPKRPSDKPLRLPLQDVYKIGGIGTVPVGRVETGVLKPGMVVTFGPTGLTTEVKSVEMHHESLVEALPGDNVGFNVKNVAVKDLKRGFVASDSKNDPAKEAASFTSQVIIMNHPGQIGNGYTPVLDCHTSHIAVKFAEILTKVDRRSGKELEKEPKFLKNGDAGFVKMLPTKPMVVETFAEYPPLGRFAVRDMRQTVAVGVIKAVEKKEPTGAKVTKAAAKKK

SEQ ID NO: 4490 - protein, 448 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKAVEKKEAGAAGKITKSALKKK

SEQ ID NO: 4491 - protein, 447 aa, Tripterygium wilfordii
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQVNEPKRPSDKPLRLPLQDVYKIGGIGTVPVGRVETGILKPGTVVTFGPSGLTTEVKSVEMHHEALQEALPGDNVGFNVKNVAVKDLKRGFVASNSKDDPAKEAANFTAQVIIMNHPGQIGAGYAPVLDCHTSHIAVKFAELLTKIDRRSGKELEKEPKFLKNGDAGFVKMIPSKPMVVETFSEYPPLGRFAVRDMRQTVAVGVIKAVEKKDPTGAKVTKSAVKKK

SEQ ID NO: 4492 - protein, 170 aa, Populus trichocarpa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKWMPPPPSTPSLGSMKS

SEQ ID NO: 4493 - protein, 73 aa, Brassica juncea
MGKEKFHINIVVIGHVDSGKSTTTGHLIYKLGGIDKRVIERFEKEAAEMNKRSFKYAWVLDKLKAERERGIYH

SEQ ID NO: 4494 - protein, 349 aa, Brassica napus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPRA

SEQ ID NO: 4495 - protein, 303 aa, Cichorium intybus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQINEPKRPSDKPLRLPLQDVYKIGGIGTVPVRRVETGVIKPGMSSPSVHLVDHESKSVEMHHERCLKLFPETMSDSMSRTLL

SEQ ID NO: 4496 - protein, 167 aa, Lotus japonicus
MHHEALQEALPGDNVGFNVKNVAVKDLKRGFVASNSKDDPAKEAANFTSQVIIMNHPGQIGNGYAPVLDCHTSHIAVKFGELLTKIDRRSGKELEKEPKFLKNGDAGLVKMIPTKPMVVETFSEYPPLGRFAVRDMRQTVAVGVIKSVEKKDPTGAKVTKAAQKKGK

SEQ ID NO: 4497 - protein, 221 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIDRSTNLDWYKGPTFLRLLT

SEQ ID NO: 4498 - protein, 170 aa, Primula obconica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATPPSTPSQGMKRS

SEQ ID NO: 4499 - protein, 200 aa, Scabiosa columbaria
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKRLDTILTKLLSSQFLGLRETT

SEQ ID NO: 4500 - protein, 96 aa, Saccharum officinarum
MNKRSFKYAWVLDKLKAERERGITIDIALWKFETTKYYCTVIDAPGHRDFIKNMITGTSQADCAALSLTPPLVVLRLVSPRMARPVSMPSLLSPLE

SEQ ID NO: 4501 - protein, 65 aa, Solanum lycopersicum
MSLTAKRPNGGYSENVSTTMGLVGIILTIPASPFFKNLGSFSSSLPERLSILVKISANLTAIWEV

SEQ ID NO: 4502 - protein, 448 aa, Phaseolus vulgaris
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPNYSKARYDEIVKEVSSYMKKVGYNPEKIPFVPISGFEGDNMIERSTNLDWYKGPTLLEALDQINEPKRPSDKPLRLPLQDVYKIGGIGTVPVGRVETGVLKPGMLVTFAPTGLTTEVKSVEMHHEALTEALPGDNVGFNVKNVAVKDLKRGFVASNSKDDPAKEAANFTSQVIIMNHPGQIGKGYAPVLDCHTSHIAVKFAELVTKIDRRSGKELEKEPKFLKNGDAGFVKMIPSKPMVVETFSEYPPLGRFAVRDMRQTVAVGVIKSVEKKDPAGAKVTKAAQKKGK

SEQ ID NO: 4503 - protein, 449 aa, Mimulus guttatus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDLISEPKRPSDKPLRLPLQDVYKIGGIGTVPVGRVETGLIKPGMLVTFGPTGLTTEVKSVEMHHESMPEALPGDNVGFNVKNVAVKDLKRGFVASNSKDDPAKEAANFTSQVIIMNHPGQIGNGYAPVLDCHTSHIAVKFREILTKIDRRSGKEIEKEPKFLKNGDAGMVNMIPTKPMVVETFSEYPPLGRFAVRDMRQTVAVGVIKSVEKKDPSGAKVTKAAAKKGAK

SEQ ID NO: 4504 - protein, 447 aa, Abies balsamea
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKRVGYNPDKIPFVPISGFEGDNMIERSNNLDWYKGPTLLEALDQVSEPKRPSDKPLRLPLQDVYKIGGIGTVPVGRVETGVIKPGTIVTFAPTGLTTEVKSVEMHHEALLEALPGDNVGFNVKNVAVKDLKRGYVASDSKNDPAKEAANFTAQVIIMNHPGQIGNGYAPVLDCHTCHIAVKFAEIMTKVDRRSGKELEKEPKFLKNGDAGFVKMIPTKPMVVETFAEYPPLGRFAVRDMRQTVAVGVIKAVEKKEPSGAKVTKAAAKKK

SEQ ID NO: 4505 - protein, 447 aa, Amborella trichopoda
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEITKEVSSYIKKVGYNPDKIPFVPISGFEGDNMIERSTNLDWYKGPTLLEALDMISEPKRPSDKPLRLPLQDVYKIGGIGTVPVGRVETGVLKPGMVVTFAPSGLTTEVKSVEMHHEALQEALPGDNVGFNVKNVAVKDLKRGFVASNSKDDPAKEAANFTAQVIIMNHPGQIGNGYAPVLDCHTCHIAVKFAEILTKIDRRSGKELEKEPKFLKNGDAGFVKMIPTKPMVVETFSEYPPLGRFAVRDMRQTVAVGVIKAVEKKDPSGAKVTKSAAKKK

SEQ ID NO: 4506 - protein, 449 aa, Theobroma cacao
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLDALDQINEPKRPSDKPLRLPLQDVYKIGGIGTVPVGRVETGTLKPGMVVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELLTKIDRRSGKELEKEPKFLKNGDAGFVKMIPTKPMVVETFSGYPPLGRFAVRDMRQTVAVGVIKSVDKKDASGAKVTKSAAKKSGK

SEQ ID NO: 4507 - protein, 447 aa, Cannabis sativa
MGKEKLHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFIPISGFEGDNMIERSTNLDWYKGPTLLEALDQILEPKRPTDKPLRLPLQDVYKIGGIGTVPVGRVETGVIKPGMVVTFGPTGLTTEVKSVEMHHEALQEAGPGDNVGFNVKNVAVKDLKRGFVASNSKDDPAREAANFTSQVIIMNHPGQIGNGYAPVLDCHTSHIAVKFSEILTKIDRRSGKEIEKEPKFLKNGDAGFVKMLPTKPMVVETFSEYPPLGRFAVRDMRQTVAVGVIKSVEKKDPSGAKVTKSAAKKK

SEQ ID NO: 4508 - protein, 449 aa, Catharanthus roseus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDMIQEPKRPSDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGAASFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDPSGAKVTKAAAKKGAK

SEQ ID NO: 4509 - protein, 447 aa, Cedrus atlantica
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKRVGYNPDKIPFVPISGFEGDNMIERSSNLDWYKGPTLLEALDQVSEPKRPSDKPLRLPLQDVYKIGGIGTVPVGRVETGVLKPGTVVTFAPTGLTTEVKSVEMHHEALTEALPGDNVGFNVKNVAVKDLKRGYVASDSKNDPAKEAANFTAQVIIMNHPGQIGNGYAPVLDCHTCHIAVKFAEIMTKVDRRSGKELEKEPKFLKNGDAGFVKMIPTKPMVVETFAEYPPLGRFAVRDMRQTVAVGVIKAVEKKEPTGAKVTKAAIKKK

SEQ ID NO: 4510 - protein, 449 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMIKMVPTKPMVVETFSEYPPLGRFAVRDMRQTVAVGVIKSVEKKDPSGAKVTKSAAKKGGK

SEQ ID NO: 4511 - protein, 447 aa, Euonymus alatus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKEAASFTSQVIIMNHPGQIGNGYAPVLDCHTSHIAVKFAEILTKIDRRSGKELEKEPKFLKNGDAGMVKMIPTKPMVVETFSAYPPLGRFAVRDMRQTVAVGVIKSVDKKEASAAKVTKSAAKKK

SEQ ID NO: 4512 - protein, 447 aa, Euphorbia peplus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQINEPKRPSYKPLRLPFQDVYNIGGIGTVPVGRVDTGIIKPGMVVTFGPSGLTTEVKSVEMHHEALQEALPGDNVGFNVKNVAVKDLKRGFVASNSKDDPAKEAANFTSHVIIMNHPGQIGNGYAPVLDCHTSHIAVKFSEILTKIDRRSGKELEKEPKFLKNGDAGMIKMIPTKPMVVETFAEYPPLGRFAVRDMRQTVAVGVIKSVEKKDPSGAKVTKSAAKKK

SEQ ID NO: 4513 - protein, 448 aa, Euphorbia peplus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPTDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAANFTSQVIIMNHPGQIGNGYAPVLDCHTSHIAVKFSEILTKIDRRSGKELEKEPKFLKNGDAGFVKMIPTKPMVVETFAEYPPLGRFAVRDMRQTVAVGVIKSVDKKDPSGAKVTKSAVKKGK

SEQ ID NO: 4514 - protein, 449 aa, Fraxinus spp
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYIKKVGYNPDKIPFVPISGFEGDNMIERSTNLDWYKGPTLLDALDQIQEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFAEYPPLGRFAVRDMRQTVAVGVIKSVDKKDPSGAKVTKAAAKKGAK

SEQ ID NO: 4515 - protein, 449 aa, Fraxinus spp
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYIKKVGYNPDKIPFVPISGFEGDNMIERSTNLDWYKGPTLLDALDQIQEPKRPSDKPLRLPLQDVYKIGGIGAVPVGRVETGVIKPGMVVTFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFAEYPPLGRFAVRDMRQTVAVGVIKNVDKKDPTGAKVTKAAAKKGAK

SEQ ID NO: 4516 - protein, 447 aa, Gnetum gnemon
MGKEKTHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIVKEVSSYLKRVGYNPDKIPFVPISGFEGDNMIERSTNLDWYKGPTLLEALDMIHEPKRPSDKPLRLPLQDVYKIGGIGTVPVGRVETGTLKPGMVVTFGPTGLTTEVKSVEMHHEALSEALPGDNVGFNVKNVAVKDLKRGYVASDSKNDPAKEAASFTSQVIIMNHPGQIGNGYAPVLDCHTSHIAVKFAEIQTKVDRRSGKELEKEPKFLKNGDAGFVKMIPTKPMVVETFSEYPPLGRFAVRDMRQTVAVGVIKAVEKKEPTGAKVTKAAAKKK

SEQ ID NO: 4517 - protein, 449 aa, Hevea brasiliensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVALYLKKVGYNPEKIPFVPISGFEGDNMIERSTNLDWYKGPTLLEALDLILEPKRPSDKPLRLPLQDVYKIGGIGTVPVGRVETGVLKPGMVVTFAPSGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSTYPPLGRFAVRDMRQTVAVGVIKSVEKKDPTGAKVTKSAAKKGGK

SEQ ID NO: 4518 - protein, 449 aa, Lactuca sativa
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSTNLDWYKGPTLLEALDQINEPKRPTDKPLRLPLQDVYKIGGIGTVPVGRVETGIIKPGMVVTFGPTGLTTEVKSVEMHHEALTEALPGDNVGFNVKNVAVKDIKRGYVASNSKDDPAKGAASFTSQVIIMNHPGQIGNGYAPVLDCHTSHIAVKFQELLTKIDRRSGKELEKEPKFLKNGDAGMVKMMPTKPMVVETFAEYPPLGRFAVRDMRQTVAVGVIKSVDKKDPTGAKVTKAAAKKGVK

SEQ ID NO: 4519 - protein, 447 aa, Pinus pinaster
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKRVGYNPDKIPFVPISGFEGDNMIERSTNLDWYKGPTLLEALDQVSEPKRPSDKPLRLPLQDVYKIGGIGTVPVGRVETGVIKPGTIVTFGPTGLTTEVKSVEMHHEALQEALPGDNVGFNVKNVAVKDLKRGYVASDSKNDPAKEAANFTAQVIIMNHPGQIGNGYAPVLDCHTCHIAVKFAEIMTKVDRRSGKELEKEPKFLKNGDAGFVKMIPTKPMVVETFAEYPPLGRFAVRDMRQTVAVGVIKAVEKKEPSGAKVTKAAAKKK

SEQ ID NO: 4520 - protein, 449 aa, Cucumis melo
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPDKIPFVPISGFEGDNMIERSTNLDWYKGPTLLEALDLIQEPKRPSDKPLRLPLQDVYKIGGIGTVPVGRVETGIIKPGMVVTFAPTGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKAVEKKDASGAKVTKSAAKKSGK

SEQ ID NO: 4521 - protein, 447 aa, Tropaeolum majus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIAFVPISGFEGDNMIERSTNLDWYKGPTLLEALDLISEPKRPTDKPLRLPLQDVYKIGGIGTVPVGRVETGVLKPGMVVTFGPTGLTTEVKSVEMHHESLPEAMPGDNVGFNVKNVAVKDLKRGFVASNSKDDPAKEAANFTSQVIIMNHPGQIGNGYAPVLDCHTSHIAVKFGEILTKIDRRSGKELEKEPKFLKNGDAGFVKMLPSKPMVVETFSAYPPLGRFAVRDMRQTVAVGVIKSVEKKDPSGAKVTKSAVKKK

SEQ ID NO: 4522 - protein, 447 aa, Avena sativa
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKGRFEEIVKEVGSYLKKVGYNPDKVPFVPISGFEGDNMIERSSNLDWYKGPTLLEALDQINEPKRPSDKPLRLPLQDVYKIGGIGTVPVGRVETGVIKPGMLVTFGPTGLTTEVKSVEMHHESMLEALPGDNVGFNVKNVAVKDIKRGYVASNAKDDPAKEAANFVAQVIIMNHPGQIGNGYAPVLDCHTSHIAVKFSEIQTKVDRRSGKEIEAFPKFLKNGDAGFVKMIPTKPMVVETFSQYPPLGRFAVRDMRQTVAVGVIKSVEKKDPTGAKVTKAAAKKK

SEQ ID NO: 4523 - protein, 448 aa, Capsicum annuum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGIIKPGMVVTFGPTGLTTEVKSVEMHHEALQEALPGDNVGFNVKNVAVKDLKRGYVASNSKDDPAKGASSFTSQVIIMNHPGQIGNGYAPVLDCHTSHIAVKFAEILTKIDRRSGKELEKEPKFLKNGDSGMVKMIPTKPMVVETFSDYPPLGRFAVRDMRQTVAVGVIKSVDKKDPTGAKITKAAAKKAK

SEQ ID NO: 4524 - protein, 447 aa, Phalaenopsis aphrodite
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSSNLDWYKGPTLLEALDLIQEPKRPTDKPLRLPLQDVYKIGGIGTVPVGRVETGVLKPGMVVTFGPTGLTTEVKSVEMHHEALQEAVPGDNVGFNVKNVAVKDLKRGFVASNSKEDPAREAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4525 - protein, 447 aa, Pinus taeda
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKRVGYNPDKIPFVPISGFEGDNMIERSTNLDWYKGPTLLEALDNLSEPKRPSDKPLRLPLQDVYKIGGIGTVPVGRVETGVIKPGMIVTFGPTGLTTEVKSVEMHHEALLEALPGDNVGFNVKNVAVKDLKRGYVASDSKNDPAKEAANFTAQVIIMNHPGQIGNGYAPVLDCHTCHIAVKFAEIQTKVDRRSGKELEKEPKFLKNGDAGFVKMIPTKPMVVETFAEYPPLGRFAVRDMRQTVAVGVIKAVEKKEPSGAKVTKAAAKKK

SEQ ID NO: 4526 - protein, 447 aa, Podocarpus macrophillus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDMISEPKRPSDKPLRLPLQDVYKIGGIGTVPVGRVETGVLKPGTVVTFGPTGLTTEVKSVEMHHEALAEALPGDNVGFNVKNVAVKDLKRGFVASDSKNDPAKEAANFTAQVIIMNHPGQIGNGYAPVLDCHTSHIAVKFSEILTKVDRRSGKELEKEPKFLKNGDAGFVKMIPTKPMVVETFAEYPPLGRFAVRDMRQTVAVGVIKSVEKKEPSGAKVTKAAAKKK

SEQ ID NO: 4527 - protein, 447 aa, Prunus persica
MGKEKIHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSSNLDWYKGPTLLEALDLINEPKRPTDKPLRLPLQDVYKIGGIGTVPVGRVETGIIKPGMVVTFGPSGLTTEVKSVEMHHEALPEALPGDNVGFNVKNVAVKDLKRGFVASNSKDDPAREAANFTSQVIIMNHPGQIGNGYAPVLDCHTSHIAVKFNEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4528 - protein, 447 aa, Pseudotsuga menziesii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKRVGYNPDKIPFVPISGFEGDNMIERSTNLDWYKGPTLLDALDQVSEPKRPSDKPLRLPLQDVYKIGGIGTVPVGRVETGVIKPGTIVTFGPTGLTTEVKSVEMHHEALQEALPGDNVGFNVKNVAVKDLKRGYVASDSKNDPAKEAANFTAQVIIMNHPGQIGNGYAPVLDCHTCHIAVKFSEIMTKVDRRSGKELEKEPKFLKNGDAGFVKMIPTKPMVVETFAEYPPLGRFAVRDMRQTVAVGVIKAVEKKDPTGAKVTKAAAKKK

SEQ ID NO: 4529 - protein, 447 aa, Pteridium aquilinum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIMKEVSGYLKKVGYNPDKIPFVPISGFEGDNMIERSSNLDWYKGPTLLDALDMISEPKRPSDKPLRLPLQDVYKIGGIGTVPVGRVETGVIKPGMVVTFAPTGLTTEVKSVEMHHEALLEALPGDNVGFNVKNVAVKDLKRGFVASDSKNDPAREAANFTAQVIIMNHPGQIGNGYAPVLDCHTSHIAVKFAEILTKIDRRSGKELEKEPKFLKNGDAGFVKMIPTKPMTVETFADYPPLGRFAVRDMRQTVAVGVIKAVEKKDPSGAKVTKSAAKKK

SEQ ID NO: 4530 - protein, 447 aa, Pteridium aquilinum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIMKEVSAYLKKVGYNPDKIPFVPISGFEGDNMIERSSNLDWYKGPTLLDALDMVQEPKRPSDKPLRLPLQDVYKIGGIGTVPVGRVETGIIKPGMVVTFAPTGLTTEVKSVEMHHEALLEALPGDNVGFNVKNVAVKDLKRGFVASDSKNDPAKEAANFTSQVIIMNHPGQIGNGYAPVLDCHTSHIAVKFAEILTKIDRRSGKEIEKEPKFLKNGDAGIIKMIPTKPMTVETFAEYPPLGRFAVRDMRQTVAVGVIKAVEKKDPTGAKVTKAAAKKK

SEQ ID NO: 4531 - protein, 449 aa, Salvia sclarea
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVASYLKKVGYNPDKIPFVPISGFEGDNMIERSTNLDWYKGPTLLEALDQILEPKRPSDKPLRLPLQDVYKIGGIGTVPVGRVETGMIKPGMVVTFAPSGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGMIKMIPTKPMVVETFSEYPPLGRFAVRDMRQTVAVGVIKSVEKKDPSGAKVTKAAAKKGVK

SEQ ID NO: 4532 - protein, 447 aa, Sequoia sempervirens
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQVSEPKRPSDKPLRLPLQDVYKIGGIGTVPVGRVETGVLKPGTIVTFGPTGLTTEVKSVEMHHEALQEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAGFVKMIPTKPMVVETFSEYPPLGRFAVRDMRQTVAVGVIKAVEKKDPTGAKVTKAAAKKK

SEQ ID NO: 4533 - protein, 447 aa, Selaginella moellendorffii
MGKEKAHINIVVIGHVDSGKSTTTGHLIYKLGGIDKRTIERFEKEAAEMNKRSFKYAWVLDKLKAERERGITIDIALWKFETNRYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLEWYKGPTLLEALDQVTEPKRPSDKPLRLPLQDVYKIGGIGTVPVGRVETGVLKPGMVVTFGPTGLTTEVKSVEMHHESLVEALPGDNVGFNVKNVAVKDLKRGFVASDSKNDPAKEAASFTSQVIIMNHPGQIGNGYTPVLDCHTSHIAVKFAEILTKVDRRSGKELEKEPKFLKNGDAGFVKMLPTKPMVVETFAEYPPLGRFAVRDMRQTVAVGVIKAVEKKEPTGAKVTKAAAKKK

SEQ ID NO: 4534 - protein, 447 aa, Picea glauca
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKSRFDEIVKEVSSYLKKVGYNPDKIPFVPISGFEGDNMIERSTNLDWYKGPTLLDALDQISEPKRPTDKPLRLPLQDVYKIVGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGFVKMIPTKPMVVETFSAYPPLGRFAVRDMRQTVAVGVIKSVEKKDPSGAKVTKSAVKKK

SEQ ID NO: 4535 - protein, 449 aa, Tabernaemontana elegans
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPEKIPFVPISGFEGDNMIERSTNLDWYKGPTLLEALDMIQEPKRPSDKPLRLPLQDVYKIGGIGTVPVGRVETGILKPGMVVTFGPTGLTTEVKSVEMHHEALQEALPGDNVGFNVKNVAVKDLKRGFVASNSKDDPAKEASSFTSQVIIMNHPGQIGNGYAPVLDCHTSHIAVKFAELLTKIDRRSGKELEKEPKFLKNGDSGMVKMIPTKPMVVETFSEYPPLGRFAVRDMRQTVAVGVIKSVEKKDPTGAKVTKAAAKKGAK

SEQ ID NO: 4536 - protein, 448 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYAKGRYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKAVEKKEAGAAGKITKSALKKK

SEQ ID NO: 4537 - protein, 447 aa, Tripterygium wilfordii
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGLTLLEALDMINEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKGAASFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDASGAKVTKSAAKKK

SEQ ID NO: 4538 - protein, 449 aa, Valeriana officinalis
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDMISEPKRPSDKPLRLPLQDVYKIGGIGTVPVGRVETGTIKPGMVVTFGPTGLTTEVKSVEMHHESLLEALPGDNVGFNVKNVAVKDLKRGYVASNSKDDPAKGAANFTSQVIIMNHPGQIGNGYAPVLDCHTSHIAVKFAEILTKIDRRSGKEIEKEPKFLKNGDAGMVKMLPTKPMVVETFSEYPPLGRFAVRDMRQTVAVGVIKAVDKKDPSGAKVTKAAVKKGAK

SEQ ID NO: 4539 - protein, 449 aa, Citrullus lanatus
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPDKIPFVPISGFEGDNMIERSTNLDWYKGPTLLEALDLIQEPKRPSDKPLRLPLQDVYKIGGIGTVPVGRVETGIIKPGMVVTFAPTGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKAVEKKDPSGAKVTKSAAKKSGK

SEQ ID NO: 4540 - protein, 248 aa, Amorphophallus konjac
MIERSTNLDWYKGPTLLEALDFDPRSQTRPTDKPLRLPLQDVYKIGGIGTVPVGRVETGVLKPGMVVTFGPTGLTTEVKSVEMHHEALPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKAVEKKDPSGAKVTKAAQKKK

SEQ ID NO: 4541 - protein, 153 aa, Secale cereale
MFGFNVKNVAVKDLKRGFVASNSKDDPAKAPANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4542 - protein, 448 aa, Cicer arietinum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGVLKPGFVVTFAPTGLATEVKSVEMHHEALTEALPGDNVGFNVKNVAVKDLKRGYVASNSKDDPAKEAANFTSQVIIMNHPGQIGNGYAPVLDCHTSHIAVKFAELITKIDRRSGKEIEKEPKFLKNGDAGLVKMIPTKPMVVETFAEYPPLGRFAVRDMRQTVAVGVIKSVEKKEPSGGGKKTISAVKKK

SEQ ID NO: 4543 - protein, 449 aa, Olea europaea
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKPRYDEIVKEVSSYIKKVGYNPDKIPFVPISGFEGDNMIERSTNLDWYKGPTLLEALDQILEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFSEYPPLGRFAVRDMRQTVAVGVIKNVDKKDPSGAKVTKAAAKKGAK

SEQ ID NO: 4544 - protein, 447 aa, Prunus mume
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVRQMICCCNKMDATTPKYSKARYDEIVKEVSSYLKKVGYNPEKIPFVPISGFEGDNMIERSTNLDWYKGPTLLEALDLISEPKRPSDKPLRLPLQDVYKIGGIGTVPVGRVETGTLKPGMVVTFAPTGLTTEVKSVEMHHESLVEALPGDNVGFNVKNVAVKDLKRGYVASNSKDDPAKEAANFTAQVIIMNHPGQIGQGYAPVLDCHTSHIAVKFAEMLTKIDRRSGKELEKEPKFLKNGDAGFVKMVPTKPMVVETFSEYPPLGRFAVRDMRQTVAVGVIKSVEKKDPTGAKITKAAAKKK

SEQ ID NO: 4545 - protein, 449 aa, Prunus mume
MGKEKIHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKVQMDATTPKYSKARYDEIIKEVSSYLKKVGYNPDKIPFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALTEALPGDNVGFNVKNVAVKDLKRGFVASNSKEDPAREAANFTSQVIIMNHPGQIGNGYAPVLDCHTSHIAVKFNEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4546 - protein, 447 aa, Amborella trichopoda
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIMKEVSSYIKKVGYNPDKIPFVPISGFEGDNMIEKSTNLDWYKGPTLLEALDMILEPKRPFDKPLRLPLQDVYKIGGIGTVPVGRVETGVLKPGMVVTFAPSGLTTEVKSVEMHHEALQEALPGDNVGFNVKNVAVKDLKRGFVASNSKDDPAKEAANFTSQVIIMNHPGQIANGYAPVLDCHTCHIAVKFAEILTKIDRRSGKELEKEPKFLKNGDAGFVKMIPTKPMVVETFAEYPPLGRFAVRDMRQTVAVGVIKAVEKKDPSGAKVTKSAAKKK

SEQ ID NO: 4547 - protein, 447 aa, Amorphophallus konjac
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDMIQEPKRPLDKPLRLPLQDVYKIGGIGTVPVGRVETGILKPGMVVTFGPTGLTTEVKSVEMHHEALVEALPGDNVGFNVKNVAVKDLKRGFVASNSKEDPAKGAASFISQVIIMNHPGQIGNGYAPVLDCHTSHIAVKFAELLTKIDRRSGKELEKEPKFLKNGDAGLVKMIPSKPMVVETFSEYPPLGRFAVRDMRQTVAVGVIKSVDKKDPTGAKVTKSAAKKK

SEQ ID NO: 4548 - protein, 449 aa, Arnica chamissonis
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDNISEPKRPSDKPLRLPLQDVYKIGGIGTVPVGRVETGVIKPGMVVTFGPTGLTTEVKSVEMHHEALTEALPGDNVGFNVKNVAVKDLKRGYVASNSKDDPAKGAASFTSQVIIMNHPGQIGNGYAPVLDCHTSHIAVKFSEILTKIDRRSGKEIEKEPKFLKNGDAGMVKMLPTKPMVVETFAEYPPLGRFAVRDMRQTVAVGVIKSVDKKDPTGAKVTKAAVKKGAK

SEQ ID NO: 4549 - protein, 449 aa, Arnica chamissonis
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSEILTKIDRRSGKEIEKEPKFLKNGDAGMVKMLPTKPMVVETFAEYPPLGRFAVRDMRQTVAVGVIKSVDKKDPTGAKVTKAAVKKGAK

SEQ ID NO: 4550 - protein, 449 aa, Arnica chamissonis
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSEILTKIDRRSGKEIEKEPKFLKNGDAGMVKMLPTKPMVVETFAEYPPLGRFAVRDMRQTVAVGVIKSVDKKDPTGAKVTKAAVKKGVK

SEQ ID NO: 4551 - protein, 449 aa, Catharanthus roseus
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYMKKVGYNPDKIPFVPISGFEGDNMIERSTNLDWYKGPTLLEALDMISEPKRPSDKPLRLPLQDVYKIGGIGTVPVGRVETGILKPGMVVTFGPSGLTTEVKSVEMHHEALQEALPGDNVGFNVKNVAVKDLKRGFVASNSKDDPAKGAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKAAAKKTGK

SEQ ID NO: 4552 - protein, 200 aa, Cicer arietinum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKFHLFPSLVLREIT

SEQ ID NO: 4553 - protein, 447 aa, Euonymus alatus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKEAASFTSQVIIMNHPGQIGNGYAPVLDCHTSHIAVKFAEILTKIDRRSGKEIEKEPKFLKNGDAGIVKMIPTKPMVVETFSAYPPLGRFAVRDMRQTVAVGVVKSVDKKEASAAKVTKSAAKKK

SEQ ID NO: 4554 - protein, 447 aa, Lactuca sativa
MGKEKVHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIMKEVSTYLKKVGYNPDKIPFVPISGFEGDNMIERSTNLDWYKGPTLLEALDQINEPKRPTDKPLRLPLQDVYKIGGIGTVPVGRVETGIIKPGMVVTFGPTGLTTEVKSVEMHHEALLEALPGDNVGFNVKNVAVKDIKRGYVASNSKDDPAKGAASFTSQVIIMNHPGQIGNGYAPVLDCHTSHIAVKFAEILTKIDRRSGKEIEKEPKFLKNGDAGMVKMMPTKPMVVETFSEYPPLGRFAVRDMRQTVAVGVIKSVDKKDPTGAKITKAAAKKK

SEQ ID NO: 4555 - protein, 447 aa, Medicago truncatula
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVSSYMKKVGYNPDKIPFVPISGFEGDNMIERSTNLDWYKGPTLLEALDQINEPKRPSDKPLRLPLQDVYKIGGIGTVPVGRVETGTMKPGMVVTFAPTGLQTEVKSVEMHHESLTEALPGDNVGFNVKNVSVKDLKRGYVASNTKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKEPGTAKITKSAAKKK

SEQ ID NO: 4556 - protein, 449 aa, Olea europaea
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVASYIKKVGYNPDKIPFVPISGFEGDNMIERSSNLDWYKGPTLLEALDQILEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFAEYPPLGRFAVRDMRQTVAVGVIKSVDKKDPTGAKVTKAAAKKGAK

SEQ ID NO: 4557 - protein, 444 aa, Phalaenopsis aphrodite
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPTDKPLRLPLQDVYKIGGIGTVPVGRVETGVLKPGMVVTFGPTGLSTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMVPTKPMVVETFSEYPPLGRFAVRDMRQTVAVGVIKSVEKKDPSGAKVTKICC

SEQ ID NO: 4558 - protein, 440 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPTGAKVT

SEQ ID NO: 4559 - protein, 449 aa, Primula obconica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQVSEPKRPSDKPLRLPLQDVYKIGGIGTVPVGRVETGVIKPGMVVTFGPSGLTTEVKSVEMHHESLLEAHPGDNVGFNVKNVAVKDLKRGYVASNSKDDPAKGAASFTSQVIIMNHPGQIGNGYAPVLDCHTSHIAVKFSEILTKIDRRSGKELEKEPKFLKNGDAGMVKMIPTKPMVVETFSEYPPLGRFAVRDMRQTVAVGVIKSVDKKDPTGAKVTKAAVKKGAK

SEQ ID NO: 4560 - protein, 447 aa, Prunus persica
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVRQMICCCNKMDATTPKYSKARYDEIVKEVSSYLKKVGYNPEKIPFVPISGFEGDNMIERSTNLDWYKGPTLLEALDLISEPKRPSDKPLRLPLQDVYKIGGIGTVPVGRVETGTLKPGMLVTFAPTGLTTEVKSVEMHHESLQEALPGDNVGFNVKNVAVKDLKRGYVASNSKDDPAKEAANFTAQVIIMNHPGQIGQGYAPVLDCHTSHIAVKFAEMLTKIDRRSGKELEKEPKFLKNGDAGFVKMIPTKPMVVETFSEYPPLGRFAVRDMRQTVAVGVIKSVEKKDPTGAKITKAAAKKK

SEQ ID NO: 4561 - protein, 447 aa, Rosa hybrid cultivar
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATSPKYSKARYDEIVKEVSSYLKKIGYNPDKIAFVPISGFEGDNMIERSTNLDWYKGPTLLEALDMINEPKRPSDKPLRLPLQDVYKIGGIGTVPVGRVETGIIKPGMVVTFAPTGLTTEVKSVEMHHEALQEALPGDNVGFNVKNVAVKDLKRGYVASNSKDDPAKEAANFTAQVIIMNHPGQIGNGYAPVLDCHTSHIAVKFNEILTKIDRRSGKELEKEPKFLKNGDAGFVKMIPTKPMVVETFSEYPPLGRFAVRDMRQTVAVGVIKAVEKKDPSGAKVTKSAAKKK

SEQ ID NO: 4562 - protein, 447 aa, Rosa hybrid cultivar
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATSPKYSKARYDEIVKEVSSYLKKIGYNPEKIAFVPISGFEGDNMIERSTNLDWYKGPTLLEALDMINEPKRPSDKPLRLPLQDVYKIGGIGTVPVGRVETGIIKPGMVVTFGPTGLTTEVKSVEMHHEALQEALPGDNVGFNVKNVAVKDLKRGYVASNSKDDPAKEAANFTAQVIIMNHPGQIGNGYAPVLDCHTSHIAVKFKEILTKIDRRSGKELEKEPKFLKNGDAGFVKMIPTKPMVVETFSEYPPLGRFAVRDMRQTVAVGVIKAVEKKDPSGAKVTKSAVKKK

SEQ ID NO: 4563 - protein, 449 aa, Scabiosa columbaria
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDMISEPKRPSDKPLRLPLQDVYKIGGIGTVPVGRVETGTIKPGMVVTFGPTGLTTEVKSVEMHHESLLEALPGDNVGFNVKNVAVKDLKRGYVASNSKDDPAKGAASFTSQVIIMNHPGQIGNGYAPVLDCHTSHIAVKFAEILTKIDRRSGKEIEKEPKFLKNGDAGMVKMLPTKPMVVETFSEYPPLGRFAVRDMRQTVAVGVIKAVDKKDPSGAKVTKAAAKKGVK

SEQ ID NO: 4564 - protein, 447 aa, Fragaria vesca
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATSPKYSKARYDEIVKEVSSYLKKIGYNPDKIPFVPISGFEGDNMIERSTNLDWYKGPTLLEALDMINEPKRPSDKPLRLPLQDVYKIGGIGTVPVGRVETGIIKPGMVVTFAPTGLTTEVKSVEMHHEALQEALPGDNVGFNVKNVAVKDLKRGYVASNSKDDPAKEAANFTAQVIIMNHPGQIGNGYAPVLDCHTSHIAVKFGEILTKIDRRSGKELEKEPKFLKNGDAGFVKMLPTKPMVVETFSEYPPLGRFAVRDMRQTVAVGVIKAVEKKDPSGAKVTKSAAKKK

SEQ ID NO: 4565 - protein, 447 aa, Helianthus annuus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKPRYDEIVKEVSSYLKKVGYNPEKIPFVPISGFEGDNMIERSTNLDWYKGPTLLEALDNVSEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKGAAGFTSQVIIMNHPGQIGNGYAPVLDCHTSHIAVKFAELQTKIDRRSGKELEKEPKFLKNGDAGIVKMVPTKPMVVETFSEYPPLGRFAVRDMRQTVAVGVIKSVDKKDPTGAKITKAAAKKK

SEQ ID NO: 4566 - protein, 447 aa, Thalictrum flavum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDNISEPKRPTDKPLRLPLQDVYKIGGIGTVPVGRVETGVLKPGMVVTFGPTGLTTEVKSVEMHHEALQEALPGDNVGFNVKNVAVKDLKRGYVASNSKDDPAREAANFTSQVIIMNHPGQIGNGYAPVLDCHTSHIAVKFSEILTKIDRRSGKELEKEPKFVKNGDACFVKMLPTKPMVVETFSEYPPLGRFAVRDMRQTVAVGVIKSVEKKDPSGAKVTKSAAKKK

SEQ ID NO: 4567 - protein, 449 aa, Triphysaria pusilla
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPDKINFVPISGFEGDNMIERSTNLDWYKGPTLLEALDMISEPKRPSDKPLRLPLQDVYKIGGIGTVPVGRVETGIIKPGMLVTFAPSGLTTEVKSVEMHHEALQEALPGDNVGFNVKNVAVKDLKRGYVASNSKDDPAKEAANFTSQVIIMNHPGQIGQGYAPVLDCHTSHIAVKFAELVTKIDRRSGKELEKEPKFLKNGDAGMVKMVPTKPMVVETFAAYPPLGRFAVRDMRQTVAVGVIKSVEKKDPSGAKVTKAAAKKGAK

SEQ ID NO: 4568 - protein, 449 aa, Triphysaria pusilla
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPDKINFVPISGFEGDNMIERSTNLDWYKGPTLLEALDMISEPKRPSDKPLRLPLQDVYKIGGIGTVPVGRVETGVIKPGMLVTFAPSGLTTEVKSVEMHHEALQEALPGDNVGFNVKNVAVKDLKRGYVASNSKDDPAKEAANFISQVIIMNHPGQIGQGYAPVLDCHTSHIAVKFAELVTKIDRRSGKELEKEPKFLKNGDAGMVKMVPTKPMVVETFAQYPPLGRFAVRDMRQTVAVGVIKSVEKKDPSGAKVTKAAAKKGAK

SEQ ID NO: 4569 - protein, 450 aa, Valeriana officinalis
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLISEPKRPSDKPLRLPLQDVYKIGGIGTVPVGRVETGTIKPGMVVTFGPSGLTTEVKSVEMHHESLTEALPGDNVGFNVKNVAVKDLKRGYVASNSKDDPAKEAANFTSQVIIMNHPGQIGNGYAPVLDCHTSHIAVKFGSLLTKIDRRSGKEIEKEPKFLKNGDAGMVKMIPTKPMVVETFSEYPPLGRFAVRDMRQTVAVGVIKSVEKKEPSGAKVTKAAAKKGAGK

SEQ ID NO: 4570 - protein, 449 aa, Vinca minor
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSSNLDWYKGPTLLDALDQISEPKRPSDKPLRLPLQDVYKIGGIGTVPVGRVETGVIKPGILVTFGPTGLTTEVKSVEMHHEALTEALPGDNVGFNVKNVAVKDLKRGYVASNSKDDPAKGAASFTSQVIIMNHPGQIGNGYAPVLDCHTSHIAVKFAEILTKIDRRSGKEIEKEPKFLKNGDAGMVKMIPTKPMVVETFAEYPPLGRFAVRDMRQTVAVGVIKSVDKKDPTGAKVTKAAVKKGAK

SEQ ID NO: 4571 - protein, 449 aa, Vinca minor
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSSNLDWYKGPTLLDALDQISEPKRPSDKPLRLPLQDVYKIGGIGTVPVGRVETGVIKPGILVTFGPTGLTTEVKSVEMHHEALTEALPGDNVGFNVKNVAVKDLKRGYVASNSKDDPAKGAASFTSQVIIMNHPGQIGNGYAPVLDCHTSHIAVKFAEILTKIDRRSGKEIEKEPKFLKNGDAGMVKMIPTKPMVVETFAEYPPLGRFAVRDMRQTVAVGVIKNVDKKDPTGAKVTKAAVKKGAK

SEQ ID NO: 4572 - protein, 449 aa, Citrullus lanatus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPSDKPLRLPLQDVYKIGGIGTVPVGRVETGVLKPGMVVTFGPSGLTTEVKSVEMHHEALPEAVPGDNVGFNVKNVAVKDLKRGFVASNSKDDPAKEAANFTSQVIIMNHPGQIGNGYAPVLDCHTSHIAVKFAEIQTKIDRRSGKELEKEPKFLKNGDAGMIKMVPTKPMVVETFSQYPPLGRFAVRDMRQTVAVGVIKSVEKKDPSGAKVTKSAVKKGGK

SEQ ID NO: 4573 - protein, 178 aa, Panicum virgatum
MPGFRTPVSTRPTGTVPMPPILYTSCRGRRRGLSDGRFGSLIWSSASRRVGPLYQSRFVDLSIMLSPSNPEMGTKGILSGLYPTFFRYDATSFTISSYRDLEYLGVYVVTLLQQQIICLTPSVKARRACSRVWPSLEIPASKPPVVESMMSTAQSAWEVPVIMFLMKSRCPGASITVQ

SEQ ID NO: 4574 - protein, 199 aa, Ambrosia trifida
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPRKSHLSHLWFEVTT

SEQ ID NO: 4575 - protein, 63 aa, Brassica juncea
MGKEKFHINIVVIGHVDSGKSTTTGHLIYKLGGIDKRVIERFEKEAAEMNKRSFKYACVVGQT

SEQ ID NO: 4576 - protein, 272 aa, Brassica juncea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFALQG

SEQ ID NO: 4577 - protein, 177 aa, Fagus grandifolia
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPSTPRLGTMKLLRKSHPI

SEQ ID NO: 4578 - protein, 163 aa, Ricinus communis
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVMVNYSQVL

SEQ ID NO: 4579 - protein, 165 aa, Gossypium raimondii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVNSQILKGKVR

SEQ ID NO: 4580 - protein, 177 aa, Phalaenopsis aphrodite
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATPPSIQRLGMMKSSRKSPPI

SEQ ID NO: 4581 - protein, 109 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNHDYWYFSG

SEQ ID NO: 4582 - protein, 164 aa, Gossypium raimondii
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVKIIICLHFP

SEQ ID NO: 4583 - protein, 446 aa, Ambrosia trifida
GKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAVKKGAK

SEQ ID NO: 4584 - protein, 447 aa, Aquilegia formosa
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDNISEPKRPTDKPLRLPLQDVYKIGGIGTVPVGRVETGVLKPGMVVTFGPTGLTTEVKSVEMHHEALTEALPGDNVGFNVKNVAVKDLKRGYCASNSKDDPAREAANFTSQVIIMNHPGQIGNGYAPVLDCHTCHIAVKFGEILTKIDRRSGKELEKEPKFLKNGDAGFVKMFPTKPMVVETFSEYPPLGRFAVRDMRQTVAVGVIKSVEKKDPSGAKVTKSAAKKK

SEQ ID NO: 4585 - protein, 449 aa, Arnica chamissonis
MGKEKIHVSIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVRQMICCCNKMDATTPKYSKSRYEEIVKEVSSYMKKVGYNPDKIPFVPISGFEGDNMIERSTNLDWYKGPTLLEALDQIYEPKRPSDKPLRLPLQDVYKIGGIGTVPVGRVETGVIKPGMVVTFGPTGLTTEVKSVEMHHEALTEALPGDNVGFNVKNVAVKDLKRGYVASNSKDDPAKGAASFTSQVIIMNHPGQIGNGYAPVLDCHTSHIAVKFKELLTKIDRRSGKELEKEPKFLKNGDAGMVQMIPTKPMVVETFAEYPPLGRFAVRDMRQTVAVGVIKSVDKKDPTGAKVTKAAVKKGVK

SEQ ID NO: 4586 - protein, 449 aa, Unknown
  Sequence found in Organisms: Brassica napus, Brassica juncea, Brassica rapa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4587 - protein, 448 aa, Brassica juncea
MGKEKFHINIVVIGHVDSGKSTTTGHLIYKLGGIDKRVIERFEKEAAEMNKRSFKYAWVLDKLKAERERGITIDIALWKFGTTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGA

SEQ ID NO: 4588 - protein, 447 aa, Distylium racemosum
MGKEKTHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKGRYEEIVKEVSSYLKKVGYNPDKIPFVPISGFEGDNMIERSSNLDWYKGPTLLEALDQVSEPKRPTDKPLRLPLQDVYKIGGIGTVPVGRVETGVLKPGTVVTFGPTGLTTEVKSVEMHHEALQEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAGFVKMVPTKPMVVETFSEYPPLGRFAVRDMRQTVAVGVIKAVEKKDPTGAKVTKAAAKKK

SEQ ID NO: 4589 - protein, 447 aa, Epimedium sagittatum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYLKKVGYNPDKIPFVPISGFEGDNMIERSTNLDWYKGPTLLDALDQISEPKRPTDKPLRLPLQDVYKIGGIGTVPVGRVETGIIKPGMVCTFGPSGLTTEVKSVEMHHEALQEALPGDNVGFNVKNVAVKDLKRGYVASNSKDDPAKEAANFTSQVIIMNHPGQIGNGYAPVLDCHTCHIAVKFQEILTKIDRRSGKELEKEPKFLKNGDAGFVKMIPTKPMVVETFSEYPPLGRFAVRDMRQTVAVGVIKSVEKKDPSGAKVTKSAAKKK

SEQ ID NO: 4590 - protein, 449 aa, Euonymus alatus
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQVSEPKRPTDKPLRLPLQDVYKIGGIGTVPVGRVETGILKPGMVVTFGPSGLTTEVKSVEMHHEALQEALPGDNVGFNVKNVAVKDLKRGFVASNSKDDPAKEAANFTAQVIIMNHPGQIGGGYAPVLDCHTSHIAVKFAELLTKIDRRSGKELEKEPKFLKNGDAGFVKMIPTKPMVVETFSEYPPLGRFAVRDMRQTVAVGVIKAVEKKDPSGAKVTKSAAKKGGK

SEQ ID NO: 4591 - protein, 447 aa, Euonymus alatus
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDQISEPKRPSDKPLRLPLQDVYKIGGIGTVPVGRVETGILKPGTVVTFGPTGLTTEVKSVEMHHEALQEALPGDNVGFNVKNVAVKDLKRGFVASDSKNDPAKGAASFTSQVIIMNHPGQIGNGYAPVLDCHTSHIAVKFAEILTKIDRRSGKEIEKEPKFLKNGDAGIVKMIPTKPMVVETFSAYPPLGRFAVRDMRQTVAVGVVKSVDKKEASAAKVTKSAAKKK

SEQ ID NO: 4592 - protein, 447 aa, Marchantia polymorpha
MGKEKFHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKGRFEEISKEVSNYLKKVGYNPDKIPFVPISGFEGDNMIERSTNLDWYKGPTLLDALDNISEPKRPSDKPLRLPLQDVYKIGGIGTVPVGRVETGVIKPGMVVCFAPTGLTTEVKSVEMHHEALLEALPGDNVGFNVKNVAVKDLKRGFVASDSKNDPAKEAANFTSQVIIMNHPGQIGNGYAPVLDCHTSHIAVKFAEILTKVDRRSGKEIEKEPKFLKNGDAGFVKMIPTKPMTVETFAEYPPLGRFAVRDMRQTVAVGVIKAVEKKEPTGAKVTKAAAKKK

SEQ ID NO: 4593 - protein, 438 aa, Tropaeolum majus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARFDEITKEVSSYLKKVGYNPDKIAFVPISGFEGDNMIERSTNLDWYKGPTLLEALDLINEPKRPSDKPLRLPLQDVYKIGGIGTVPVGRVETGVVKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFGEILTKIDRRSGKELEKEPKFLKNGDAGMVKMIPSKPMVVETFATYPPLGRFAVRDMRQTVAVGVIKSVEKKDPTGAK

SEQ ID NO: 4594 - protein, 447 aa, Avena sativa
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKGRFEEIVKEVGSYLKKVGYNPDKVPFVPISGFEGDNMIERSSNLDWYKGPTLLEALDQINEPKRPSDKPLRLPLQDVYKIGGIGTVPVGRVETGVIKPGMLVTFGPTGLTTEVKSVEMHHESMLEAVPGDNVGFNVKNVAVKDIKRGYVASNAKDDPAKEAANFVAQVIIMNHPGQIGNGYAPVLDCHTSHIAVKFSEIQTKVDRRSGKEIEAFPKFLKNGDAGFVKMIPTKPMVVETFSQYPPLGRFAVRDMRQTVAVGVIKSVEKKEPTGAKVTKAAAKKK

SEQ ID NO: 4595 - protein, 447 aa, Avena sativa
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVRQMICCCNKMDATTPKYSKSRFEEIVKEVGSYLKKVGYNPDKIPFVPISGFEGDNMIERSTNLDWYKGPTLLEALDQVNEPKRPSDKPLRLPLQDVYKIGGIGTVPVGRVETGVIKPGMLVTFGPTGLTTEVKSVEMHHESMLEALPGDNVGFNVKNVAVKDIKRGYVASNAKDDPAKEAANFVAQVIIMNHPGQIGNGYAPVLDCHTSHIAVKFSEIQTKVDRRSGKEIEAFPKFLKNGDAGFVKMIPTKPMVVETFSQYPPLGRFAVRDMRQTVAVGVIKSVEKKDPTGAKVTKAAAKKK

SEQ ID NO: 4596 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDQIQEPKRPSDKPLRLPLQDVYKIGGIGTVPVGRVETGIIKPGMVVTFGPTGLSTEVKSVEMHHEALLEALPGDNVGFNVKNVAVKDLKRGFVASNSKDDPAKEAANFTAQVIIMNHPGQIGNGYAPVLDCHTCHIAVKFAEILTKIDRRSGKELEKEPKFLKNGDAGMIKMIPTKPMVVESFSEYPPLGRFAVRDMRQTVAVGVIKSVEKKDPSGAKVTKSAAKKGAK

SEQ ID NO: 4597 - protein, 447 aa, Sequoia sempervirens
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAILIIDSTTGGFEAGISKDGQTREHALLAFTLGVRQMICCCNKMDATTPKYSKARYDEIVKEVSSYLKKVGYNPEKIPFVPISGFEGDNMIERSSNLDWYKGPTLLDALDQVNEPKRPSDKPLRLPLQDVYKIGGIGTVPVGRVETGVLKPGTVVTFGPTGLTTEVKSVEMHHEALQEALPGDNVGFNVKNVAVKDLKRGYVASDSKNDPAKEAANFTAQVIIMNHPGQIGNGYAPVLDCHTCHIAVKFAEILTKVDRRSGKELEKEPKFLKNGDAGFVKMIPTKPMVVETFSEYPPLGRFAVRDMRQTVAVGVIKSVEKKDPTGAKVTKAAIKKK

SEQ ID NO: 4598 - protein, 447 aa, Taxus baccata
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSSNLDWYKGPTLLDALDQVSEPKRPSDKPLRLPLQDVYKIGGIGTVPVGRVETGVIKPGMVVTFGPSGLTTEVKSVEMHHEALLEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAAFVKMIPTKPMVVETFSEYPPLGRFAVRDMRQTVAVGVIKAVEKKEPSGAKVTKAAAKKK

SEQ ID NO: 4599 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQIQEPKRPSDKPLRLPLQDVYKIGGIGTVPVGRVETGVIKPGTVVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGMIKMIPTKPMVVETFSEYPPLGRFAVRDMRQTVAVGVIKSVEKKDASSAKVTKSAAKKGGK

SEQ ID NO: 4600 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQIQEPKRPSDKPLRLPLQDVYKIGGIGTVPVGRVETGIIKPGMVVTFGPTGLSTEVKSVEMHHEALQEALPGDNVGFNVKNVAVKDLKRGFVASNSKDDPAKEAANFTAQVIIMNHPGQIGNGYAPVLDCHTSHIAVKFAEILTKIDRRSGKELEKEPKFLKNGDAGMIKMIPTKPMVVESFSEYPPLGRFAVRDMRQTVAVGVIKSVEKKEPSGAKVTKSAAKKGGK

SEQ ID NO: 4601 - protein, 83 aa, Prunus persica
MLTSLTVLGNTSFKTSSGGVNNEDSTVSLGSSSNHVLNEVTMSGSINDSAVVLVSFKLPEGNINGNTTLTLGLELVKHPGILE

SEQ ID NO: 4602 - protein, 264 aa, Cicer arietinum
MGKEEVTYQQLSSLDIVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGVLELCQSDVLRLESSSLV

SEQ ID NO: 4603 - protein, 105 aa, Ricinus communis
MSRTAKRPNGGYSEKVSTTMGLVGIIFTNPASPFFKNLGSFSSSLPDRRSILVKISANFTAMWEVWQSKTGAYPFPIWPGWFMMITWDVKLAASLAGSSLEFDAT

SEQ ID NO: 4604 - protein, 101 aa, Brassica juncea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKT

SEQ ID NO: 4605 - protein, 348 aa, Musa acuminata
MITGTSQADCAVLSIDSTTGGFEAGISKDGQTREHALLAFTLGVKQMICCCNKMDATTPKYSKARYDEIVKEVSSYLKKIGYNPDKIPFVPISGFEGDNMIERSTNLDWYKGPTLLDALDMIQEPKRPSDKPLRLPLQDVYKIGGIGTVPVGRVETGILKPGMVVTFGPTGLTTEVKSVEMHHEALQEAFPGDNVGFNVKNVAVKDLKRGFVASNSKEDPAKEAASFTSQVIIMNHPGQIGNGYAPVLDCHTSHIAVKFAELLTKIDRRSSKELEKEPKFLKNGDAGFVKMIPTKPMVVETFSEYPPLGRFAVRDMRQTVAWVLSRQLRRRILLVPRSPKLLPRRNEL

SEQ ID NO: 4606 - protein, 186 aa, Fraxinus spp
MVVTFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFSEYPPLGRFAVRDMRQTVAVGVIKSVDKKDPSGAKVTKAAAKKGAK

SEQ ID NO: 4607 - protein, 361 aa, Zea mays
MVIDNITIEAKPNIYSVVRNHEHNSPNLHNEPMKIILLLTTTSTTQQNTPTSKETRNHGLHAESSSFLLGSRLGHLGSRWVLLLHALYHADRNRLPHVANREAPQWRILGESLHHHGLRGDHLDEAGVTVLEELGGALQLLARPPVNLGEQLRELHGDVGRVAVQHRGVAVADLPRVVHDDHLRGEAGSLLGGVVLGVGGHVAALQVLDRHVLDVEADVVAGQCLLHRLVVHLHRLDLRRQARGRKGDHHAGLQEPSFHAAHRDGADAADLVHVLQRKPQGLVRGPLGLVDLVQRLKEGGALVPVQVRRPLDHVVTLEPRDGHEGDLVRVVPHLLQVGTHFLDDLVVPSLGVLGGSGIHLI

SEQ ID NO: 4608 - protein, 62 aa, Glycine max
MSLTAKRPRGGYSEKVSTTMGLVGIILTIPASPFFKNLGSFSSSLPDRLSILVKISENLTAM

SEQ ID NO: 4609 - protein, 151 aa, Glycine max
MCLCKRFMVHLHRLDFSCQSSWCKSHHHSRLQDTGLNTSHWHSSNTSNLVHILKGKPEGLVRGPLGLTNLVKCIKQSWTLVPVKVCGPLNHVVSLKTRDRNKRNLVRVVSYFLQVGRDFLHNFIIPGLGILGRDIIYFVTAANHLFHTKGE

SEQ ID NO: 4610 - protein, 152 aa, Taxus baccata
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAIYTGSEANDLLL

SEQ ID NO: 4611 - protein, 156 aa, Ricinus communis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVK

SEQ ID NO: 4612 - protein, 449 aa, Mimulus guttatus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDMISEPKRPTDKPLRLPLQDVYKIGGIGTVPVGRVETGVLKPGMLVTFGPTGLTTEVKSVEMHHESMPEALPGDNVGFNVKNVAVKDLKRGFVASNSKDDPAREAAHFTSQVIIMNHPGQIGSGYAPVLDCHTCHIAVRFAELVTKIDRRSGKEIEREPKFLKNGDAGFVKMFPTKPMVVETFSEYPPLGRFAVRDMRQTVAVGVIKSVEKKDPTGAKVTKAAAKKGAK

SEQ ID NO: 4613 - protein, 449 aa, Olea europaea
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPEKIPFVPISGFEGDNMIERSTSLDWYKGPTLLEALDMLLEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKGAANFTSQVIIMNHPGQIGNGYAPVLDCHTSHIAVKFAELITKIDRRSGKELEKEPKFLKNGDAGFVKMIPTKPMVVETFSEYPPLGRFAVRDMRQTVAVGVIKSVDKKDPSGAKVTKAAAKKGAK

SEQ ID NO: 4614 - protein, 449 aa, Brassica juncea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSEKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4615 - protein, 449 aa, Brassica juncea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSRDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4616 - protein, 449 aa, Brassica rapa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKHPTGAKVTKAAVKKGAK

SEQ ID NO: 4617 - protein, 449 aa, Lactuca sativa
MGKEKTHVNIVVIGHVDSGKSTTTGHLIYKLGGIDKRVIEKFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDAINEPKRPSDKPLRLPLQDVYKIGGIGTVPVGRVETGVIKPTMLVTFGPSGLTTEVKSVEMHHEALQEALPGDNVGFNVKNVSVKDLKRGYVASNSKDDPCKGAANFTSQVIIMNHPGQIGNGYAPVLDCHTSHIAVKFAEILTKIDRRSGKELEKEPKFLKNGDAGMIKMIPTKPMVVETFSEYPPLGRFAVRDMRQTVAVGVIKSVEKKDPTGAKVTKAAAKKGGK

SEQ ID NO: 4618 - protein, 450 aa, Medicago truncatula
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVFNIFSPPKYSKSRYDEIVKEVSSYMKKVGYNPDKIPFVPISGFEGDNMIERSTNLDWYKGPTLLEALDQINEPKRPSDKPLRLPLQDVYKIGGIGTVPVGRVETGVIKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPSGGLKQTKSAAKKK

SEQ ID NO: 4619 - protein, 448 aa, Pinus taeda
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGTVVTFGPTGLTTEVKSVEMHHEALLEALPGDNVGFNVKNVAVKDLKRGYVASDSKNDPAKEAANFTSQVIIMNHPGQISNGYAPVLDCHTCHIAVKFAEIMTKVDRRSGKEIEKEPKFLKNGDAGFIKMIPSKPMVVETFSEYPPLGRFAVRDMRQTVAVGVIKGVEKKEPTGAKITKAAVKKGK

SEQ ID NO: 4620 - protein, 449 aa, Plantago ovata
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVSSYMKKVGYNPDKIPFVPISGFEGDNMIERSTNLDWYKGPTLLEALDMIHEPKRPSDKPLRLPLQDVYKIGGIGTVPVGRVETGVIKPGMVVTFGPSGLTTEVKSVEMHHEALPEALPGDNVGFNVKNVAVKDLKRGYVASNSKDDPAKGAANFTSQVIIMNHPGQIGQGYAPVLDCHTSHIAVKFAELLTKIDRRSGKELEKEPKFLKNGDAGMVKMLPTKPMVVETFSEYPPLGRFAVRDMRQTVAVGVIKSVDKKDPSGAKVTKAAAKKGAK

SEQ ID NO: 4621 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLDALDQIQEPKRPSDKPLRLPLQDVYKIGGIGTVPVGRVETGVIKPGTVVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGMIKMIPTKPMVVETFSEYPPLGRFAVRDMRQTVAVGVIKNVEKKDASSAKVTKSAVKKGGK

SEQ ID NO: 4622 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLDALDQIQEPKRPSDKPLRLPLQDVYKIGGIGTVPVGRVETGIIKPGMVVTFGPTGLSTEVKSVEMHHEALLEALPGDNVGFNVKNVAVKDLKRGFVASNSKDDPAKEAANFTAQVIIMNHPGQIGNGYAPVLDCHTCHIAVKFAEILTKIDRRSGKELEKEPKFLKNGDAGMIKMIPTKPMVVESFSEYPPLGRFAVRDMRQTVAVGVIKSVEKKEPSGAKVTKSAAKKGGK

SEQ ID NO: 4623 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLDALDQIQEPKRPSDKPLRLPLQDVYKIGGIGTVPVGRVETGVIKPGTVVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGMIKMIPTKPMVVETFSEYPPLGRFAVRDMRQTVAVGVIKNVEKKDASSAKVTKSAAKKGGK

SEQ ID NO: 4624 - protein, 445 aa, Helianthus annuus
KIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIENGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4625 - protein, 448 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVSSYMKKVGYNPDKIPFVPISGFEGDNMIERSTNLDWYKGPTLLEALDQINEPKRPSDKPLRLPLQDVYKIGGIGTVPVGRVETGTMKPGMVVTFAPTGLQTEVKSVEMHHESLTEALPGDNVGFNVKNVAVKDLKRGYVASNTKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKAVEKKEAGAAAKFTKSALKKK

SEQ ID NO: 4626 - protein, 119 aa, Ambrosia trifida
TSITKKSKNGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADA

SEQ ID NO: 4627 - protein, 302 aa, Brassica juncea
MICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4628 - protein, 221 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLEWYKGPPFLRPST

SEQ ID NO: 4629 - protein, 275 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDNISEPKRPSDKPLRLPLQDVYKIGGIGTVPVGRVETGVIKPGMVVTFWTHRFDH

SEQ ID NO: 4630 - protein, 147 aa, Vinca minor
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGLKLVSLRMVRLVSTPYLPSLLVSSR

SEQ ID NO: 4631 - protein, 442 aa, Cicer arietinum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGFVVTFAPTGLSTEVKSVEMHHEALTEALPGDNVGFNVKNVAVKDLKRGYVASNSKDDPAKEAANFTSQVIIMNHPGQIGNGYAPVLDCHTSHIAVKFAELITKIDRRSGKEIEKEPKFLKNGDAGLVKMIPTKPMVVETFAEYPPLGRFAVRDMRQTVAVGVIKSVEKKEPSGVKPKKK

SEQ ID NO: 4632 - protein, 447 aa, Zostera marina
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQISEPKRPSDKPLRLPLQDVYKIGGIGTVPVGRVETGIIKPGMVCTFGPSGLTTEVKSVEMHHESMLQALPGDNVGFNVKNVAVKDLKRGYVASDSKNDPAKGAANFTSQVIIMNHPGQIGNGYAPVLDCHTSHIAVKFAEILTKIDRRSGKEIEKEPKFLKNGDAGFVKMLPTKPMVVETFSQYPPLGRFAVRDMRQTVAVGVIKSVEKKEPTSAKVTKSAIKKK

SEQ ID NO: 4633 - protein, 447 aa, Cephalotaxus harringtonia
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSSNLDWYKGPTLLDALDQISEPKRPTDKPLRLPLQDVYKIGGIGTVPVGRVETGVLKPGMLVTFGPSGLTTEVKSVEMHHEALQEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAGFVKMVPTKPMVVETFSDYPPLGRFAVRDMRQTVAVGVIKSVEKKDPTGAKVTKAAAKKK

SEQ ID NO: 4634 - protein, 444 aa, Euonymus alatus
EKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKEAASFTSQVIIMNHPGQIGNGYAPVLDCHTSHIAVKFAEILTKIDRRSGKELEKEPKFLKNGDAGMVKMIPTKPMVVETFSAYPPLGRFAVRDMRQTVAVGVIKSVDKKEASAAKVTKSAAKKK

SEQ ID NO: 4635 - protein, 447 aa, Gnetum gnemon
MGKEKTHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQVHEPKRPSDKPLRLPLQDVYKIGGIGTVPVGRVETGILKPGAVVTFGPTGLTTEVKSVEMHHEALQEALPGDNVGFNVKNVAVKDLKRGFVASDSKNDPAKEAASFTSQVIIMNHPGQISNGYAPVLDCHTSHIAVKFAEITTKVDRRSGKELEKEPKFLKNGDAGFIKMIPSKPMVVETFSEYPPLGRFAVRDMRQTVAVGVIKAVEKKEPTGAKVTKAAAKKK

SEQ ID NO: 4636 - protein, 447 aa, Elaeis guineensis
MGKAKVHINIVIIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDMIQEPKRPSDKPLRLPLQDVYKIGGIGTVPVGRVETGILRPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFSELLSKIDRRSGKELEKEPKFLKNGDAGFVKMIPTKPMVVETFSEYSPLGRFAVRDMRQTVAVGVIKSVEKKDPTGAKITKAAQKKK

SEQ ID NO: 4637 - protein, 447 aa, Sciadopitys verticillata
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVRQMICCCNKMDATTPKYSKARYEEIVKEVSSYMKKVGYNPDKIPFVPISGFEGDNMIERSTNLDWYKGPTLLDALDQISEPKRPTDKPLRLPLQDVYKIGGIGTVPVGRVETGVLKPGMLVTFGPTGLTTEVKSVEMHHEALLEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAGFVKMVPTKPMVVETFSEYPPLGRFAVRDMRQTVAVGVIKAVEKKEPSGAKVTKAAAKKK

SEQ ID NO: 4638 - protein, 447 aa, Picea glauca
MGKEKTHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIVKEVSSYLKRVGYNPDKIPFVPISGFEGDNMIERSTNLDWYKGPTLLEALDQVSEPKRPTDKPLRLPLQDVYKIGGIGTVPVGRVETGIIKPGTIVTFGPTGLTTEVKSVEMHHEALQEAYPGDNVGFNVKNVAVKDLKRGYVASDSKNDPAKEAANFTAQVIIMNHPGQIGNGYAPVLDCHTCHIAVKFSEIMTKVDRRSGKELEKEPKFLKNGDAGFVKMIPTKPMVVETFAEYPPLGRFAVRDMRQTVAVGVIKAVEKKDPTGAKVTKAAAKKK

SEQ ID NO: 4639 - protein, 442 aa, Tripterygium wilfordii
THINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDMINEPKRPSDKPLRLPLQDVYKIGGIGTVPVGRVETGVVKPGMVVTFGPTGLTTEVKSVEMHHEALLEALPGDNVGFNVKNVAVKDLKRGFVASDSKNDPAKGAASFTSQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDASGAKVTKSAAKKK

SEQ ID NO: 4640 - protein, 65 aa, Eucalyptus grandis
MSLTAKRPRGGYSEKVSTTIGLVGIIFTIPASPFFKNLGSFSSSLPDRLSILVSNSENFTAMWEV

SEQ ID NO: 4641 - protein, 98 aa, Eutrema halophilum
MLSTTLSGNYGFPLCISGIAQKFSVSKEMADHDKRRKGMKKRMRSEGKDESRSHGEEEMGVERFDELWLRENEDVRDLVALFQDLGFWSVSSHTAKAA

SEQ ID NO: 4642 - protein, 62 aa, Aquilegia formosa
MSRTAKRPRGGYSENVSTTIGFVGIILTYPASPFFKNLGSFSSSFPERLSILVVISANFTAM

SEQ ID NO: 4643 - protein, 156 aa, Brassica rapa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVS

SEQ ID NO: 4644 - protein, 178 aa, Brassica rapa
MISSYLALEYLGVKLANLVTAANHLLDTKGEGKKSMLTGLTILGDTSLKTSGGRVNDKNSTISLGGTSNHVLDEITMSRGINDSAVVLGGLELPESNINGDTTLTLSLKFVQHPRVLEGPLVHLSSLLLEPLDDTLVNTTKLVDQVTSCSRFARVDMANDHNVDVKLLFTHSCKSKKS

SEQ ID NO: 4645 - protein, 156 aa, Brassica rapa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKVN

SEQ ID NO: 4646 - protein, 65 aa, Theobroma cacao
MSLTAKRPNGGYSENVSTTMGLVGTIFTIPASPFFKNLGSFSSSLPDRLSILVNNSANLTAMWEV

SEQ ID NO: 4647 - protein, 198 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFRGDHEGGVLLPEEGGIQPRQDPVCAHLWVRG

SEQ ID NO: 4648 - protein, 254 aa, Avena sativa
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKGRFEEIVKEVGSYLKKVGYNPDKVPFVPISGFEGDNMIERSSNLDWYKGPTLLEALDQINEPKRPSDKPLAFPSGCLQDWWHWNCASGAC

SEQ ID NO: 4649 - protein, 198 aa, Primula obconica
EKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALFAFTLGVKQMICCCNKMDATTPKYSKSRYEEIVKEVSSYLKKVGYNPDQNPICAHLPDLKVTT

SEQ ID NO: 4650 - protein, 123 aa, Primula obconica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGF

SEQ ID NO: 4651 - protein, 105 aa, Solanum lycopersicum
MSLTAKRPNGGYSAKVSTTMGLVGIILTIPASPFFKNLGSFSSSLPERLSILVKISANLTAMWEVWQSSTGAYPFPIWPGWFIMMTWAVKLAAPLAGSSSEFEAT

SEQ ID NO: 4652 - protein, 449 aa, Olea europaea
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQILEPKRPSDKPLRLPLQDVYKIGGIGTVPVGRVETGVLKPGMVVTFGPTGLTTEVKSVEMHHEALSEALPGDNVGFNVKNVSVKDLKRGYVASDSKNDPAKGAESFTSQVIIMNHPGQIGNGYAPVLDCHTSHIAVKFAELLTKIDRRSGKELEKEPKFLKNGDSGMVKMIPTKPMVVETFSEYPPLGRFAVRDMRQTVAVGVIKNVDKKEPTGAKVTKAAAKKGAK

SEQ ID NO: 4653 - protein, 447 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFEEITKEVSSYLKKVGYNPDKIPFVPISGFEGDNMIERSSNLDWYKGPTLLEALDAVTEPKRPSDKPLRLPLQDVYKIGGIGTVPVGRVETGVIKPGMLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKDATGAKVTKAAAKKK

SEQ ID NO: 4654 - protein, 449 aa, Cucumis sativus
MGKEKVHINIVVIGHVDSGKSTTTGHLIYKLGGIDKRVIERFEKEAAEMNKRSFKYAWVLDKLKAERERGITIDIALWKFETAKYYCTVIDAPGHRDFIKNMITGTSQADCAVLIIDSTTGGFEAGISKDGQTREHALLAFTLGVRQMICCCNKMDATTPKYSKSRYDEIVKEVSSYLKKVGYNPDKIPFVPISGFEGDNMIERSTNLDWYKGPTLLEALDQVHEPKRPSDKPLRLPLQDVYKIGGIGTVPVGRVETGIIKPGMVVTFAPTGLTTEVKSVEMHHEALQEALPGDNVGFNVKNVAVKDLKRGYVASNSKDDPAKEAASFTSQVIIMNHPGQIGNGYAPVLDCHTSHIAVKFGEILTKIDRRSGKELEKEPKFLKNGDAGFVKMIPTKPMVVETFSEYPPLGRFAVRDMRQTVAVGVIKSVEKKDPSGAKVTKSAAKKSGK

SEQ ID NO: 4655 - protein, 449 aa, Eucalyptus grandis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLILEPKRPTDKPLRLPLQDVYKIGGIGTVPVGRVETGILKPGMVVTFGPSGLTTEIKSVEMHHEALQEALPGDNVGFNVKNVAVKDLKRGYVASNSKDDPAKEAATFTSQVIIMNHPGQIGNGYAPVLDCHTSHIAVKFSEILTKIDRRSGKELEKEPKFLKNGDAGFVKMIPTKPMVVETFSEYPPLGRFAVRDMRQTVAVGVIKSVEKKDPSGAKVTKSAAKKGGK

SEQ ID NO: 4656 - protein, 445 aa, Fraxinus spp
KIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYIKKVGYNPDKIPFVPISGFEGDNMIERSTNLDWYKGPTLLDALDQILEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFAEYPPLGRFAVRDMRQTVAVGVIKSVDKKDPSGAKVTKAAAKKGAK

SEQ ID NO: 4657 - protein, 447 aa, Marchantia polymorpha
MGKEKFHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKGRYDEIIKEVANYLKKVGYNPDKIPFVPISGFEGDNMIERSTNLDWYKGPTLLEALDSISEPKRPSDKPLRLPLQDVYKIGGIGTVPVGRVETGVIKPGMLVTFAPTGLTTEVKSVEMHHEALLEALPGDNVGFNVKNVAVKDLKRGFVASDSKNDPAKEAANFTSQVIIMNHPGQIGNGYAPVLDCHTSHIAVKFSEILTKVDRRSGKEIEKEPKFLKNGDAGFVKMIPTKPMTVETFAEYPPLGRFAVRDMRQTVAVGVIKAVEKKEPSGAKVTKAAAKKK

SEQ ID NO: 4658 - protein, 448 aa, Medicago truncatula
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKVFEATTPKYSKSRYDEIVKEVSSYMKKVGYNPDKIPFVPISGFEGDNMIERSTNLDWYKGPTLLEALDQINEPKRPSDKPLRLPLQDVYKIGGIGTVPVGRVETGTMKPGMVVTFAPTGLQTEVKSVEMHHESLTEALPGDNVGFNVKNVSVKDLKRGYVASNTKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKEPGTAKITKSAAKKK

SEQ ID NO: 4659 - protein, 447 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDMVQEPKRPLDKPLRLPLQDVYKIGGIGTVPVGRVETGILKPGMVVTFGPSGLTTEVKSVEMHHEALQEALPGDNVGFNVKNVAVKDLKRGYVASNSKDDPAKGAASFTAQVIIMNHPGQIGNGYAPVLDCHTSHIAVKFAELLTKIDRRSGKELEKEPKFLKNGDAGFVKMIPTKPMVVETFSEYPPLGRFAVRDMRQTVAVGVIKSVDKKDASGAKITKAAQKKK

SEQ ID NO: 4660 - protein, 449 aa, Olea europaea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQISEPKRPLDKPLRLPLQDVYKIGGIGTVPVGRVETGVLKPGMVVTFGPTGLTTEVKSVEMHHEALSEALPGDNVGFNVKNVSVKDLKRGYVASDSKNDPAKGAESFTSQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKNVDKKEPSGAKVTKAAAKKGAK

SEQ ID NO: 4661 - protein, 449 aa, Olea europaea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQISEPKRPLDKPLRLPLQDVYKIGGIGTVPVGRVETGVLKPGMVVTFGPTGLTTEVKSVEMHHEALSEALPGDNVGFNVKNVSVKDLKRGYVASDSKNDPAKGAESFTSQVIIMNHPGQIGNGYAPVLDCHTSHIAVKFAELLTKIDRRSGKELEKEPKFLKNGDAGMVKMIPTKPMVVETFSEYPPLGRFAVRDMRQTVAVGVIKNVDKKEPSGAKVTKAAAKKGVK

SEQ ID NO: 4662 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLDALDQIQEPKRPSDKPLRLPLQDVYKIGGIGTVPVGRVETGVIKPGTIVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGMIKMIPTKPMVVETFSQYPPLGRFAVRDMRQTVAVGVIKNVEKKDASSAKVTKSAVKKGGK

SEQ ID NO: 4663 - protein, 449 aa, Populus trichocarpa
MGKEKSHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLDALDQIQEPKRPSDKPLRLPLQDVYKIGGIGTVPVGRVETGVIKPGTIVTFGPTGLTTEVKSVEMHHEALQEALPGDNVGFNVKNVAVKDLKRGFVASNSKDDPAKEAANFTSQVIIMNHPGQIGNGYAPVLDCHTCHIAVKFAEILTKIDRRSGKELEKEPKFLKNGDAGMIKMIPTKPMVVETFSEYPPLGRFAVRDMRQTVAVGVIKNVEKKDASSAKVTKSAVKKGGK

SEQ ID NO: 4664 - protein, 449 aa, Primula obconica
MGKEKVHISLVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYEEIVKEVSSYLKKVGYNPEKVPFVPISGFEGDNMIERSTNLDWYKGPTLLDALDQVSEPKRPSDKPLRLPLQDVYKIGGIGTVPVGRVETGVIKPGMVVTFGPSGLTTEVKSVEMHHESLLEAHPGDNVGFNVKNVAVKDLKRGYVASNSKDDPAKGAASFTAQVIIMNHPGQIGNGYAPVLDCHTSHIAVKFSEILTKIDRRSGKELEKEPKFLKNGDAGMVKMIPTKPMVVETFSEYPPLGRFAVRDMRQTVAVGVIKSVDKKDPTGAKVTKAAVKKGAK

SEQ ID NO: 4665 - protein, 447 aa, Picea glauca
MGKEKTHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIVKEVSSYLKRVGYNPDKIPFVPISGFEGDNMIERSNNLDWYKGPTLLEALDQVSEPKRPTDKPLRLPLQDVYKIGGIGTVPVGRVETGIIKPGTIVTFGPTGLTTEVKSVEMHHEALQEAYPGDNVGFNVKNVAVKDLKRGYVASDSKNDPAKEAANFTAQVIIMNHPGQIGNGYAPVLDCHTCHIAVKFSEIMTKVDRRSGKELEKEPKFLKNGDAGFVKMIPTKPMVVETFAEYPPLGRFAVRDMRQTVAVGVIKAVEKKDPTGAKVTKAAAKKK

SEQ ID NO: 4666 - protein, 441 aa, Thalictrum flavum
HINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDGISEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFSEILTKIDRRSGKELEKEPKFVKNGDACFVKMLPTKPMVVETFSEYPPLGRFAVRDMRQTVAVGVIKSVEKKDPTGAKVTKSAAKKK

SEQ ID NO: 4667 - protein, 452 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDNISEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDPTGAKGLPSLLSRRSKVLQ

SEQ ID NO: 4668 - protein, 169 aa, Eucalyptus grandis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVKQMICCCNKVHFFLYVTQVFQVPF

SEQ ID NO: 4669 - protein, 93 aa, Vitis vinifera
MIMTWAVKLAASFAGSSLELDATKPRFRSLTATFFTLKPTLSPGRPSTKDSWCISTDLTSVVSPLGPKVTTIPGLIIPVSTRPTGTVPMPPIL

SEQ ID NO: 4670 - protein, 449 aa, Amsonia hubrichtii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCGVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDLLNEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKGAANFTAQVIIMNHPGQIGNGYAPVLDCHTCHIAVKFSEILTKIDRRSGKELEKEPKFLKNGDAGFVKMIPTKPMVVETFSEYPPLGRFAVRDMRQTVAVGVIKSVDKKDPSGAKVTKAAVKKSGK

SEQ ID NO: 4671 - protein, 447 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFEEITKEVSSYLKKVGYNPDKIPFVPISGFEGDNMIERSSNLDWYKGPTLLEALDAVTEPKRPSDKPLRLPLQDVYKIGGIGTVPVGRVETGVIKPGMLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPFGRFAVRDMRQTVAVGVIKAVEKKDATGAKVTKAAAKKK

SEQ ID NO: 4672 - protein, 448 aa, Pinus pinaster
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATSPKYSKARYDEIVKEVSSYLKKIGYNPDKIPFVPISGFEGDNMIERSTNLDWYKGPTLLDALDQVSEPKRPSDKPLRLPLQDVYKIGGIGTVPVGRVETGVIKPGTVVTFGPTGLTTEVKSVEMHHEALLEALPGDNVGFNVKNVAVKDLKRGYVASDSKNDPAKEAASFTSQVIIMNHPGQISNGYAPVLDCHTCHIAVKFAEIMTKVDRRSGKELEKEPKFLKNGDAGFIKMIPSKPMVVETFSEYPPLGRFAVRDMRQTVAVGVIKGVEKKDPTGAKITKAAAKKGK

SEQ ID NO: 4673 - protein, 448 aa, Arachis hypogaea
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGILKPGMVVTFAPTGLQTEVKSVEMHHESLPEALPGDNVGFNVKNVSVKELKRGFVASNSKDDPAKEAGSFTSQVIIMNHPGQIGQGYAPVLDCHTSHIAVKFAELQTKIDRRSGKELEKEPKFLKNGDAGMVKMIPTKPMVVETFAEYPPLGRFAVRDMRQTVAVGVIKSVEKKDASAKITKSAAKKAGK

SEQ ID NO: 4674 - protein, 447 aa, Physcomitrella patens
MGKEKVHINIVVIGHVDSGKSTTTGHLIYKLGGIDKRVIERFEKEAAEMNKRSFKYAWVLDKLKAERERGITIDIALWKFETMKYYCTVIDAPGHRDFIKNMITGTSQADCAVLIIDSTTGGFEAGISKDGQTREHALLAFTLGVKQMICCCNKMDATTPKYSKARYEEIVKEVSAYLKKVGYNPEKVPFVPISGFEGDNMIERSTNLDWYKGPTLLEALDNVSEPKRPSDKPLRLPLQDVYKIGGIGTVPVGRVETGIIRPGMLVCFAPTGLTTEVKSVEMHHESMPEAHPGDNVGFNVKNVAVKDLKRGYVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKEPTGAKVTKAAAKKK

SEQ ID NO: 4675 - protein, 447 aa, Taxus baccata
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSSNLDWYKGPTLLDALDQVSEPKRPSDKPLRLPLQDVYKIGGIGTVPVGRVETGVIKPGMVVTFGPSGLTTEVKSVEMHHEALLEALPGDNVGFNVKNVAVKDLKRGYVASDSKNDPAKEAANFTAQVIIMNHPGQIGNGYAPVLDCHTCHIAVKFSEILTKVDRRSGKELEKEPKFIKNGDAAFVKMIPTKPMVVETFSEYPPLGRFAVRDMRQTVAVGVIKAVEKKEPSGAKVTKAAAKKK

SEQ ID NO: 4676 - protein, 449 aa, Tripterygium wilfordii
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDIYKIGGIGTVPVGRVETGILRPGTVVTFGPSGLTTEVKSVEMHHEALQEALPGDNVGFNVKNVAVKDLKRGFVASNSKDDPAKEAANFTAQVIIMNHPGQIGGGYAPVLDCHTSHIAVKFAELLTKIDRRSGKELEKEPKFLKNGDAGFVKMIPSKPMVVEAFSEYPPLGRFAVRDMRQTVAVGVIKAVEKKDPSGAKVTKSAAKKGGK

SEQ ID NO: 4677 - protein, 449 aa, Citrullus lanatus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVRQMICCCNKMDATTPKYSRSRYDEIVKEVSSYLKKVGYNPDKIPFVPISGFEGDNMIERSTNLDWYKGPTLLEALDQVHEPKRPSDKPLRLPLQDVYKIGGIGTVPVGRVETGILKPGMVVTFAPSGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPSGAKVTKSAAKKSGK

SEQ ID NO: 4678 - protein, 166 aa, Prunus mume
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAILIIDSTTGGFEAGISKDGQTREHALLAFTLGVRQMICCCNKVSHSQVLKGKVR

SEQ ID NO: 4679 - protein, 345 aa, Theobroma cacao
LLRCSLSTLLSCRLGDLGTCWILLLNILNNTNSHSLPHVPHSKTSQWWVLRECLHNHGLGGNHLHHTGITILQELGFLLKLLARSPVNLGQQLRKLDSNVGGVTVEDWGITITNLAGVVHDDDLRGEAGSLLGRIILGVRSNETTLEILNSNILHIEPYIVTRESLLESFVVHLNRLNFSGKTRRTKGHNHTRLQDTSLNTTDWDSSNTTNLVHVLKWETEGLVGGPLGLIDLVKSLKKSRALVPVKVGRPFNHVVTLETGNGNKWNFIWVVTHLLQVRRDFLHNFIIPSLGACYKSNLVAAANHLLDTKGKGKQSVLTSLTVLGNTSLETTSGGINNQDSTVSL

SEQ ID NO: 4680 - protein, 177 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNRWTRPPRSTARPVSRRSRRRCPPT

SEQ ID NO: 4681 - protein, 177 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTRSTARPVSRRSRRRCPPT

SEQ ID NO: 4682 - protein, 101 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPDIVISSRT

SEQ ID NO: 4683 - protein, 124 aa, Euphorbia peplus
MNHPGQIGNGYAPVLDCHTSHIAVKFSEILTKIDRRSGKELEKEPKFLKNGDAGMIKMIPTKPMVVETFAEYPPLGRFAVRDMRQTVCCWCHQECGEEGSIWSQGHQVCCQEEVRCFSMIVYHW

SEQ ID NO: 4684 - protein, 200 aa, Fraxinus spp
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKILLCLSLVLRVIT

SEQ ID NO: 4685 - protein, 257 aa, Avena sativa
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKGRFEEIVKEVGSYLKKVGYNPDKVPFVPISGFEGDNMRGPATLIGTRAQPCLRRLTRSMSPRGPQTSPSAFPFRMSTRLVALELCQWGVLRLE

SEQ ID NO: 4686 - protein, 198 aa, Ambrosia trifida
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPTNPLSHLWFEVTT

SEQ ID NO: 4687 - protein, 449 aa, Brassica rapa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIILNHPGQIGNGYAPVLDCHTSHIAVKFSEILTKIDGRSGKEMEKEPKYLKNGDAGMVKMTPTKPMVVETFSEYPPLGRFAVRDMRQTVAVGVIKSVDKKCPTGAKVTKAAVKKGAK

SEQ ID NO: 4688 - protein, 449 aa, Bruguiera gymnorhiza
MGKEKIHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTSKYSKARYDEIVKEVSSYLKKVGYNPEKIPFVPISGFEGDNMIERSTNLDWYKGPTLLEALDMIQEPKRPSDKPLRLPLQDVYKIGGIGTVPVGRVETGVLKPGMVVTFGPSGLTTEVKSVEMHHEALQEALPGDNVGFNVKNVSVKDLKRGYVASNSKDDPAKEASSFTSQVIIMNHPGQIGNGYAPVLDCHTSHIAVKFSEILTKIDRRSGKELEKEPKFLKNGDAGFVKMIPTKPMVVETFSEYPPLGRFAVRDMRQTVAVGVIKSVEKKEPSGAKVTKSAAKKGGK

SEQ ID NO: 4689 - protein, 447 aa, Distylium racemosum
MGKEKTHINIVVIGHVDSGKSTTTGHLIYKLGGIDKRVIERFEKEAAEMNKRSFKYAWVLDKLKAERERGITIDIALWKFETNKYYCTVIDAPGHRDFIKNMITGTSQADCAVLIIDSTTGGFEAGISKDGQTREHALLAFTLGVRQMICCCNKMDATTPKYAKARYDEIVKEVSSYMKKVGYNPDKIPFVPISGFEGDNMIERSSNLDWYKGPTLLEALDMVNEPKRPTDKPLRLPLQDVYKIGGIGTVPVGRVETGVLKPGTVVTFGPTGLTTEVKSVEMHHEALVEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAGFVKMIPTKPMVVETFSEYPPLGRFAVRDMRQTVAVGVIKSVEKKEPSGAKVTKAAAKKK

SEQ ID NO: 4690 - protein, 430 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVE

SEQ ID NO: 4691 - protein, 447 aa, Sciadopitys verticillata
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLEWYKGPTLLDALDQVSEPKRPTDKPLRLPLQDVYKIGGIGTVPVGRVETGVLKPGMLVTFGPSGLTTEVKSVEMHHEALVEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAAFVKMVPTKPMVVETFSEYPPLGRFAVRDMRQTVAVGVIKSVEKKEPTGAKVTKAAAKKK

SEQ ID NO: 4692 - protein, 440 aa, Selaginella moellendorffii
MGKEKAHINIVVIGHVDSGKSTTTGHLIYKLGGIDKRTIERFEKEAAEMNKRSFKYAWVLDKLKAERERGITIDIALWKFETNRYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDQVTEPKRPSDKPLRLPLQDVYKIGGIGTVPVGRVETGVLKPGMVVTFGPTGLTTEVKSVEMHHESLVEALPGDNVGFNVKNVAVKDLKRGFVASDSKNDPAKEAASFTAQVIIMNHPGQIGNGYTPVLDCHTSHIAVKFAELLTKVDRRSGKELEQEPKFLKNGDAGFVKMLPTKPMVVETFAEYPPLGRFAVRDMRQTVAVGVIKAVEKKEPTGAKVT

SEQ ID NO: 4693 - protein, 361 aa, Ambrosia trifida
WVRKRFISVIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQRLSLVTRWVHVKTLLSGSETWFTLHPTQRMTLLRVLPVHSQVIIMNTLVKSETVMLRFWIATHLTLPSSFLSC

SEQ ID NO: 4694 - protein, 98 aa, Ambrosia trifida
RIHIRIVVIGHVDSGKSTTTGHLIYKLGGIDKRVIERFEKEAAEMNKRSFKYAWVLDKLKAERERGITHPISPCGSLRPPSTTALSLMPPDIVISLRT

SEQ ID NO: 4695 - protein, 177 aa, Brassica napus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPSTPRLGTMRSSRRCLPT

SEQ ID NO: 4696 - protein, 346 aa, Ceratodon purpureus
MITGTSQADCAVLIIDSTTGGFEAGISKDGQTREHALLAFTLGVKQMICCCNKMDATTPKYSKARFEEITKEVSSYLKKVGYNPDKIPFVPISGFEGDNMIERSSNLDWYKGPTLLEALDAVTEPKRPSDKPLRLPLQDVYKIGGIGTVPVGRVETGVIKPGMLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKDATGAKVTKAAAKKK

SEQ ID NO: 4697 - protein, 177 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATPRSTARPVSRRSRRRCPPT

SEQ ID NO: 4698 - protein, 249 aa, Papaver somniferum
MIERSTNLDWYKGPTLLEALDNISEPKRPHRQAPSSSLQDVYKIGGIGTVPVGRVETGVIKPGMVFLWTHWLTTEVKSVEMHHEALLEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDHRARLPSLLSRRSKVLQ

SEQ ID NO: 4699 - protein, 157 aa, Phaseolus vulgaris
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKVYI

SEQ ID NO: 4700 - protein, 444 aa, Brassica napus
FHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4701 - protein, 437 aa, Flaveria ramosissima
IGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4702 - protein, 177 aa, Brassica rapa
MVSSKKPNQEKKPKNGDGLNTRSSGSKTKKKTPNKAKLKDVAEKEPEVHEISESSSSEGRRDEPKESNGVVVSEDAKMVRFPMNRIRRIMRSDNSAPQIMQDAVFLVNKATELFIERFSEEAYGSSVQDKKKFIHYKHLSSVVSNEERYEFLADCVPEKLKGEVALEEWERSMTDVG

SEQ ID NO: 4703 - protein, 348 aa, Flaveria ramosissima
MITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4704 - protein, 197 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNRWTRHPEVQQGPFRGDHEGGVLLPEEGGIQPRQDPVCAHLWVRG

SEQ ID NO: 4705 - protein, 144 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALWLSLWE

SEQ ID NO: 4706 - protein, 115 aa, Fraxinus spp
MNHPGQIGSGYAPVLDCHTSHIAVKFAELLTKIDRRSGKELEKEPKFLKNGDAGMVKMIPTKPMVVETFSEYPPLGRFAVRDMRQTVAVGVIKNVEKKEPSGAKVTKAAAKKGVK

SEQ ID NO: 4707 - protein, 444 aa, Elaeis guineensis
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIDRSTNLDWYKGPTLLEALDLIQEPKRPSDKPLRLPLQDVYKIGGIGTVPVGRVETGILRPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPTGAQDHQGSC

SEQ ID NO: 4708 - protein, 447 aa, Physcomitrella patens
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFEEISKEVSAYLKKVGYNPDKIPFVPISGFEGDNMIERSTNLDWYKGPTLLEALDNVSEPKRPSDKPLRLPLQDVYKIGGIGTVPVGRVETGIIRPGMLVCFAPTGLTTEVKSVEMHHESMPEAHPGDNVGFNVKNVAVKDLKRGYVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKEPTGAKVTKAAAKKK

SEQ ID NO: 4709 - protein, 447 aa, Physcomitrella patens
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSSARYEEIVKEVSSYLKKVGYNPDKIPFVPISGFEGDNMIERSTNLSWYKGPTLLEALDNVSEPKRPSDKPLRLPLQDVYKIGGIGTVPVGRVETGIIRPGMLVCFAPTGLTTEVKSVEMHHESMPEAHPGDNVGFNVKNVAVKDLKRGYVASDSKNDPAKEAANFTAQVIIMNHPGQIGNGYAPVLDCHTSHIAVKFAEILTKVDRRSGKELEKEPKFLKNGDAGFVKMIPTKPMTVETFSEYPPLGRFAVRDMRQTVAVGVIKAVEKKEPTGAKVTKAAAKKK

SEQ ID NO: 4710 - protein, 450 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFEEITKEVSSYLKKVGYNPDKIPFVPISGFEGDNMIERSSNLDWYKGPTLLEALDAVTEPKRPSDKPLRLPLQDVYKIGGIGTVPVGRVETGVIKPGMLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKDATGAKVTKAAAKKSKRL

SEQ ID NO: 4711 - protein, 465 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKNERVDIVCCVSSILVLLLF

SEQ ID NO: 4712 - protein, 72 aa, Pseudotsuga menziesii
MGKEKTHINIVVIGHVDSGKSTTTGHLIYKLGGIDKRVIERFEKEAAEMNKRSFKYAWVLDKLKAEREPKHT

SEQ ID NO: 4713 - protein, 195 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKSLRSNLWI

SEQ ID NO: 4714 - protein, 184 aa, Ceratodon purpureus
MLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKDATGAKVTKAAAKKK

SEQ ID NO: 4715 - protein, 223 aa, Cucurbita pepo
MNKRSFKYAWVLDKLKAERERGITIDIALWKFETTKYYCTVIDAPGHRDFIKNMITGTSQADCAVLIIDSTTGGFEAGISRDGQTREHALLAFTLGVKQMICCCNKMDATPQVLQGRYDEIVKEVSSYLKKVGYNPDKIPFVPISGFEGDNMIERSTNLDWYKGPTLLEALDLIQEPKRPSDKPLRLPLQDVYKIGGIGTVPVGRVETGVLKPGMVVTLAHLD

SEQ ID NO: 4716 - protein, 286 aa, Fraxinus spp
MNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKPRFDEIVKEVSSYIKKVGYNPDKIPFVPISGFEGDNMIERSTNLDWYKGPTLLEALDQIQEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTPRSSS

SEQ ID NO: 4717 - protein, 170 aa, Phalaenopsis aphrodite
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKSLRRGMMKL

SEQ ID NO: 4718 - protein, 89 aa, Papaver somniferum
VVIGHVDSGKSTTTGHLIYKLGGIDKRVIERFEKEAAEMNKRSFKYAWVLDKLKAERERGITIDIALWKFETTKYYCTIIDAPGHRDFY

SEQ ID NO: 4719 - protein, 447 aa, Physcomitrella patens
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFDEISKEVSTYLKKVGYNPDKIPFVPISGFEGDNMIERSTNLDWYKGPTLLEALDNVSEPKRPSDKPLRLPLQDVYKIGGIGTVPVGRVETGIIRPGMLVCFAPTGLTTEVKSVEMHHESMPEAHPGDNVGFNVKNVAVKDLKRGYVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKEPTGAKVTKAAAKKK

SEQ ID NO: 4720 - protein, 447 aa, Physcomitrella patens
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFDEISKEVSTYLKKVGYNPDKIPFVPISGFEGDNMIERSTNLEWYKGPTLLEALDNVSEPKRPSDKPLRLPLQDVYKIGGIGTVPVGRVETGIIKPGMLVTFAPTGLTTEVKSVEMHHESLLEAHPGDNVGFNVKNVAVKDLKRGYVASDSKNDPAKEAANFTAQVIIMNHPGQIGNGYAPVLDCHTSHIAVKFAEILTKVDRRSGKELEKEPKFLKNGDAGFVKMVPTKAMTVETFAQYPPLGRFAVRDMRQTVAVGVIKAVEKKEPSGAKVTKAAAKKK

SEQ ID NO: 4721 - protein, 447 aa, Physcomitrella patens
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFDEISKEVSAYLKKVGYNPDKIPFVPISGFEGDNMIERSTNLEWYKGPTLLEALDNVSEPKRPSDKPLRLPLQDVYKIGGIGTVPVGRVETGVIRPGMLVCFAPTGLTTEVKSVEMHHESMPEAHPGDNVGFNVKNVAVKDLKRGYVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKEPTGAKVTKAAAKKK

SEQ ID NO: 4722 - protein, 444 aa, Brassica napus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKRPTVPRSQAAVKR

SEQ ID NO: 4723 - protein, 334 aa, Brassica napus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKELPTSHPRSSS

SEQ ID NO: 4724 - protein, 144 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGVSRPVSRRMGRPVSTLCWLSLWE

SEQ ID NO: 4725 - protein, 268 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATAPTYSKARYDEIVNEVSSYQKKVGYNPEKIPFIPISGFEGDNMIERSTNLNWNKGPTLLEALDQINDPKRPSDKPLRLPLQDVYYIGGIGTVPVGRVETRTLKPGMVVTY

SEQ ID NO: 4726 - protein, 451 aa, Phalaenopsis aphrodite
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLDALDLIQEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKSQVPEDGDAGFVKMVPTKPMVVETFSEYPPLGRFAVRDMRQTVAVGVIKSVEKKDPSGAKVTKSAAKKKYQKPS

SEQ ID NO: 4727 - protein, 438 aa, Ambrosia trifida
MGKVKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKAQLELR

SEQ ID NO: 4728 - protein, 435 aa, Centaurea maculosa
HVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQISEPKRPSDKPLRLPLQDVYKIGGIGTVPVGRVETGVIKPGMVVTFGPSGLTTEVKSVEMHHEALLEALPGDNVGFNVKNVAVKDLKRGYVASNSKDDPAKGAASFTSQVIIMNHPGQIGNGYAPVLDCHTSHIAVKFQELVTKIDRRSGKEIEKEPKFLKNGDAGMVKMIPTKPMVVETFAEYPPLGRFAVRDMRQTVAVGVIKSVDKKDPTGAKVTKAAVKKGAK

SEQ ID NO: 4729 - protein, 442 aa, Cucumis sativus
INIVVIGHVDSGKSTTTGHLIYKLGGIDKRVIERFEKEAAEMNKRSFKYAWVLDKLKAERERGITIDIPLWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYLKKVGYNPEKIPFVPISGFEGDNMIERSTNLDWYKGPTLLEALDLIQEPKRPSDKPLRLPLQDVYKIGGIGTVPVGRVETGIIKPGMVVTFAPSGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGFVKMIPTKPMVVETFSAYPPLGRFAVRDMRQTVAVGVIKAVEKKDASGAKVTKSAAKKSGK

SEQ ID NO: 4730 - protein, 446 aa, Flaveria ramosissima
YRRISVLLSLDNVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4731 - protein, 450 aa, Ceratodon purpureus
YSRWVRKKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVKQMICCCNKMDATTPKYSKARFEEITKEVSSYLKKVGYNPDKIPFVPISGFEGDNMIERSSNLDWYKGPTLLEALDAVTEPKRPSDKPLRLPLQDVYKIGGIGTVPVGRVETGVIKPGMLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKDATGAKVTKAAAKKK

SEQ ID NO: 4732 - protein, 300 aa, Ceratodon purpureus
MICCCNKMDATTPKYSKARFEEITKEVSSYLKKVGYNPDKIPFVPISGFEGDNMIERSSNLDWYKGPTLLEALDAVTEPKRPSDKPLRLPLQDVYKIGGIGTVPVGRVETGVIKPGMLVCFAPTGLTTEVKSVEMHHESMPEAHPGDNVGFNVKNVAVKDLKRGFVASDSKNDPAKEAANFTAQVIIMNHPGQIGNGYAPVLDCHTSHIAVKFAEILTKVDRRSGKELEKEPKFLKNGDAGFVKMIPTKPMTVETFAEYPPLGRFAVRDMRQTVAVGVIKAVEKKDATGAKVTKAAAKKK

SEQ ID NO: 4733 - protein, 61 aa, Ambrosia trifida
MVKMLPTKPMVVETFAEYPPLGRFAVRDMRQTVAVGVIKSVDKKDPTGAKVTKAAVKKGAK

SEQ ID NO: 4734 - protein, 226 aa, Eschscholzia californica
MSQRDPQTSHSVFHFRMVNKIGGIGTVPVDVLRLESSSPVWLSTFGPHWIGPLRLSPWRWHHEALQESSSRWTNVGFNVKNVAVKDTQAWFVTSTPRMTQPGKLPNFTSQVIIMNHPGQIGNGYAPVLDCHTSHIAVKFGEILTKIDRRSGKEFEKEPKFLKNGDAGMVKMLPTKPMVVETFAEYPPLGRFAVRDMRQTVAVGVIKSVEKKDPSGAKVTKSAAKKK

SEQ ID NO: 4735 - protein, 428 aa, Ambrosia trifida
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKS

SEQ ID NO: 4736 - protein, 435 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVSSYMKKVGYNPDKIPFVPISGFEGDNMIERSTNLDQINEPKRPSDKPLRLPLQDVYKIGGIGTVPVGRVETGTMKPGMVVTFAPTGLQTEVKSVEMHHESLTEALPGDNVGFNVKNVAVKDLKRGYVASNTKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKEPGTAKITKSAAKKK

SEQ ID NO: 4737 - protein, 179 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGRFRGRYLEGVGTTREHVFVGLSTLGVKQMICCCNKMDATPRSTARPVSRRSRRRCPPT

SEQ ID NO: 4738 - protein, 427 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIK

SEQ ID NO: 4739 - protein, 447 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSQADCAVLIIDSTTGGFEAGISKDGQTREHALLAFTLGVRQMICCCNKMDATTPKYSKARYEEITKEVSAYLKKVGYNPEKVPFVPISGFEGDNMIERSSNLEWYKGPTLLEALDNVSEPKRPSDKPLRLPLQDVYKIGGIGTVPVGRVETGVIKPGMLVCFAPTGLVTEVKSVEMHHESMAEAHPGDNVGFNVKNVAVKDLKRGYVASDSKNDPAKEAANFTAQVIIMNHPGQIGNGYAPVLDCHTSHIAVKFSEILTKVDRRSGKELEKEPKFLKNGDAGVVKMVPTKPMTVETFAEYPPLGRFAVRDMRQTVAVGVIKAVEKKEPSGAKITKSAKTKK

SEQ ID NO: 4740 - protein, 408 aa, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGVIKGVEKKDPTGAKVTKAAIKKK

SEQ ID NO: 4741 - protein, 63 aa, Ambrosia trifida
FPHLSLKSSEHLLLRMGKEKIHISIVVIGHVDSGKSTTTGHLIYKLGGIDKRVIERFEREPLK

SEQ ID NO: 4742 - protein, 280 aa, Gossypium raimondii
MPQPPNTQKARYDEIVKEVSSYLKKVGYNPEKIPFVPISGFECDNMIERSTNLDWYKGPTLTSHSVFHFRMCTRLEVLELSPVGRVETGILKPGMVATFGPSGLTIEVKSVEMHHESLTEALPGDNVGFNVKNVAVKDLKRGYVASNSKDDPAKEAANFTSQVIIMNHPAQIGNGYAPVLDCHTSHIAVKFAELVTKIDRRSGKELEKEPKFLKNGDAGFVKMVPTKPMVVETFSEYPPLGRFAVRDMRQTVAVGVIKSVEKKDPSGAKVTKSAAKKGGK

SEQ ID NO: 4743 - protein, 216 aa, Quercus alba
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGRGS

SEQ ID NO: 4744 - protein, 268 aa, Helianthus annuus
NIVVIGHVDSGKSTTTGHLIYKLGGIDERVIERFEKEAAEMNKRSFKYAWVLDKLKAERERGITIDIPLWKFETTKYYCTVIDAPGHRDFIKNMITGTSQADCAVLIIDSTTGGFEAGISKDGQTREHALLAFTLGVRQMICCCNKMDATTPKYSKPRYDEIVKEVSSYLKKVGYNPEKIPFVPISGFEGDNMIERSTNLDWYKGPTLLEALNNVSEPKRPSDKPLRLPLQDVYKIVGLELCPWVGLRRVLSSPVWSSLSARPVSPLK

SEQ ID NO: 4745 - protein, 435 aa, Flaveria ramosissima
MSTPAKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4746 - protein, 440 aa, Pteridium aquilinum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIMKEVSAYLKKVGYNPDKIPFVPISGFEGDNMIERSSNLDWYKGPTLLDALDMVQEPKRPSDKPLRLPLQDVYKIGGIGTVPVGRVETGIIKPGMVVTFAPTGLTTEVKSVEMHHEALLEALPGDNVGFNVKNVAVKDLKRGFVASDSKNDPAKEAANFTSQVIIMNHPGQIGNGYAPVLDCHTSHIAVKFAEILTKIDRRSGKEIEKEPKFLKNGDAGIIKMIPTKPMTVETFAEYPPLGRFAVRDMRQTVAVGVIKAVEKEGSYWSQGY

SEQ ID NO: 4747 - protein, 447 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKVPFVPISGFEGDNMIERSTNLDWYKGPTFLRPLTRSMSPRGPQTSPSAFPFRMSTRLVAIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTCHIAVKFAEIQTKIDRRSGKELEAAPKFLKNGDAGFVKMIPTKPMVVETFAQYPPLGRFAVRDMRQTVAVGVIKSVEKKEPTGAKVTKAAIKKK

SEQ ID NO: 4748 - protein, 429 aa, Utricularia gibba
STTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSNNLDWYKGPTLLEALDLINEPKRPSDKPLRLPLQDVYKIGGIGTVPVGRVETGVLKPGMVVTFGPSGLTTEVKSVEMHHEALLEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGLVKMIPTKPMVVETFSEYPPLGRFAVRDMRQTVAVGVIKSVEKKDPTGAKVTKAAAKKGAK

SEQ ID NO: 4749 - protein, 233 aa, Brassica napus
MIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHITVKFSEILTKIDRRSGKEIEKEPKFLKNGDAGMVKMTPTKPMVGETFSEYPPLGRFAVRDMRQTVAVGVIKSVDKKD

SEQ ID NO: 4750 - protein, 108 aa, Ambrosia trifida
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITVLTG

SEQ ID NO: 4751 - protein, 446 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKVPFVPISGFEGDNMIERSTNLDWYKGPTLLEALDQINEPKRPSDKPLRLPFRMSTRLVALELCQWGGVETGVIKPGMLSPLVHWPDTEVKSVEMHHESLLEALPGDNVGFNVKNVAVKDLKRGYVASNSKDDPAKEAANFTAQVIIMNHPGQISNGYAPVLDCHTCHIAVKFAEIQTKIDRRSGKELEAAPKFLKNGDAGFVKMIPTKPMVVETFAQYPPLGRFAVRDMRQTVAVGVIKSVEKKEPTGAKVTKAAIKKK

SEQ ID NO: 4752 - protein, 421 aa, Ambrosia trifida
KSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVT

SEQ ID NO: 4753 - protein, 444 aa, Quercus alba
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLEALDLILEPKRPSDKPLRLPLQDVYKIGGIGTVPVGRVETGVLKPGIVVTFGPTGLTTEVKSVEMHHESLLEALPGDNVGFNVKNVAVKDLKRGFVASNSKDDPAKEAANFTAQVIIMNHPGQIGNGYAPVLDCHTSHIAVKFSEILTKIDRRSGKELEKEPKFLKNGDAGFVKMIPTKPMVVETFSEYPPLGRFAVRDMRPNCGCWCCQECGEEGSKWCQGHQVCC

SEQ ID NO: 4754 - protein, 198 aa, Artemisia annua
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKESYLKKVGYNPDKIALCPSLVLKVTT

SEQ ID NO: 4755 - protein, 249 aa, Gossypium raimondii
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICMDATTPKYSKARYDEIVKEVSSYLKKVGYNPDKIPFVPISGFEGDNMIERSTNLDWYKGPTLLEALDQINEPKRPSDKPLRLPLQDVYKIGGIGTAPLV

SEQ ID NO: 4756 - protein, 452 aa, Ambrosia trifida
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKSRYDEIVKEVSSYLKKVGYNPEKIPFVPISGFEGDNMIERSTNLDWYKGPTLLEALDNVSEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGIVKMVPTKPMVVETFSEYPPLGRFAVRDMRQTVAVGVIKSVDKKAQLVLRLPRLQPRRNEPLCL

SEQ ID NO: 4757 - protein, 458 aa, Medicago truncatula
MGKEKVHINIVVIGHVDSGKSTTTGHLIYKLGGIDKRVIERFEKEAAEMNKRSFKYAWVLDKLKAECERGITIDIALWKFETTKYYCTVIDAPGHRDFIKNMITGTSQADCAVLIIDSTTGGFEAGISKDGQTREHALLAFTLGVKQMIFMDATTPKYSKGRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFAPTGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKAVEKKDPSGGLNKNKVSIEEEVNRAGRSIQGSLLW

SEQ ID NO: 4758 - protein, 213 aa, Amorphophallus konjac
MIERSTNLDWYKGPTLLDALDLIQEPKRPTDKPLRLPLQDVYKIGGIGTVPVGRVETGILKPGMVVCFGPTGLTTEVKSVEMHHEALVEALPGDNVGFNVKNVAVKDLKRGFVASNSKDDPAKEAANFTSQVIIMNHPGQIGNGYAPVLDCHTSHIAAKFAEILTKIDRRSGKELEKEPKFLKNGDAGFVKMIPTKPMVVETFSEYPPSAVSP

SEQ ID NO: 4759 - protein, 416 aa, Avena sativa
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIVKMIPTKPMVVETFSTYPLLVALLFVT

SEQ ID NO: 4760 - protein, 200 aa, Fraxinus spp
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYDEIVKEVSSYIKKSDITLTRSHLCPSLVLRVTT

SEQ ID NO: 4761 - protein, 427 aa, Aquilegia formosa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITAGISKDGQTREHALLAFTLGVKQMICCCNKMDATTPKYSKARYEEIIKEVSSYLKKVGYNPDKIPFVPISGFEGDNMIERSTNLDWYKGPTLLEALDLISEPKRPTDKPLRLPLQDVYKIGGIGTVPVGRVETGLLKPGMVITFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKEIEKEPKFLKNGDAGFVKMIPSKPMVVETFSEYPPLGRFAVRDMRQTVAVGVIKSVEKKDPTGAKVTKSAVKKK

SEQ ID NO: 4762 - protein, 155 aa, Brassica rapa
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKV

SEQ ID NO: 4763 - protein, 93 aa, Fragaria vesca
MMMTWAVKLAASLAGSSLEFEATYPRLRSLTATFLTLKPTLSPGRASWRASWCISTDLTSVVNPVGAKVTTIPGLIIPVSTRPTGTVPIPPIL

SEQ ID NO: 4764 - protein, 432 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPRGPPTSPCVSPSGCVQIGGIGNVPVGRVETSVIKPGMVVTFGPTGLTTEVKSVEMHHEALQEALPGDNVGFNVKNVAVEDLKRVYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKD

SEQ ID NO: 4765 - protein, 178 aa, Cicer arietinum
MDRPVSTPSLAFHSWSETDDLFFVTRWMPLHPSTQKARYDEIVKEVSSYLKKVGYNPDKNPLRFQSSGFEGDNMIERSTTLTGTRDQLSLRLLTRSTSPRDLRQALRLPLQDVYKIGGIGTVPVGRVETGVIKPGVIVTFGPTGLDKLEVKVPFEELHHEGSHPKGSSPGDQRLDSNV

SEQ ID NO: 4766 - protein, 476 aa, Flaveria ramosissima
MGKENTHMSIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKELNDGLSVLYRMLMELLSYFGTISIMFILV

SEQ ID NO: 4767 - protein, 346 aa, Pennisetum glaucum
MITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4768 - protein, 461 aa, Brassica juncea
PQVLLSDSYLQLWVKRSFTSTLWFIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4769 - protein, 399 aa, Secale cereale
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4770 - protein, 293 aa, Pennisetum glaucum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPG

SEQ ID NO: 4771 - protein, 425 aa, Brassica napus
GHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4772 - protein, 346 aa, Curcuma longa
MITGTSQADCAVLIIDSTTGGFEAGISKDGQTREHALLAFTLGVKQMICCCNKMDATTPKYSKARYDEIVKEVSSYLKKVGYNPDKTPFVPISGFEGDNMIERSTNLDWYKGPTLLEALDLINEPKRPTDKPLRLPLQDVYKIGGIGTVPVGRVETGILKPGIVVTFGPTGLTTEVKSVEMHHEALQEALPGDNVGFNVKNVAVKDLKRGFVASNSKDDPAKEAANFISQVIIMNHPGQIGNGYAPVLDCHTSHIAVKFAELLTKIDRRSGKELEKEPKFLKNGDAGLVKMIPTKPMVVETFSEYPPLGRFAVRDMRQTVAVGVIKSVEKKDPTGAKITKAAQKKK

SEQ ID NO: 4773 - protein, 66 aa, Secale cereale
KRVIERFEKEAAEMTRGRSSTPGCLTSSRLSVREVSPLILLCGSSRPPSTPAPSLMLLVTVISSRT

SEQ ID NO: 4774 - protein, 443 aa, Nicotiana tabacum
HINIVVIGHVDSGKSTTTGHLIYLGGIDKRVIERFEKEAAEMHKRSFKYAWVLDKLKAERDRGITIDIALWKFETTKYYCTVIDRPGHRDFIKNMITGTSRACRVLIVASTTGFAQAGNLKDGQTRERLLIDSTTGNTLGVTQMICCCNKMDATTPKYSKARYDEIVKEVSSYLKKVGYNPDKIPFVPISGFEGDNMIERSTNLDWYKGPTLLDALDQINEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKGASSFTSQVIIMNHPGQIGNGYAPVLDCHTSHIAVKFAEILTKIDRRSGKEIEKEPKFLKNGDAGMVKMIPTKPMVVETFSEYPPLGRFAVRDMRQTVAVGVIKNVDKKDPTGAKVTKAAQKKK

SEQ ID NO: 4775 - protein, 477 aa, Brassica napus
QSYDGTFYGFRLRRQDLPLSISFTFRTTSGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4776 - protein, 415 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMTSHHAHGCGDLRHLPSSWPLRCA

SEQ ID NO: 4777 - protein, 61 aa, Solanum phureja
MGKEKIHISIVVIGHVDSGKSTTSGHLIYKLGGIDKRVIERFEKEAAEMNKRSFKYICLGA

SEQ ID NO: 4778 - protein, 415 aa, Gossypium hirsutum
MGKEKVHINLVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARFDEIVKEVSSYLKKVGYNPEKIPFVPISGFEGDNMIERSTNLDWYKGPTLLEALDQITEPKRPSDKPLRLPLQDVYKIGGIGTVPVGRVETGVLKPGMVVTFGPTGLTTEVKSVEMHHESLPEAFPGDNVGFNVKNVAVKDLKRGFVASNSKDDPAKEAANFTSQVIIMNHPGQIGNGYAPVLDCHTSHIAVKFSELLTKIDRRSGKELEKEPKFLKNGDAGMVKMIPTKPMVVETFSEYPPLGRFCCP

SEQ ID NO: 4779 - protein, 111 aa, Ceratodon purpureus
MGKEKVHINIVVIGHVDSGKSTTTGHLIYKLGGIDKRVIERFEKEAAEMNKRSFKYAWVLDKLKAERERGITIDIALWKFETVKYYCTVIDAPGHRDFIKNMITGTSITVQ

SEQ ID NO: 4780 - protein, 264 aa, Pinus taeda
MNKRSFKYAWVLDKLKAERERGITIDIALWKFETTKYYCTVIDAPGHRDFIKNMITGTSQADCAVLIIDSTTGGFEAGISALLAFTLGVRQMICCCNKMDATTPKYSKARYDEIVKEVSSYLKRVGYNPDKIPFVPISGFEGDNMIERSTNLDWYKGPTLLEALDNLSEPKRPSDKPLRLPLQDVYKIGGIGTVPVGRVIKPGMIVTFGPTGLTTEVKSVEMHHEALLEALPGDNVGFNVKNVAVNPRMIQQRKLPTLPHRLLL

SEQ ID NO: 4781 - protein, 393 aa, Secale cereale
GKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIP

SEQ ID NO: 4782 - protein, 410 aa, Quercus alba
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHEALLEALPGDNVGFNVKNVAVKDLKRGFVASNSKDDPAKEAANFSSQVIIMNHPGQIGNGYAPVLDCHTSHIAVKFAELLTKIDRRSGKELEKEPKFLKNGDAGMVKMLPTKPMVVETFPSIPTWS

SEQ ID NO: 4783 - protein, 197 aa, Triticum aestivum
SIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPVPFPTLPGVSEGGQHD

SEQ ID NO: 4784 - protein, 392 aa, Triticum aestivum
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKM

SEQ ID NO: 4785 - protein, 166 aa, Papaver somniferum
MHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPTGAKVTKSAVKKK

SEQ ID NO: 4786 - protein, 181 aa, Brassica napus
MIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKF

SEQ ID NO: 4787 - protein, 490 aa, Arabidopsis lyrata
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPRYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMIKPGMVVTFAPTGLTTEVKSVEMHHESLLEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGESKDNVSFFTLVWYLVACLCSCFVISPSERCSRNWVLDRRWRS

SEQ ID NO: 4788 - protein, 348 aa, Flaveria ramosissima
MITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4789 - protein, 449 aa, Fraxinus spp
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKPRYDEIVKEVSSYIRKVGYNPDKIPFVPISGFEGDNMIERSTNLDWYKGPTLLEALDQIQEPKRPSDKPSVSHFRTSTRLVVLELYLLAVWRLVLSSLVWLSPFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAELQTKIDRRSGKELEKEPKFLKNGDAGLVKMIPTKPMVVETFSEYPPLGRFAVRDMRQTVAVGVIKSVDKKDPSGAKVTKAAAKKGAK

SEQ ID NO: 4790 - protein, 200 aa, Brassica napus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKILLFPSLVSRVTT

SEQ ID NO: 4791 - protein, 426 aa, Triticum aestivum
TAAAASSSRFPLLPSSLLQPWVREKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATY

SEQ ID NO: 4792 - protein, 300 aa, Ceratodon purpureus
MICCCNKMDATTPKYSKARYEEITKEVSAYLKKVGYNPEKVPFVPISGFEGDNMIERSSNLEWYKGPTLLEALDNVSEPKRPSDKPLRLPLQDVYKIGGIGTVPVGRVETGVIKPGMLVCFAPTGLVTEVKSVEMHHESMAEAHPGDNVGFNVKNVAVKDLKRGYVASDSKNDPAKEAANFTAQVIIMNHPGQIGNGYAPVLDCHTSHIAVKFSEILTKVDRRSGKELEKEPKFLKNGDAGVVKMVPTKPMTVETFAEYPPLGRFAVRDMRQTVAVGVIKAVEKKEPSGAKITKSAKTKK

SEQ ID NO: 4793 - protein, 163 aa, Setaria italica
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKVTIYCLFLV

SEQ ID NO: 4794 - protein, 407 aa, Brassica juncea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTSTKPMVVETFSEYP

SEQ ID NO: 4795 - protein, 416 aa, Gossypium hirsutum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDQINEPKRPSDKPLRLPLQDVYKIGGIGTVPVGRVETGTLKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAELLTKIDRRSGKELEKEPKFLKNGDAGMIKMVPTKPMVVEPSPRTLHLDVLPLGT

SEQ ID NO: 4796 - protein, 399 aa, Pennisetum glaucum
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4797 - protein, 396 aa, Triticum aestivum
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTK

SEQ ID NO: 4798 - protein, 293 aa, Zea mays
MDATTPKYSKARYDEIVKEVGSYLKKVGYNPDKIPFVPISGFEGDNMIERSTNLDWYKGPTLLEALDQINEPKRPSDKPLRLPLQDVYKIGGIGTVPVGRVETGLLKPGMVVTFAPTGLTTEVKSVEMHHETMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 4799 - protein, 399 aa, Pennisetum glaucum
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPPLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4800 - protein, 402 aa, Papaver somniferum
VVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLDALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRF

SEQ ID NO: 4801 - protein, 427 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNRWMPYPQYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLVVLLLGICDRQLLWSHQEC

SEQ ID NO: 4802 - protein, 383 aa, Secale cereale
AERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4803 - protein, 413 aa, Trigonella foenum-graecum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYLKKVGYNPDKIPFVPISGFEGDNMIKRSTNLDWYKGPTLLEALDQINEPKRPSDKPLRLPLQDVYKIGGIGTVPVGRVETGVLKPGMVVTFAPSGLTTEVKSVEMHHEALTEALPGDNVGFNVKNVAVKDLKRGYVASNSKDDPAKEAANFTSQVIIMNHPGQIGNGYAPVLDCHTSHIAVKFAELVTKIDRRSGKEIEKEPKFLKNGDAGIIKMIPPSLWWLRLSPNILHLAVSL

SEQ ID NO: 4804 - protein, 399 aa, Quercus alba
MNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQINEPKRPSDKPLRLPLQDVYKIGGIGTVPVGRVETGIIKPGMVVTFGPTGLTTEVKSVEMHHEALLEALPGDNVGFNVKNVAVKDLKRGFVASNSKDDPAKEAANFTSQVIIMNHPGQIGNGYAPVLDCHTSHIAVKFAELLTKIDRRSGKELEKEPKFLKNGDAGMVKMLPTKPMVVETFSEYPPLGRFAVRDMRQTVAVGVIKSVEKKDPSGAKVTKSAAKKK

SEQ ID NO: 4805 - protein, 316 aa, Nicotiana benthamiana
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGILKPGMVVTLRLLTRSMSPRGPQTSPSGSHFRMCTRLVVLVLSLLVVWKPVSSSLVWL

SEQ ID NO: 4806 - protein, 399 aa, Panicum virgatum
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 4807 - protein, 399 aa, Eschscholzia californica
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLDALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4808 - protein, 399 aa, Quercus alba
MNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHEALLEALPGDNVGFNVKNVAVKDLKRGYVASNSKDDPAKEAANFSSQVIIMNHPGQIGNGYAPVLDCHTSHIAVKFAELLTKIDRRSGKELEKEPKFLKNGDSGMVKMIPTKPMVVETFSEYPPLGRFAVRDMRQTVAVGVIKSVEKKDPSGAKVTKSAAKKK

SEQ ID NO: 4809 - protein, 184 aa, Secale cereale
MVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 4810 - protein, 399 aa, Gossypium hirsutum
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALSEALPGDNVGFNVKNVAVKDLKRGFVASNSKDDPAKEAASFTSQVIIMNHPGQIGNGYAPVLDCHTSHIAVKFSELLTKIDRRSGKELEKEPKFLKNGDAGMIKMVPTKPMVVETFSEYPPLGRFAVRDMRQTVAVGVIKSVEKKDPTGAKVTKSAAKKK

SEQ ID NO: 4811 - protein, 399 aa, Eschscholzia californica
MNKRSFKYAWVLDKLKAERERGITIDIALWKLETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLDALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGMVKMLPTKPMVVETFAEYPPLGRFAVRDMRQTVAVGVIKSVEKKDPSGAKVTKSAAKKK

SEQ ID NO: 4812 - protein, 404 aa, Setaria italica
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKGDNMIERSTNLDWYKGPTLLEALDQINEPKRPSDKPLRLPLQDVYKIGGIGTVPVGRVETGVLKPGMVVTFAPTGLTTEVKSVEMHHESMQEALPGDNVGFNVKNVAVKDLKRGYVASNSKDDPAREAAGFTAQVIIMNHPGQIAGGYAPVLDCHTSHVAVRFSELLTKIDRRSGKELESGPKFLKNGDAGLVKMVPTKPMVVETFSEYPPLGRFAVRDMRQTVAVGVIKSVEKKDPTGAKVTKAAAKKK

SEQ ID NO: 4813 - protein, 401 aa, Flaveria ramosissima
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4814 - protein, 401 aa, Flaveria ramosissima
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKKDPTGAKVTKAAVKKGAK

SEQ ID NO: 4815 - protein, 127 aa, Musa acuminata
MGKEKVHINIVVIGHVDSGKSTTTGHLIYKLGERGITIDIALWKFETTKYYCTVIDAPGHRDFIKNMITGTSQADCAVLIIDSTTGGFEAGISKDGQTREHALLAFTLGVKQMICCCNKMDATTPKY

SEQ ID NO: 4816 - protein, 397 aa, Amorphophallus konjac
KRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPTDKPLRLPLQDVYKIGGIGTVPVGRVETGVLKPGMVVTFGPTGLTTEVKSVEMHHEALPEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKAVEKKDPSGAKVTKAAQKKK

SEQ ID NO: 4817 - protein, 394 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLP

SEQ ID NO: 4818 - protein, 393 aa, Pennisetum glaucum
KYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4819 - protein, 399 aa, Papaver somniferum
MNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPTDKPLRLPLQDVYKIGGIGTVPVGRVETGLIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFGEILTKIDRRSGKELEKEPKFLKNGDAGIIKMLPTKPMVVETFAEYPPLGRFAVRDMRQTVAVGVIKSVEKKDPSGAKVTKSAAKKK

SEQ ID NO: 4820 - protein, 152 aa, Thalictrum flavum
MNKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYEEIIKEVSSYLKKVGYNPDKFPLFPSLGLRVTT

SEQ ID NO: 4821 - protein, 401 aa, Ambrosia trifida
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAVKKGAK

SEQ ID NO: 4822 - protein, 399 aa, Ananas comosus
MNKRSFKYAWVLDKLKAERERGITIDIALWKFETTKYYCTVIDAPGHRDSIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMVPTKPMVMETFSEYPPLGRFAVRDMRQTVAVGVIKSVEKKDPSGAKVTKAAQKKK

SEQ ID NO: 4823 - protein, 399 aa, Papaver somniferum
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLDALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKEPKFLKNGDAGIIKMLPTKPMVVETFSQYPPLGRFAVRDMRQTVAVGVIKEVEKKDPTGAKVTKSAVKKK

SEQ ID NO: 4824 - protein, 391 aa, Trigonella foenum-graecum
AWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELVTKIDRRSGKEIEKEPKFLKNGDAGIIKMIPTKPMVVETFSEYPPLGRFAVRDMRQTVAVGVIKGVEKKDPTGAKVTKAAAKKK

SEQ ID NO: 4825 - protein, 400 aa, Salvia sclarea
NKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPEKIPFVPISGFEGDNMIERSTNLDWYKGPTLLEALDAVSEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAELMTKIDRRSGKELEKEPKFLKNGDAGMVKMIPTKPMVVETFSQYPPLGRFAVRDMRQTVAVGVIKSVEKKDPSGAKVTKAAAKKGAK

SEQ ID NO: 4826 - protein, 300 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFQR

SEQ ID NO: 4827 - protein, 401 aa, Helianthus annuus
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGGEGDNMIERSTKLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4828 - protein, 216 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCWNKMDATTPKYSKARYEEIVKEVSSYLKKVGYNPDKIAFVPISGFEGDNMIERSTNLDWYKGPTF

SEQ ID NO: 4829 - protein, 361 aa, Primula obconica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQVSEPKRPSDKPLRLPLQDVYKIGGIGTVPVGRVETGVIKPGMVVTFGPSGLTTEVKSVEMHHESLLEAHPGDNVGFNVKNVAVKDLKRGYVASNSKDDPAKGAASFTSQVIIMNHPGQVGNGYAPVLDCHTLPHCCEIL

SEQ ID NO: 4830 - protein, 389 aa, Panicum virgatum
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGM

SEQ ID NO: 4831 - protein, 392 aa, Ambrosia trifida
MNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVT

SEQ ID NO: 4832 - protein, 312 aa, Brassica juncea
MITGTSQADCAVLIIDSTTGGLEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVRPSLSTHPLDVLP

SEQ ID NO: 4833 - protein, 388 aa, Pennisetum glaucum
LDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKSVEKKDPTGAKVTKAAAKKK

SEQ ID NO: 4834 - protein, 390 aa, Papaver somniferum
WVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIAFVPISGFEGDNMIERSTNLDWYKGPTLLEALDNISEPKRPSDKPLRLPLQDVYKIGGIGTVPVGRVETGVIKPGMVVTFGPTGLTTEVKSVEMHHEALLEALPGDNVGFNVKNVAVKDLKRGFVASNSKDDPAREAANFTSQVIIMNHPGQIGNGYAPVLDCHTSHIAVKFAEIQTKIDRRSGKELEKEPKFLKNGDAGIIKMIPTKPMVVETFAQYPPLGRFAVRDMRQTVAVGVIKGVEKKDPTGAKVTKSAVKKK

SEQ ID NO: 4835 - protein, 386 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPALDCHTSHIAVKFAEIQTKIDRRSGKELEAAPKFLKNGD

SEQ ID NO: 4836 - protein, 390 aa, Nicotiana tabacum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPTDKPLRLPLQDVYKIGGIGTVPVGRVETGVLKPGMLVTFGPTGLTTEVKSVEMHHEALQEALPGDNVGFNVKNVAVKDLKRGYVASNSKDDPAKGAASFTSQVIIMNHPGQIGNGYAPVLDCHTSHIAVKFAEILTKIDRRSGKELEKEPKFLKNGDAGMV

SEQ ID NO: 4837 - protein, 335 aa, Ambrosia trifida
MITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGTASFTSQVIIMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVEKRTRWS

SEQ ID NO: 4838 - protein, 265 aa, Phalaenopsis aphrodite
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSSNLDWYKGPTLLEALDLIQEPSVLRTSPFVFRSRMSTRLEALELFLWEELRQESSNPELW

SEQ ID NO: 4839 - protein, 157 aa, Brassica napus
MLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVDDPSLRYPTTWDVSL

SEQ ID NO: 4840 - protein, 101 aa, Populus trichocarpa
MGKEKTHINIAVIGHVDSGKSTTTGHLTFKLGGIDKRVIERFEKEAAGMNKRSFKLPGFWTSLRLSVSAVSPLILLSGSLRPPSTTALSLMLLVIVTLLRI

SEQ ID NO: 4841 - protein, 396 aa, Utricularia gibba
FKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPEKIPFVPISGFEGDNMIERSTNLDWYKGPTLLEALDLINEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKEAANFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPTGAKVTKAAAKKGAK

SEQ ID NO: 4842 - protein, 399 aa, Euonymus alatus
MNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYEEIVKEVSSYLKKVGYNPDKIPFVPISGFEGDNMIERSTNLDWYKGPTLLEALDQISEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKEAASFTSQVIIMNHPGQIGNGYAPVLDCHTSHIAVKFAEILTKIDRRSGKEIEKEPKFLKNGDAGMVKMIPTKPMVVETFSAYPPLGRFAVRDMRQTVAVGVIKSVDKKEASAAKVTKSAAKKK

SEQ ID NO: 4843 - protein, 394 aa, Flaveria ramosissima
FKYAWVLDKLKAERERGITIDIALWKFETNKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKGASSFTSQVIIMNHPGQIGNGYAPVLDCHTSHIAVKFSEILTKIDRRSGKELEKEPKFLKNGDAGMVKMVPTKPMVVETFSEYPPLGRFAVRDMRQTVAVGVIKSVDKKDPTGAKVTKAAQKKK

SEQ ID NO: 4844 - protein, 401 aa, Brassica juncea
MNKRSFKYAWVLDKLKAERERGITIDIALWKFETTKYYCTVIDAPGHRDFIKNMITGTSQADCAVLIIDSTTGGFEAGISKDGQTREHALLAFTPGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4845 - protein, 189 aa, Musa acuminata
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVYQPGLVQGPNPSRGS

SEQ ID NO: 4846 - protein, 199 aa, Triticum aestivum
MVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAPRRNEMVSGSLLHHDGGWR

SEQ ID NO: 4847 - protein, 381 aa, Cicer arietinum
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGVIVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELLTKIDRRSGKELEKEPKF

SEQ ID NO: 4848 - protein, 384 aa, Secale cereale
KAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKELEAAPKFLKNGDAGFVKMIPTKPMVVETFAQYPPLGRFAVRDMRQTVAVGVIKSVEKKEPTGAKVTKAAIKKK

SEQ ID NO: 4849 - protein, 371 aa, Secale cereale
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRS

SEQ ID NO: 4850 - protein, 384 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEPKFLEE

SEQ ID NO: 4851 - protein, 392 aa, Primula obconica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKIPFVPISGFEGDNMIERSTNLDWYKGPTLLDALDQVSEPKRPSDKPLRLPLQDVYKIGGIGTVPVGRVETGVIKPGMVVTFGPSGLTTEVKSVEMHHESLLEAHPGDNVGFNVKNVAVKDLKRGYVASNSKDDPAKGAASFTSQVIIMNHPGQIGNGYAPVLDCHTSHIAVKFSEILTKIDRRSGKELEKEPKFLKNGDGGYGRR

SEQ ID NO: 4852 - protein, 348 aa, Ambrosia trifida
MITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVINMNHPGQIGNGYAPVLDCHTSHIAVKFSELLTKIDRRSGKELEKEPKFLKNGDAGMVKMLPTKPMVVETFAEYPPLGRFAVRDMRQTVAVGVIKSVDKKDPTGAKVTKAAAKKGAK

SEQ ID NO: 4853 - protein, 399 aa, Cephalotaxus harringtonia
MNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSSNLDWYKGPTLLDALDQVSEPKRPTDKPLRLPLQDVYKIGGIGTVPVGRVETGVLKPGMLVTFGPSGLTTEVKSVEMHHEALQEALPGDNVGFNVKNVAVKDLKRGYVASDSKNDPAKEAANFTSQVIIMNHPGQIGNGYAPVLDCHTCHIAVKFAEILTKVDRRSGKELEKEPKFIKNGDAGFVKMVPTKPMVVETFSDYPPLGRFAVRDMRQTVAVGVIKAVEKKEPSGAKVTKAAAKKK

SEQ ID NO: 4854 - protein, 397 aa, Euonymus alatus
GYHFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGTVVTFGPTGLTTEVKSVEMHHEALQEALPGDNVGFNVKNVAVKDLKRGFVASDSKNDPAKEAASFTSQVIIMNHPGQIGNGYAPVLDCHTSHIAVKFAEILTKIDRRSGKELEKEPKFLKNGDAGMVKMIPTKPMVVETFSAYPPLGRFAVRDMRQTVAVGVIKSVDKKEASAAKVTKSAAKKK

SEQ ID NO: 4855 - protein, 388 aa, Ananas comosus
LDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDLIQEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKEDPAKEAASFTSQVIIMNHPGQIGNGYAPVLDCHTSHIAVKFAEILTKIDRRSGKELEKEPKFLKNGDAGFVKMIPTKPMVVETFSEYPPLGRFAVRDMRQTVAVGVIKSVEKKDPTGAKVTKAAAKKK

SEQ ID NO: 4856 - protein, 217 aa, Panicum virgatum
MGKKKSHINIVVIGHISSGKSTTTGHLIYKLGGIDKHMMQKLQKEAAIMNKKSVKYAWVLDKLKAERERGITIDITLSKFETSKYYCTVIDAPGHRDFIKNMITGTSQADCAILILDSTTGGYEAGISKDGQTCEHALIAFTLGVKQMICCCNKMDATAPRYSKARYDEIVKDISHFLKKVGYNPDKIPFVPISGIEGDNLTERSTKLDWYKGANPA

SEQ ID NO: 4857 - protein, 341 aa, Chelidonium majus
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPTDKPLRLPLQDVYKIGGIGTVPVGRVETGLIKPGMVVTFGPTGLTTEVKSVEMHHEALQEALPGDNVGFNVKNVAVKDLKRGFVRPTPRMTLPGKPLTSPPGHHHEPPWSDR

SEQ ID NO: 4858 - protein, 389 aa, Curcuma longa
TRYKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDLIQEPKRPTDKPLRLPLQDVYKIGGIGTVPVGRVETGVLKPGMVVTFGPTGLTTEVKSVEMHHEALQEALPGDNVGFNVKNVAVKDLKRGFVASNSKDDPAKEAANFTSQVIIMNHPGQIGNGYAPVLDCHTSHIAVKFAEILTKIDRRSGKELEKEPKFLKNGDAGFVKMIPTKQMVVETFSEYPPLGRFAVRDMRQTVAVGVIKSVEKKDPTGAKVTKAAAKKK

SEQ ID NO: 4859 - protein, 385 aa, Secale cereale
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKSRYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTCHIAVKFAEIQTKIDRRSGKELEAAAQVPQER

SEQ ID NO: 4860 - protein, 381 aa, Vinca minor
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIIKEVSSYLKKVGYNPDKIPFVPISGFEGDNMIERSTNLDWYKGPTLLEALDQISEPKRPSDKPLRLPLQDVYKIGGIGTVPVGRVETGVIKPGMVVTFGPTGLTTEVKSVEMHHEALQEALPGDNVGFNVKNVAVKDIKRGYVASNSKDDPAKGAASFTSQVIIMNHPGQIGNGYAPVLDCHTSHIAVKFAELLTKIDRRSGKELEKEPKF

SEQ ID NO: 4861 - protein, 382 aa, Cicer arietinum
MGKEKFHINIVVIGHVDSGKSTTTGHLIYKLVGIDKRVIERFEKEAAEMNKRSFKYAWVLDKLKAERERGITIDIALWKFETTKYYCTVIDAPGHRDFIKNMITGTSKLIVLSLSLTPPLVVFEAGISKDGQTREHALLVFHSWSETDDLLLYKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGVIVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFAELLTKIDRRSGKELEKEPKFL

SEQ ID NO: 4862 - protein, 99 aa, Cicer arietinum
MITGTSQADCAVLIIDSTTGGFEAGISKDGQTREHALLAFTLGVKQMICCCNKMDATTPKYSKARYDEIVKEVSSYLKKVGYNPDKIPSFQSLDLRETT

SEQ ID NO: 4863 - protein, 379 aa, Eschscholzia californica
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTVLEALDQINEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFGEILTKIDRRSGKELEKEP

SEQ ID NO: 4864 - protein, 398 aa, Utricularia gibba
NKRSFKYAWVLDKLKAERERGITIDIALWKFETNKYYCTVIDAPGHRDFIKNMITGTSQADCAVLIIDSTTGGFEAGISKDGQTREHALLAFTLGVKQMICCLNKMDATTPKYSKARYEEIQKEVSSYLKKVGYNPEKVPFVPISGFEGDNMIERSTNLDWYKGPTLLEALDNVTEPKRPSDKPLRLPLQDVYKIGGIGTVPVGRVETGVIKPGMVITFAPTGLTTEVKSVEMHHESLPEANPGDNVGFNVKNVSVKELKRGFVASDSKNDPAKEAANFTAQVIIMNHPGQIGNGYAPVLDCHTSHIAVKFAEILVKIDRRSGKEIEKEPKFVKNGDACFVKMIPSKPMCVETFSTYPPLGRFAVRDMRQTVAVGVIKAVEKKDATSAKVTKAAVKKK

SEQ ID NO: 4865 - protein, 154 aa, Secale cereale
MVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTQAHWLWRPSPPTLLLAASLCVT

SEQ ID NO: 4866 - protein, 243 aa, Triticum aestivum
MIERSTNLDWYKGPTLLEALDLINEPKRPSDKPLRLPLQDVYKIGGIGTVPVGRVETGVIKPGMVVTFGPTGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAA

SEQ ID NO: 4867 - protein, 381 aa, Brassica napus
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKF

SEQ ID NO: 4868 - protein, 385 aa, Papaver somniferum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLDALDNISEPKRPSDKPLRLPLQDVYKIGGIGTVPVGRVETGFIKPGMVVTFGPTGLTTEVKSVEMHHEALQEALPGDNVGFNVKNVAVKDLKRGFVASNSKDDPAREAANFTSQVIIMNHPGQIGNGYAPVLDCHTSHIAVKFAEILTKIDRRSGKELEKDAQVLEEW

SEQ ID NO: 4869 - protein, 347 aa, Triticum aestivum
MITGTPRADCAVLIIDSTTGGFEAGISKDGQTREHAPLAFTLGVKQMICCCNKMDATTPKYSKARYEEIVKEVSSYLKKVGYNPDKVPFVPISGFEGDNMIERSTNLDWYKGPTLLEALDQINEPKRPSRTSPSVFPFRTCTRLAALELCQWAVLRLESSSQAWLSPFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 4870 - protein, 227 aa, Gossypium hirsutum
KLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPNLQGCLQDWWHWNCTCWSC

SEQ ID NO: 4871 - protein, 293 aa, Eragrostis curvula
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVPIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALQEALPG

SEQ ID NO: 4872 - protein, 381 aa, Brassica juncea
MGKEKFHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTNIDRRSGKEIEKEPKF

SEQ ID NO: 4873 - protein, 375 aa, Parthenium argentatum
MGKEKIHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFSELLTKIDRRSGKEL

SEQ ID NO: 4874 - protein, 386 aa, Orobanche aegyptiaca
KAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKINFVPISGFEGDNMIERSTNLDWYKGPTLLEALDMIQEPKRPSDKPLRLPLQDVYKIGGIGTVPVGRVETGIIKPGMLVTFGPTGLTTEVKSVEMHHESMPEALPGDNVGFNVKNVAVKDLKRGFVASNSKDDPAKEAANFTSQVIIMNHPGQIGQGYAPVLDCHTSHIAVKFAELVTKIDRRSGKEIEKEPKFLKNGDAGMVKMIPTKPMVVETFSEYPPLGRFAVRDMRQTVAVGVIKSVEKKDPSGAKVTKAAAKKGAK

SEQ ID NO: 4875 - protein, 164 aa, Papaver somniferum
MFTRLEVSELCQLDVLKPESSSLVWLLPFGPTGLTTEVKSVEMHHEALQEALPGDNVGFNVKNVAVKDLKRGFVASNSKDDPAREASNFTSQVIIMNHPGQIGNGYAPVLDCHTSRISVKFAEILTKIDRRSGKELEKEPKFSTFSVAAYLSCKSEYSHKNNIS

SEQ ID NO: 4876 - protein, 373 aa, Flaveria ramosissima
MGKEKTHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVIKPGMVVTFGPSGLTTEVKSVEMHHEALTEALPGDNVGFNVKNVAVKDLKRGYVASNSKDDPAKGAASFTSQVIIMNHPGQIGNGYAPVLDCHTSHIAVKFSELLTKIDRRSGK

SEQ ID NO: 4877 - protein, 438 aa, Marchantia polymorpha
MASEKVHINIVVIGHVDSGKSTTTGHMIYKLGGIDQSVIDRFEEEATEMNKQSFKYAWVLDKLKAERERGITIDIALMKFETSKYSCTVIDAPGHRDFIKNMITGTSQADCALLMIDSTTGGFEAGFSKDGQTREHALLAFTLGVEQMICCCNKMDATSPPYSQERYEEIKQEVSGYLEMVGYNPENIPFVPISGFQGDNMIEKSENLEWYEGPTLLEALDNVTEPKRPSDKPLRLPLQDVYKIGGIGTVPVGRVETGVIKPGMMVCFAPTGLTAEVMSVEMHHEALSEALPGDNVGFNVKDVSAKELKRGFVASDSENDPAREAASFTSQVIIMNHPGQIANGYAPVLDCHTSHVAVKFAEVLSKIDRHSGEELEQEPKFLKSGEAGMVKMIPSRPLTVEAFAEYPPLGRFAVRDSRQTVAVGVIKAVEKKDPACEK

SEQ ID NO: 4878 - protein, 389 aa, Podocarpus macrophillus
MGKEKTHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLDALDQVSEPKRPSDKPLRLPLQDVYKIGGIGTVPVGRVETGVLKPGTVVTFGPTGLTTEVKSVEMHHEALVEALPGDNVGFNVKNVAVKDLKRGYVASDSKNDPAKEAANFTSQVIIMNHPGQIGNGYAPVLDCHTCHIAVKFSEILTKVDRRSGKELEKEPKFLRMEMLDL

SEQ ID NO: 4879 - protein, 63 aa, Brassica napus
MDATTPKYSKARYDEIIKEVSSYLKKVGYNPDKIPFVPISGFEGDNMIERSTNLDWYKGTNSP

SEQ ID NO: 4880 - protein, 110 aa, Flaveria ramosissima
ERGITIDIALWKFETTKYYCTVIDAPGHRDFIKNMITGTSQADCAVLIIDSTTGGFEAGISKDGQTREHALLAFTLGVKQMICCCNKMDATTPKYSKSRYEEIVKECHLT

SEQ ID NO: 4881 - protein, 381 aa, Fagus grandifolia
MGKEKVHINIVVIGHVDSGKSTTTGHLIYKLGGIDKRVIERFEKEAAEMNKRSFKYAWVLDKLKAERERGITIDIALWKFETTRYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNLTNPLVPISGFEGDNMIERSTNLDWYKGPTLLDALDQISEPKRPSDKPLRLPLQDVYKIGGIGTVPVGRVETGVVKPGMVVTFGPTGLTTEVKSVEMHHEALLEALPGDNVGFNVKNVAVKDLKRGFVASNSKDDPAREAANFTSQVIIMNHPGQIGNGYAPVLDCHTCHIAVKFSEILTKIDRRSGKELEKETLNF

SEQ ID NO: 4882 - protein, 387 aa, Brassica napus
LKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIIKEVSSYLKKVGYNPDKIPFVPISGFEGDNMIERSTNLDWYKGPTLLEALDQINEPKRPSDKPLRLPLQDVYKIGGIGTVPVGRVETGMLKPGMVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4883 - protein, 385 aa, Cicer arietinum
KAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGFVVTFAPTGLSTEVKSVEMHHEALTEALPGDNVGFNVKNVAVKDLKRGYVASNSKDDPAKEAGNFTSQVIIMNHPGQIGNGYAPVLDCHTSHIAVKFAELITKIDRRSGKEIEKEPKFLKNGDAGLVKMIPTKPMVVETFAEYPPLGRFAVRDMRQTVAVGVIKSVEKKEPSGGGKKTISAVKKK

SEQ ID NO: 4884 - protein, 210 aa, Brassica napus
MSTRVGGIGTVPVGRVETGMLKPGMVVTFAPSGLTTEVKSVEMHHESPVEALPGDNVGFNVKNVAVKDLKRGYVASNSKDDPAKGAANFTSQVIIMNHPGQIGNGYAPVFDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4885 - protein, 210 aa, Brassica napus
MSTRSVVLERCQWVVWRLVCSSPVLVVTFAPSGLTTEVKSVEMHHESLVEALPGDNVGFNVKNVAVKDLKRGYVASNSKDDPAKGAANFTSQVIIMNHPGQIGNGYAPVLDCHTSHIAVKFSEILTKIDRRSGKEIEKEPKFLKNGDAGMVKMTPTKPMVVETFSEYPPLGRFAVRDMRQTVAVGVIKSVDKKDPTGAKVTKAAVKKGAK

SEQ ID NO: 4886 - protein, 198 aa, Leymus cinereus x Leymus triticoides
MSAATAAPIGLSWAPQLPSLAAAGGSKKGSAPTPSIDAQESLWKPSNDLVDGLYVPPRDPRKVNKMARKNVKDTTGMGWFDMPAPSITPELKKDLEILQLRHVMDPKRHFKRSGKSKALPKYFQVGTVVEPASEYYSSRLTKHERKQTLVDELLSDQKLKNYRMRKVREIQVARTPGGNQKWKNKGKQTFKRAKDRRK

SEQ ID NO: 4887 - protein, 198 aa, Triticum aestivum
MSSSSAAPIGLSWAPQLPSLAAAGGSKKGSAPTPSIDAQESLWKPSNELVDGLYVPPRDPRKVNKMARKNVKDTTGKGWFDMPAPSITPELKKDLEILQLRHVMDPKRHFKRSGKSKALPKYFQVGTVIEPASEFYSSRLTKHERKQTLVDELLSDQKLKNYRMRKVREIQVARTPGGNQKWKNKGKQTFKRAKDRRK

SEQ ID NO: 4888 - protein, 133 aa, Secale cereale
MARKSVKDTAGKGWFDMPAPSITPELKKDLEILQLRHVMDPKRHFKRSGKSKALPKYFQVGTVIEPASEYYSSRLTKHERKQTLADELLSDQKLKNYRMRKVREIQVARTPGGNQKWKNKGRQTFKRAKDRRK

SEQ ID NO: 4889 - protein, 197 aa, Avena sativa
MAEAPIGLSWAPKLPSLPSAGGSSSKKGSAPTQSIDAKDSLWRPSSELVDGLFVPPRDPRKLNKMARKNVKDTTGKGWFDMPAPTITPELKKDLEILQLRHVMDPKRHFKRSGKSKALPKYFQVGTVIAPASEFYSSRLTKQEQKTTLVDELLSDPKLKNYRMRKVREIQETRTPGGNQKWKNKGRQTFKRAKDRRK

SEQ ID NO: 4890 - protein, 197 aa, Brachypodium distachyon
MSEAAAAPIGLSWAPKLPSLPAAGGGKKGLGTDLSAHGSSLWKPGNELVDGLFVAPRDPRKVNKLARKNVKDTTGKGWFDMPAPSITPELKKDLHILQLRHVMDPKRHFKRSGKSKVLPKYFQIGTVIEPAHEFWSSRLTKRERKTTLVDELLSDQKLKNYRMGKVREIQETRKPGGNEKWKNKGRQTFKRAKDRRK

SEQ ID NO: 4891 - protein, 197 aa, Panicum virgatum
MPEAAAPIGLSWAPNLPSLATTSGGSKSDPAPKPSTAQGSIWKPASELVDGLFVPPTDPRKVNKLARKSVKDTTGKGWFDMPAPSITPELKKDLEILQLRHVMDPKRHFKRAGKSKALPRYFQVGTVVEPASEFYSGRLTKRERKTTLVDELLSDQSLKSYRKRKVREIQESRTPGGNQKWKNKGKQTLKRAKDRRK

SEQ ID NO: 4892 - protein, 197 aa, Panicum virgatum
MPEAAAPIGLSWAPNLPSLATMSGGSKSDPAPKPSTAQGSIWKPASELVDGLFVPPTDPRKVNKLARKSVKDTTGKGWFDMPAPSITPELKKDLEILQLRHVMDPKRHFKRAGKSKALPRYFQVGTVVEPASEFYSGRLTKRERKTTLVDELLSDQSLKSYRKRKVREIQESRTPGGNQKWKNKGKQTLKRAKDRRK

SEQ ID NO: 4893 - protein, 197 aa, Panicum virgatum
MSETAAPIGLSWAPKLPSLAMTSGGSKSDPAPKTSTVQGSIWKPASELVDGLFVPPTDPRKVNKLARKNIKDTTGKGWFDMPAPSITPELKKDLEILQLRHVMDPKRHFKRAGKSKALPRYFQVGTVVEPPSEFYSGRLTKRERKTTLVDELLSDQSLKNYRKRKVREIQENRTPGGNQKWKNKGKQTLKRAKDRRK

SEQ ID NO: 4894 - protein, 197 aa, Zea mays
MSETAAPIGLSWAPKLPSFATTSGGSKIDHAPDPSTAQGSLWKRTSELVDGLFVPPRDPRQLNKLARKNVKDTAGKGWFDMPAPTITPELKKDLEILQLRHVIDPKRHFKRAGKSKALPKYFQVGTVVEPASEFYSSRLKNRERKATLVDELLSDQSLKSYRMRKVREIQEIRTPGGNQKWKNKGKKTLKRAKDRRK

SEQ ID NO: 4895 - protein, 197 aa, Panicum virgatum
MSETAAPIGLSWAPKLPSLATTSGGSKSDPAPKTSTAQGSIWKPASELVDGLFVPPIDPRKVNKLARKNVKDTTGKGWFDMPAPSITPELKKDLEILQLRHVMDPKRHFKRAGKSKALPRYFQVGTVVEPPSEFYSGRLTKRERKTTLVDELLSDQSHKSYRKRKVREIQESRTPGGNQKWKNKGKQTLKRAKDRRK

SEQ ID NO: 4896 - protein, 197 aa, Sorghum bicolor
MSETAAPIGLSWAPKLPSFATTSGSSKSDHAPNPSTAQGSLWKPSSELVDGLFVPPRDPRQLNKLAKKNVKDTTGKGWFDMPAPTITPELKKDLEILQLRHVIDPKRHFKRAGKSKALPKYFQVGTVVEPASEFYSSRLKNRERKATLVDELLSDQSLKSYRMRKVREIQEIRTPGGNQKWKNKGKQTLKRAKDRRK

SEQ ID NO: 4897 - protein, 195 aa, Oryza sativa
MAEAAPIGLSWAPKLPSLPTTSGGKKDTGASSSRAQGSLWKPASELVDGLFVPPRDPRKANKLARKNVKDTSGKGWFDMPAPTITPELKKDLEILQLRHVMDPKRHFKRAGKSKALPKYFQVGTVIEPASEFFSSRLTKRERKTTLVDELLSDQHLKNYRMRKVREIQESRTPGGSQKWRNKGKKTLKRAKDRRK

SEQ ID NO: 4898 - protein, 197 aa, Setaria italica
MSETAAPIGLSWAPKLPSLATTSCSSKSEPAPKPSTAQGSLWKPQSELVDGLFVSPRDPKKVNKLTRKSVKDTTGKGWFDMPAPTITPELKKDLEILQLRHVMDPKRHFKRAGKSKALPKYFQVGTVVEPASEFYSGRMTRRERKTTLVDELLSDQYLKSYRMRKVREIQESRMPGGNQKWKNKGKQTLKRAKDRRK

SEQ ID NO: 4899 - protein, 643 aa, Brachypodium distachyon
MSTPRSSASSPDPIPHKSVTLAPSLGMRDPEEDSDSTPSRMSEDDDCSGGGGGGGWTPDLRGGGGRWAPPDQVLEIVLESVLEFLTAARDRNAASLVCRSWYRAEAQTRRELFIGNCYAVSPRRAVERFGGVRAVVLKGKPRFADFSLVPHGWGAYVSPWFAALGPAYPRLERICLKRMTVSDDELALIPRSFPLFKELSLVCCDGFSTRGLAIIAEGCRHLRVLDLTEDYFHEEENEVVDWISKFPESNTSLESLVFDCVSVPFNFEALEALVARSPALRRLRVNDHVSIEQLRCLMARAPRLTHLGTGSFRSEPGSGGTSSVSELATSFAASRSLVCLSGFLDVNAEYLPAIYPVCANLTSLNFSFASLTAEEIIPVINHCVSLRTFWVLDTVGDEGLRAVAETCSDLRELRVFPLDATEDSEGSVSDIGLQAISEGCRKLESILYFCQRMTNAAVIAMSENCPNLVVFRLCIMGRHRPDRITGEPMDEGFGAIVMNCKKLTRLSVSGLLTDKAFAYIGKYGKLIKTLSIAFAGNSDMSLQHVFEGCTRLQKLEVRDSPFGDKGLLSGMNYFYNMRFFWMNSCRLTAKGCRDVAQQMPNLVVEVMKEHPEDEGETDTVDKLYLYRSLAGPRNDAPSFVNIL

SEQ ID NO: 4900 - protein, 595 aa, Triticum aestivum
GGPGGGDRWAPDLRGCSNGGRWAPPDQVLENVLESVLEFLTAARDRNAASLVCRSWYRAEAQTRRELFIGNCYAVSPRRAVERFGGVRAVVLKGKPRFADFSLVPHGWGANVSPWVAALGPAYPRLERICLKRMTVSDDELALIPRSFPLFKELSLVCCDGFTTRGLAVIAEGCRHLRVLDLTEDYFHEEESEVVDWISKFPECNTSLESLVFDCVSVPFNFEALEALVARSPALRRLRVNDHVSIEQLRRLMARAPHLTHLGTGSFRSEPGPGGALSVSELATSFAASRSLVCLSGFLDANAAYLPAIYQVCANLTSLNFSFAGLTAEEFIPVIRHCVNLRTLWVLDTVGDEGLRAVAETCSNLRELRVFPLDATEDSEGSVSDIGLQAISEGCRMLESILYFCQRMTNAAVIAMSENCPDLLVFRLCIMGRHRPDRITGAPMDEGFGAIVMNCKKLTRLSVSGLLTDKAFAYIGRHGKLIKTLSVAFAGNSDMSLQHVFEGCTRLQKLEVRDSPFGDKGLLSGLNYFYNMRFFWMNSCRLTVKGCGDVAQQMPNLVVEVMKENEGEMDTVDKLYLYRSLAGPREDAPSFVNIL

SEQ ID NO: 4901 - protein, 635 aa, Brachypodium distachyon
MSTPRSSSSSPDPIPNPSVTLAGSPGMRDAEEGPDSPPSRMSEDGNGGAWTPDLRCGRWAPPDQVLEIVLESVLEFLTAARDRNAASLVCRSWYRAEAQTRRELFIGNCYAVSPRRAVERFGGVRAVVLKGKPRFADFSLVPQGWGAYFSTWVAALGPAYPCLERIFLKRMTVSDDELALIPKSFPLFKELSLVCCDGFSTRGLATIAEGCRHLRVLDLTEDYFHEDENQVVDWISKFPECNTMLESLVFDCVGVPFNFEALEALVARSPALRQLRVNDHVSIEQLRRLMARAPHITHLGTGSFHSEPGSGGASSVSELATSFAATRSLVCLSGFLDFNAEYLPAIYPVCVNLTSLNFSFASLTAEELIPVICHCISLRIFWVLDTVGDEGLQAVAETCSDLRELRVFPLDATEDSEGSVSDIGLQAISEGCRKLESILYFCQRMTNAAVIAMSENCPDLVVFRLCIMGRHRPDRITGEPMDEGFGAIVMNCKKLTRLSVSGLLTDKAFAYIGKYGKLIKTLSVAFAGNSDMSLQHVFEGCIRLQKLEVRDSPFGDKGLLSGMNYFYNMRFFWMNSCRLTVKGCRDLAQQMPNLVVEVMKDHPDEEGEIDTVDKLYLYRSLAGPRNDAPSFVNIL

SEQ ID NO: 4902 - protein, 667 aa, Oryza sativa
MSTSPSCSSSSPIPQSLTLASTSSSSSSSGMRDAGEGSDSPPSEMSEDGSGGSGDGDGDGDGGGGGGDRWMPDLRGGNGGGGGGGGGGGRWAPPDQVLENVLESVLEFLTAARDRNAASLVCRSWYRAEAQTRRELFIGNCYAVSPRRAVERFGGVRAVVLKGKPRFADFSLVPYGWGAYVSPWVAALGPAYPHLERICLKRMTVSNDDLALIAKSFPLFKELSLVCCDGFSTLGLAAIAERCRHLRVLDLIEDYIDEEEDELVDWISKFPESNTSLESLVFDCVSVPFNFEALEALVARSPAMRRLRMNHHVTVEQLRRLMARAPQLTHLGTGAFRSEPGPGGALSVTELATSFAASRSLICLSGFRDVNPEYLPAIHPVCANLTSLNFSFANLTAEELTPIIRNCVRLRTFWVLDTVGDEGLRAVAETCSDLRELRVFPFDATEDSEGSVSDVGLQAISEGCRKLESILYFCQRMTNAAVIAMSKNCSDLVTFRLCIMGRHRPDRITGEPMDDGFGAIVMNCKKLTRLSVSGLLTDKAFAYIGKYGKLIKTLSVAFAGNSDMSLQSVFEGCTRLQKLEVRDSPFSDKGLLSGLSYFYNMRFLWMNSCRLTMRGCRDVAQQMPDLVVEVMKDHLDDEGEMETVDKLYLYRSLAGARNDAPSFVNIL

SEQ ID NO: 4903 - protein, 665 aa, Setaria italica
MSTPHSSSTSSSPAPHRASPPQIPQSLTLAPPTASSASPSSSSASGMRDAAEDDSDSPPSQMSEDDPGGGGGDRWEPDLRGGNGGGGRWAPPDQVLENVLESVLEFLTAARDRNAASLVCRSWYRAEAQTRRELFIGNCYAVSPRRAVERFGGLRSVVLKGKPRFADFSLVPYGWGAYVSPWVAALGPAYPRLERICLKRMTISDDDLHLVAKSFPLFRELSLVCCDGFSTVGLAAIAKLCRHLRVLDLIEDYVEDEDDELVDWISKFPESNTSLESLVFDCVSVPFNFEALEVLVARSPALRRLRVNHHVSVEQLRRLMARAPQLTHFGTGAFRSEAAPGGGLSVTELATSFAASRSLICLSGFRDVNPEYLPAIYPVCAKLTSLNFSFASLTAEELKPVIRNCINLRTFWVLDTVGDEGLRAVADTCSELRELRVFPLDASEDSEGSVSDVGLQAISEGCRKLESILYFCQRMTNAAVIAMSKNCPDLVVFRLCIMGRHRPDRITGEPMDDGFGAIVMNCKKLTRLSVSGLLTDKAFAYIGKYGKLIKTLSVAFAGNSDMSLQYIFEGCTKLQKLEVRDSPFSDKGLLSGLNYFYNMRFLWMNSCRLTMRGCKDVAQQMQNLVVEVIKDHPDDEGEAEIVDKLYLYRSLAGPRNDAPPFVTLL

SEQ ID NO: 4904 - protein, 622 aa, Panicum virgatum
MRDAAEDDSDSPPSQMSEDDPGGGGGGGDRWEPDLRGGNGGGGGRWAPPDQVLENVLESVLEFLTAARDRNAASLVCRSWYRAEAQTRRELFIGNCYAVSPRRAVERFGGLRSVVLKGKPRFADFSLVPYGWGAYVSPWVAALGPAYPRLERICLKRMTVSDDDLALVAKSFPLFRELALVCCDGFSTLGLAVIAERCRHLRMLDLIEDYLEDEDDELVDWISKFPESNTSLESLVFDCVSVPFNFEALEALVARSPALRRLRVNHHVSVEQLRRLMARAPQLTHFGTGAFRSEAAPGAGLSVTELATSFAASKSIICLSGFRDVNPEYLSAIYPVCAKLTSLNFSFASLTAEELKPVIRNCINLRTFWVLDTVGDEGLRAVADTCSDLRELRVFPLDASEDSEGSVSDVGLQAISEGCQKLESILYFCQRMTNAAVIAMSKNCPDLVVFRLCIMGRHRPDWITGEPMDDGFGAIVMNCKKLTRLSVSGLLTDKAFAYIGKYGKLIKTLSVAFAGNSDMSLQYIFEGCTKLQKLEVRDSPFSDKGLLSGMNYFYNMRFLWMNSCRLTMRGCKDVAQQMQNLVVEVIKDHSDDEGEAEIVDKLYLYRSLAGPRNDAPPFVTLL

SEQ ID NO: 4905 - protein, 665 aa, Panicum virgatum
MSTPHSSSTSSAPHRASPPQIPQSLTLAAPTASSASPSSSSASGMRDAAEDDSDSPPSQMSEDDPGGGGGGDRWEPDLRGGNGGGGGRWAPPDQVLENVLESVLEFLTAARDRNAASLVCRSWYRAEAQTRRELFIGNCYAVSPRRAVERFGGLRSVVLKGKPRFADFSLVPYGWGAYVSPWVAALGPAYPRLERICLKRMTVSDDDLALVAKSFPLFRELALVCCDGFSTLGLAVIAERCRHLRMLDLIEDYLEDEDDELVDWISKFPESNTSLESLVFDCVSVPFNFEALEALVARSPALRRLRVNHHVSVEQLRRLMARAPQLTHFGTGAFRSEAAPGAGLSVTELATSFAASKSIICLSGFRDVNPEYLSAIYPVCAKLTSLNFSFASLTAEELKPVIRNCINLRTFWVLDTVGDEGLRAVSDTCSDLRELRVFPLDASEDSEGSVSDVGLQAISEGCQKLESILYFCQRMTNAAVIAMSKNCPDLVVFRLCIMGRHRPDWITGEPMDDGFGAIVMNCKKLTRLSVSGLLTDKAFAYIGKYGKLIKTLSVAFAGNSDMSLQYIFEGCTKLQKLEVRDSPFSDKGLLSGKNYFYNMRFLWMNSCRLTMRGCKDVAQQMQNLVVEVIKDHSDDEGEAEIVDKLYLYRSLAGPRNDAPPFVTLL

SEQ ID NO: 4906 - protein, 618 aa, Panicum virgatum
MRDAAEDASDSPPSQMSEDDPGGGGGGGDRWEPDLRGGNGRWAPPDQVLENVLESVLEFLTAARDRNAASLVCRSWYRAEAQTRRELFIGNCYAVSPLRAVERFGGLRSVVLKGKPRFADFSLVPYGWGAYVSPWVAALGPAYPRLERICLKRMTVSDDDLALVAKSFPLFRELALVCCDGFSTLGLAVIAERCRHLRMLDLIEDYVEDEDDELVDWISKFPESNTSLESLVFDCVSVPFNFEALEALVARSPALRRLRVNHHVSVEQLRRLMARAPQLTHFGTGAFRSEAAPGGGLSVTELATSFAASKSIICLSGFRDVNPEYLPAIYPVCAKLTSLNFSFASLTTEELKPVIRNCINLRTLWVLDTVGDEGLRAVADTCSDLRELRVFPLDASEDSEGSVSDVGLQAISEGCRKLESILYFCQRMTNAAVIAMSKNCPDLVVFRLCIMGRHRPDWITGEPMDDGFGAIVMNCKKLTRLSVSGLLTDKAFAYIGKYGKLIKTLSVAFAGNSDMSLQYIFEGCTKLQKLEVRDSPFSDKGLLSGMNYFYNMRFLWMNSCRLTMRGCKDVAQQMQNLVVEVIKDHSDDEGEAEIVDKLYLYRSLAGPRNDAPPFVTLL

SEQ ID NO: 4907 - protein, 662 aa, Sorghum bicolor
MSTPHSSSTSSVPHRASPPQIPPSLTLAPTASSASPSSSSASGMRDAAEDDSDSPPSQMSEDDPGGGGDRWEPDLRGGNNGGGGRWAPPDQVLENVLETVLEFLTAARDRNAASLVCRSWYRAEAQTRRELFIGNCYAVSPRRAVERFGGLRAVVLKGKPRFADFSLVPYGWGAYVSPWVAALGPAYPRLERICLKRMTVSDDDLALIAKSFPLFRELSLVCCDGFSTVGLAVIVERCRHLRVLDLIEDYLEDEEDELVDWISKFSESNTSLESLVFDCVSVPFNFEALEALVARSPALRRLRVNHHVSVEQLRRLMARAPQLTHFGTGAFRSEGAPDGGLAVTELATSFAAARSLVCLSGFREVDPQYLPAIYPVCAKLTSLNFSFASLTAAELKPVIRNCTNLRTFWVLDTVGDEGLRAVADTCSDLRELRVFPLDASEDSEGSVSDVGLQAISEGCRKLESILYFCQRMTNEAVIAMSKNCPELVAFRLCIMGRHRPDRVTGDPMDEGFGAIVMNCKKLTRLSVSGLLTDKAFAYIGKYGKLIKTLSVAFAGNSDMSLQYVFEGCTKLQKLEVRDSPFTDRGLLSGLNYFYNMRFLWMNSCRLTMRGCKDVAQQMQNLVVEVIKDHSEDEGEAEIVDKLYLYRSLAGPRNDAPPFVTLL

SEQ ID NO: 4908 - protein, 110 aa, Triticum aestivum
MNSRPIVLVFLLLVLIISSQFEWKQQIGEAEASPEATRRRQQPLVVREDAVKEKIILAQEKNIQQLTELIQSLQVQLLHCRGSNSTAHGASSNQSSASYAEADRHQIIDD

SEQ ID NO: 4909 - protein, 110 aa, Triticum aestivum
MNSRPIVLVFLLLVLIISSQFEWKQQIGEAEASPEATRRRQQPQVVREDAVKEKIILAQEKNIQQLTELIQSLQVQLLHCRGSNSTAHGASSNQSSASYAEADRHQIIDD

SEQ ID NO: 4910 - protein, 110 aa, Triticum aestivum
MNSRPIVLVFLLLVLIISSQFEWKQQIGEAEASPEATRRRQQPQIVREDAVKEKIILAQEKNIQQLTELIQSLQVQLLHCRGSNSTAHGASSNQSSASYSEADRHQIIDD

SEQ ID NO: 4911 - protein, 110 aa, Secale cereale
MNSRPIVLIFLLLVLIISSQFEWKQQIGEAEASPEATLRRQQPAVLREDAVKEKIILAQEKNIQQLTELIQSLQVQLLHCRGSNNTAHGGSSNQSSTSYSEADRHQIIDD

SEQ ID NO: 4912 - protein, 110 aa, Secale cereale
MNSRPIVLIFLLLVLIISSQFEWKQQIGEAEASPEATLRRQQPAVLREDAVKEKIILAQEKNIQQLTELIQSLQVQLLHCRGSNNTAHGGSSNQSSTSYSEADTHQIIDD

SEQ ID NO: 4913 - protein, 111 aa, Lolium multiflorum
MNSRPIVLVFLLLVLIITSQFEWKQQIGEAEASPEATRRRQQALVVREDAVKEKIILAQEKNIQQLTELIQSLQVQLLHCRGSNSTTAHSASSNQSSTNDTEAEGHELIDD

SEQ ID NO: 4914 - protein, 111 aa, Avena sativa
MNSRPIVLIFLLLVLIITSQFEWKQQIGEAEASPEATRRRQQALVLREDAVKEKIILAQEKNIQQLTELIQSLQVQLLHCRGSNSTTAHSASSNQSSTNDTEAEGHEIIDD

SEQ ID NO: 4915 - protein, 398 aa, Brachypodium distachyon
MYGEDARTVAELSIDDYLYPDADVYNVSGLPPIALPPPTCNLARGRWLFDNVTTPLYREHECTFLTKQVTCLENGRPDDTWQYWKWQPNDCSLPTFDARRFMERMRGKRMMFVGDSLNRNQWESMVCMVQGVLSKGRKKVIKRGSLTIFHAKEYRATLEFYWAPFLVESNSDNPRIHSIDHRIIRPERIEGHAKYWRGVDYLIFNTYIWWMNTADMKVRRPDSRYWSEHDEVPRIDAYGRVLKTWSDWLEENIDPARTSVFFMTISPLHISPDKWGNPSAIKCFNETLPVLNYTEPFDLNHDMRMYDLVASTSRSMKKVPVTLIDITRMSDYRKDAHTSVYTIRRDRLLTPKQRADPEKFADCIHWCLPGVPDVWNTVLFTRIFSKSSPPPLPSLPPQ

SEQ ID NO: 4916 - protein, 401 aa, Triticum aestivum
MYGEDARTIAELSIDDYLYPDADIYNVSGLPPIKLPPPTCDLAHGRWVFDNESLPLYREKECNFLTKQLTCLANGRNDDLWQYWQWQPNNCSLPTFDARRFMERMRGKRLMFVGDSLNRNQFYSLVCMVQSILSKGRKKVVKRGSNTIFHAKEYRATLEFYWAPFLVESNSDDPNIHSIEHRIIRPERIEGHAQYWRGVDYLIFDTYIWWMNTADIKVRRPDSRSWSEHDEVPRIEAYGRVLKTWSDWLNENIDPARTSVFFMTISPIHISPDKWGNPHGIKCAKETLPVLNYTEPLDLNHDMRLYDMVASTARSMKKVPVTLIDITRMSDYRKDAHTSVYSVRRGYLLTPKQKNDPEKFADCIHWCLPGVPDVWNTVLYTRIFSKSPPSSPPALALPPPQ

SEQ ID NO: 4917 - protein, 401 aa, Secale cereale
MYGEDARTIAELSIDDYLYPDADIYNVSGLPPIALPPPTCDLAHGRWVFDNESLPLYREKECSFLTKQLTCLANGRNDDLWQYWQWQPNNCSLPTFDARRFMERMRGKRLMFVGDSLNRNQFYSLVCMVQSVLSKGRKKVVKRGSLTIFHAKEYRATLEFYWAPFLVESNSDDPNIHSIEHRIIRPERIEGHAQYWRGVDYLIFDTYIWWMNTADIKVRRPDSRYWSEHDEVPRIEAYSRVLKTWSDWLNENVDPARTSVFFMTISPIHISPDKWGNPHGIKCAKETLPVLNYTEPLDLNHDMRLYDMVASTARSMKKVPVTLIDITRMSDYRKDAHTSVYSVRRGYLLTPKQKNDPENFADCIHWCLPGVPDVWNTVLYTRIFSKSPPSSPPALALPPPQ

SEQ ID NO: 4918 - protein, 464 aa, Panicum virgatum
MAKPPPPTSPSDPPLPTAAAPKPRTFGLFSSSARSLLAAARRSPVTTLVVAFFLLALFMYGEDVRTIAELSIDDYLYPDADLYNVSGLPPLLLHPPTCDLSDGRWLFDNVSLPAYREKDCTFLTKQVTCLANGRPDDTWQYWKWQPNQCSLPTFDARRFMETMRGKRLMFVGDSLNRNQWESLVCLVQPILSKGRKKIVKRGSLTIFHAKEYRATLEFYWAPFLVESNSDNPKIHSIEHRIIRPDRIEGHAKYWKDVDYLIFNTYIWWMNTADMKVRRPDSRYWSQHDEVPRIEAYGRVFKTWSEWLNNNIDPAHTSVFFMTISPLHISPNNWGNPEGIRCVKETLPYQNYSQPLDLYHDMRMFDLVVKVASSMEKVPVTVINITRMSDYRKDAHTSLYSIRQGKLLTPKQKADPEKFADCIHWCLPGVPDVWNQILYTRILSKSSWHSNSAAPPLQSLPPPAQ

SEQ ID NO: 4919 - protein, 785 aa, Triticum aestivum
MASSLTPRSPYQKKENLGNVRRGMGYSAPPRRNVLSAINNGGGANAEPAPSEAGSEAPAFEFSGREDVDRLLNEKMKVKSKNDYKGRTEQMSEYIKRLRACIRWLVELEDGYLAEQEKLRGQIDSDNARHAEFEAQLSGALEELKAANLEMTTRCDSLEESLNKEKAARLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQAKKSSKDSELLRIKAAAFEETCSSQQEQIETLQKQLAVATEKLKHADVTAIEAMTGYETQKETIKDLEERLAYAEFQIIEADKLRKKLHNTILELKGNIRVFCRVRPFLSDANSNGQEEAIISYPSSVENAGRGIDLMNQGQKCSFSYDKVFDHSASQDDVFVEMSQLVQSALDGYKVCIFAYGQTGSGKTYTMMGKPGRDQKGIIPRSLEQIFKTSQSLESQGWKYCMQASMLEIYNETIRDLLAPGRSSSDMPGGKQYTIKHDSQGNTTVSDLTTTNVFSTADVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEASSAGETLCSLRFASRVNACEIGVARRQTQSKSSSDTSNRLSYG

SEQ ID NO: 4920 - protein, 785 aa, Secale cereale
MASSLTPRSPYQKKENLGNVRRGMGYSAPPRRNVLSAINNGGGANAEPAPSEAGSEAPAFEFSGREDVDRLLSEKMKGKSKNDYKGRTEQMSEYIRRLRACIRWLVELEDGYLAEQEKLRGQIDSENARHAEFEAQLSGALEHLKAANLEMTTRCDSLEESLNKEKADRLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQAKKSSKDSELLRIKAAAFEETCSSQQEQIETLQKQLAVATEKLKHADVTAIEAMTGYETQKETIKDLEERLAYAEFQIIEADKLRKKLHNTILELKGNIRVFCRVRPFLSDADSNGQEETIISYPSSVENAGRGIDLMNQGQKCSFSYDKVFDHSASQDDVFVEMSQLVQSALDGYKVCIFAYGQTGSGKTYTMMGKPGRDQKGIIPRSLEQIFKTSQSLESQGWKYCMQASMLEIYNETIRDLLAPGRSSSEMPGGKQYTIKHDSQGNTTVSDLTTTNVFSTGDVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEASSSGETLCSLRFASRVNACEIGVARRQTQSKSSSDSSNRLSYG

SEQ ID NO: 4921 - protein, 785 aa, Secale cereale
MASSLTPRSPYQKKENLGNVRRGMGYSAPPRRNVLSAINNGGGANAEPAPSEAGSEAPAFEFGGREDVDRLLSEKMKGKSKNDYKGRTEQMSEYIRRLRACIRWLVELEDGYLAEQEKLRGQIDSENARHAEFEAQLSGALEHLKAANLEMTTRCDSLEESLNKEKADRLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQAKKSSKDSELLRIKAAAFEETCSSQQEQIETLQKQLAVATEKLKHADVTAIEAMTGYETQKETIKDLEERLAYAEFQIIEADKLRKKLHNTILELKGNIRVFCRVRPFLSDADSNGQEETIISYPSSVENAGRGIDLMNQGQKCSFSYDKVFDHSASQDDVFVEMSQLVQSALDGYKVCIFAYGQTGSGKTYTMMGKPGRDQKGIIPRSLEQIFKTSQSLESQGWKYCMQASMLEIYNETIRDLLAPGRSSSEMPGGKQYTIKHDSQGNTTVSDLTTTNVFSTGDVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEASSSGETLCSLRFASRVNACEIGVARRQTQSKSSSDNSNRLSYG

SEQ ID NO: 4922 - protein, 228 aa, Secale cereale
MQASMLEIYNETIRDLLAPGRSSSEMPGGKQYTIKHDSQGNTTVSDLTTTNVFSTGDVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEASSSGETLCSLRFASRVNACEIGVARRQTQSKSSSDSSNRLSYG

SEQ ID NO: 4923 - protein, 529 aa, Secale cereale
MEPAAAEMDTGELDALLLAAADFASYPGTHGEDTVRQFLEQFPLPKLLGVLQSQADVPETVETVAACLDKVFSSRYGASLLPSYGEFIQAGLLTNSNSIRQLACKAVVHLLDKAGDIAVAVDTFVQHNLYPLLINCLIEGDEEISAIVMDAIKRLAEIPTGTDIIFPPDGQGLQLNKVAAQSSSMARIRILSLIAKLFAASSCTATAIRDSNLLSLFEDEIKDRKDMLKTLSALEVLYELAEHPHSNMFLLKTSLLQHITDVINDPSADSIVRSRASLISGRLLSSADAFMTIEQSCVTNLLLAIDKILRTEESQNTDEIESALETLGLIGTTTQGACLLLSDPPNIARHVVEMSFDRQGRGKQLAALHAFGSICGVDRQEDQIKLDDYQAEECLKRLVYSAASNSPKLTPSALLLSILQQDPDVRIAGYRVLSGLVVREWCLREVCSKPEIIGIVTDPKMETTKLGMEARYACCVAINKALSSSHLLHEPSLSELIGKLNEAVRRGPYLSEKRQRVEAQPVVGTMERF

SEQ ID NO: 4924 - protein, 618 aa, Triticum aestivum
MMMDLGAARATPPSAQEAAEAAVRAVGCGYDLADDLRLFRAKDRLLDLGGGGERDLCLPGGAVVAGVPAGVVADKGERARFRSDVLSFTQMAEHVNQSLSLTGKIPSGPFNAMFDYRGCWHRDAAATRSLCFDARLVELYAVEAPRGARLALRDHVARDVPTSWDPPALAAFIDTHGTHVVVGVRMGGKDVVCVKQLRGSALEPRDVQARLKKLADATFSQSQQDRRQSSAGAKGRGSSSRRPPGPGSAAWRAFRSPVIHNKDDVVGIHVRRGGVDDGQGHDDWLTTIAASPDVISMAFVPITSLLTGVPGRGFLNHAVNLYLRYKPPIEELEQFLEFQVPRQWAPEFGELPLALGPQRKKKKDSLPSLQFTLMGPKLRVNTAKVDSGGRPVTGIRLFLEGKKNSRLGVHLQHLSATPRAVPIVVGEAVTTAVGDAVNERAYFEPVRSSLLTHACTAPVQHAGARIDDCAAVVTAAWFEVREACLTKVLFLRLGFSGVARTKIRRSEWDGPLATTRKSGSLSAMLSAALSGTAAVPPQGEPMEGKVEVNSAVFPKGPPVPLPVQKMAKYIDTTEVTRGPDDLPGYWVVTGAKLCVEGGKVALKAKYSLLISAPEDDEV

SEQ ID NO: 4925 - protein, 528 aa, Triticum aestivum
MDPAAEMDAGELDALLRAAADFASYPGTHGEDTVRQFLEQFPLPKLLGVLQSQADVPETVETVAACLDKVFSSRYGASLLPSYGEFIQAGLLTNSNSIRQLACKAVVHLLDKAGDIAVAVDTFVQHNLYPLLINCLIEGDEEISAIVLDAIKRLAEIPTGTDIIFPPDGQGLQLNKVAAQSSSMARIRILSLIAKLFAASSCTATAIRDSNLLSLFEDEIKDRKDMLKTLSALEVLYELAEHPHSNMFLLKTSLLQHITDVINDPSADSIVRSRASLISGRLLSSADAFMTIEKSCVTNLLLAIDKILRTEEGQNTDEIESALETLGLIGTTTQGACLLLSDPPNIARHVVEMSFDRQGRGKHLAALHALGSICGVDRQEDQMKLDDPQAEEFLKRLVYSAASNSPKLTPSALLLSILQQDPDVRIAGYRVLSGLVVREWCLREVCSKPEIIGIVTDPKMETTKLGMEARYACCVAINKALSSSHLLHEPSLSELIGKLNEAVRRGPYLSEKRQRVEAQPVVGTMERF

SEQ ID NO: 4926 - protein, 612 aa, Triticum aestivum
AARATPPSAQEAAEAAVRAVGCGYDLADDLRLFRAKDRLLDLGGGGGKRDLCLPGGAVVAGVPPGVVADKGERARFRSDVLSFAQMAEHVNQSLSLTGKIPSGPFNAMFDYRGCWHRDAAATRSLCFDARLVELYAVEAPRGARLALRGHVARDVPTSWDPPALAAFIDTHGTHVVVGVRMGGKDVVCIKQLRGSALEPRDVQARLKKLADATFSQSLDRRQSSAGAKSRGSSSRRPPGPGSAAWRAFRSPVIHNKDDVVGIHVRRGGVDDGQGHDEWLTTVAASPDVISMAFVPITSLLTGVPGRGFLNHAVNLYLRYKPPIEELEQFLEFQVPRQWAPEFGELPLALGPQRKKKKDSLPSLQFTLMGPKLRVNTAKVDSGGRPVTGIRLFLEGKKNSRLGVHLQHLSATPRAVPIVVGEAVTTAVGDAVNERAYFEPVRSSLLTHACTAPVQHAGARIDDCAAVVTAAWLEVREACLKKVLFLRLGFSGVARTKIRRSEWDGPLATTRKSGSLSAMLSAALSGTAAVPPQGEPMEGKVEVNSAVFPKGPPVPLPVQKMAKYIDTTEVTRGPDDLPGYWVVTGAKLCVEGGKVALKAKYSLLISAPEDDEV

SEQ ID NO: 4927 - protein, 521 aa, Avena sativa
MEPGELEAMLRAAGDFGSYPGVHGDDAVRRFLEQFPLPKLLGALQSQADVPGTIETVAACLDKVFSSRYGASLLPSYGEFIQAGLLANSQNIRQLACKAVFHLLDKAGDSAVAVDTFVQHNLYPLLVNCLIEGDEEISALVLDAIKRLAEIPKGLDIIFPPDGQGSLQLDKVAAQSSSMARIRILSLIAKLFAVSSSAATAIRDSNLLSLFEDEIKDRKDMLKTLSALEVLYELAEHPHSNIFLLKSSLLQHITDVINDSSTDSVVRSRASLISGRLLSSADAFMTLDQSCVTNLLLAIDKILSLEESQNTDEIESALETLGLIGATTQGACLLFNDSSNVAKHVVELSFTRQGRGKQLAALHAFGSICGVDRQEGQMKLDDQAEERLKRLVYTVASNSPKLTPSALLLSVLQQDPDVRIATYRVLSGLVVREWCLREVCSKSEIIRVVTDPTMETTKLGMEARYACCVAINKALSSSHLVNESSLSEVIGKLNEAVRRGPYLLERKRVEAQPVVDTMQRF

SEQ ID NO: 4928 - protein, 523 aa, Brachypodium distachyon
MEPAAAEMDALLRAAADFASYPGVHCDDTVRQFLEQFPLPKLLGVLQSQADVPGVDETLAACLDKVFSSRYGASLLPNYGEFIQAGLLTNSKIIRQLACKAVLNLLDKAGDSAVALDTFVQHNLYPLLINCLIEGDEEVSAIVLDVLKRLAEIPKGTDIIFPPDGQGSLQLNKVAAQSSSMARIRILSLIAKLFAVSSSTATAIRDSNLLSLFEDEIKDRKDMLKTLSALEVLYELAEHPNSNIFLLKNSLLQHITDVINDSTADSVIRSRASLISGRLLSSADAFMTIDQSCVTNLLLAIDKILGIEESQNTDEIESALEALGLIGATTQGACFLFTDSSNVAKHVVQLSFNRQGRGKQLAALHAFGSICGVDRQEDQMKLGDQAEERLKRLVYTVASDSPKLTPSALLLSVLQQDPDIRIAGYRVISRLVVREWCLREVCSKSEIIRVVTDPKMETTKLGMEARYNCCVAINKALSSSHLLNESSLSELIGKLNDAVRRGPYLSDRKRMEAQPVVDTAERF

SEQ ID NO: 4929 - protein, 180 aa, Triticum aestivum
MGNCQAAEVAAAVVQHPGGRVERLYWSTPAAEVMRANPGHYVALVTLRVAEERQDADGGGARRTVRLTRVKLLKPKETLLLGHVYRLITANEVTKAVQARKEEKLRKARQQLQQLESSTRQSKLRPAADGDDVDDDDDEASLDESLDQLARQDGGDGHRSSGARHRQWRPSLHSIDEAAS

SEQ ID NO: 4930 - protein, 181 aa, Leymus cinereus x Leymus triticoides
MGNCQAVEVAAAVVQHPGGRVERLYWSTPAAEVMRANPGHYVALVTLRVAEERHDADGGGASRTVRLTRVKLLKPKETLLLGHVYRLITANEVTKAVQARKEEKLRQARQQLQQLESSTRRSKARPAADADDDVDDDDDEASLDESLDQLARQDGGDGHRSSGVRHRQWRPSLHSIDEAAS

SEQ ID NO: 4931 - protein, 169 aa, Panicum virgatum
MGNCQAAEAAAVLLQHPGGRVERLCWSTSAAEVMRANPGHYVALVTLRVAEERQDAPGGERRTVRLTRVKLLKPKETLLLGHVYRLITTQEVTKAVQARKEEKQRKAQQQLLESRQSKARGAAEDDDEDEAALDASLDQLARQDNGNRSSSARHRQWRPSLQSIDEATS

SEQ ID NO: 4932 - protein, 169 aa, Panicum virgatum
MGNCQAAEAAAVVLQHPGGRVERLCWSTSAAEVMRANPGHYVALVTLRVAEERQDAPGGERRTVRLTRVKLLKPKETLLLGHVYRLITTQEVTKAVQARKEEKQRKAQQQLLETRQGKARGAAEDDDEDQAALDASLDQLARQDNGNRSSSARHRQWRPSLQSIDEATS

SEQ ID NO: 4933 - protein, 169 aa, Panicum virgatum
MGNCQAAEAAAVVLQHPGGRVERLCWSTNAAEVMRANPGHYVALVTLRVAEERQDAPGGERRTVRLTRVKLLKPKETLLLGHVYRLITTQEVTKAVQARKEEKQRKAQQQLLETRQGKARGAAEDDDEDQAALDASLDQLARQDNGNRSSSARHRQWRPSLQSIDEATS

SEQ ID NO: 4934 - protein, 153 aa, Brachypodium distachyon
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRLYASGA

SEQ ID NO: 4935 - protein, 153 aa, Unknown
  Sequence found in Organisms: Festuca arundinacea, Avena sativa
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRVYASGA

SEQ ID NO: 4936 - protein, 153 aa, Secale cereale
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKTNEAEAVETAKEWTRMYASGA

SEQ ID NO: 4937 - protein, 287 aa, Brassica napus
MVAMASASGSALRFTDAPSSRAIRRDVGASCLAPRTVTFGFVDKSVTNLNRLRLSCLKTRASNATAVENANAADSDKVPTPVVIIDQDSDPDATVVEVTFGDRLGALLDTMNALKNLGLNVVKANVYLDSSGKHNKFAITKADSGRKVEDPELLEAIRLTVINNMLEFHPESSSQLAMGAAFGVLPPTELVDVDIATQVSIKDDGPDRSLLYIETADRPGLLVELVKIISDISVAVESGEFDTEGLLAKVKFHVSYRNKALIKPLQQVLANSLRYFLRRPSTDESSF

SEQ ID NO: 4938 - protein, 153 aa, Unknown
  Sequence found in Organisms: Brassica juncea, Brassica rapa
MANSNLPRRIIKETQRLLSEPAPGISASPSEENMRYFNVMVLGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4939 - protein, 153 aa, Unknown
  Sequence found in Organisms: Brassica napus, Brassica rapa
MANSNLPRRIIKETQRLLSEPAPGISASPSEENMRYFNVMVLGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4940 - protein, 153 aa, Unknown
  Sequence found in Organisms: Hordeum vulgare, Leymus cinereus x Leymus triticoides, Avena sativa, Pseudoroegneria spicata, Secale cereale, Triticum aestivum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4941 - protein, 153 aa, Pennisetum glaucum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRMYASGA

SEQ ID NO: 4942 - protein, 153 aa, Unknown
  Sequence found in Organisms: Arabidopsis thaliana, Brassica napus, Solanum lycopersicum, Arabidopsis lyrata, Brassica juncea, Brassica rapa, Solanum melongena, Euonymus alatus, Vitis vinifera and additional organisms as disclosed in Tables 1 and 2
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4943 - protein, 153 aa, Unknown
  Sequence found in Organisms: Brassica napus, Brassica oleracea
MANSNLPRRIIKETQRLLSEPAPGISASPSEENMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4944 - protein, 153 aa, Unknown
  Sequence found in Organisms: Brassica napus, Brassica oleracea, Brassica rapa, Lotus japonicus
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4945 - protein, 153 aa, Unknown
  Sequence found in Organisms: Brassica napus, Brassica rapa
MANSNLPRRIIKETQRLLSEPAPGISASPSEENMRYFNVMVLGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGE

SEQ ID NO: 4946 - protein, 153 aa, Unknown
  Sequence found in Organisms: Cenchrus ciliaris, Festuca arundinacea, Setaria italica, Saccharum officinarum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYASGA

SEQ ID NO: 4947 - protein, 153 aa, Lactuca sativa
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTHMYASGA

SEQ ID NO: 4948 - protein, 153 aa, Tropaeolum majus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENVAKHWKSNEVEAVETAKEWTRLYASGA

SEQ ID NO: 4949 - protein, 153 aa, Senecio madagascariensis
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRLYASGA

SEQ ID NO: 4950 - protein, 153 aa, Unknown
  Sequence found in Organisms: Eutrema halophilum, Eutrema parvulum
MANSNLPRRIIKETQRLLSEPAPGISASPSEDNMRYFNVMVLGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4951 - protein, 153 aa, Triphysaria pusilla
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKSNESEAVETAKEWTRLYASGA

SEQ ID NO: 4952 - protein, 176 aa, Brachypodium distachyon
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETATQSGLVCMRVAHEPNTALDVITHHTLAGNEVPFA

SEQ ID NO: 4953 - protein, 243 aa, Centaurea maculosa
MRRPQIVLFGDSITEQSFRYGGWGASLTDTYSRKADIVVRGYGGYNTRWALFLLHHIFPLDSTTPPAAATIFLGANDAALPGRSSERQYVPLEEYKENLRKMVRHLKECSPTMLIVLITPPPIDEEGRKEYATSLYGEKAMKLPERTNEVTGTYANGCVEVAKELGVFSVNLWSKMQETQGWQKKFLSDGLHLTPDGNGVVYEEVVKAFKGAWLSATEMPSDFPHHSEIDPQNPEKVFQQRCL

SEQ ID NO: 4954 - protein, 479 aa, Cirsium arvense
MTKLMVQSQPHFLLLTFPTQGHINPTLQFAKRLLRLGVKVTFATCVSAHRRMTKAGQNIPESLNFAVFSDGFDDGYAYDVNDYTSFMNQLKTRGSQSVKETILSCANDGTPITCLVYTLLLPWAAGVARELNVPSALLWIQPASVFRIYYYYFKGYDKLIGEGCSEPSWSIKLPGLPLLKSRDLPSFCLPSNMYDFVLTLFKEQLQVLDLEDKPKILVNSFDALEEEALKEIDDKMKLIAVGPLIPSAFVDDVDPSDKSFGGDLFETSTDYVEWMNTKPEGSIVYISFGSIIMLSKKQKEAMARGLLASKRPFLWVVRNKDGNRKAHNEGEKEEDDEEVSCKEELEELGKIVPWCSQLEVLSHPSLGCFVTHCGWNSTMESIVCAVPVVAFPHWTDQTTNAKLLEDEWRTGVRVAANEEGVVEGDEIARCIEMVMGGEETEMRKNAKKWKDLAREAMKESGSSHMNLKAFVEQVNGSVT

SEQ ID NO: 4955 - protein, 61 aa, Gossypium hirsutum
MANSNLPRRIIKETQRLLSEPAPGISASPSEDNMRYFNVMILGPTQSPYEGGVFKLELFFA

SEQ ID NO: 4956 - protein, 74 aa, Salvia sclarea
MRYFNVMILGPTQSPYEGGVFKLELFLPEEYPMAAPKVRFLTKFTIQTSTSSEEFAWTFLKTNGVPLFRLELYF

SEQ ID NO: 4957 - protein, 153 aa, Nicotiana benthamiana
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 4958 - protein, 153 aa, Unknown
  Sequence found in Organisms: Gossypium hirsutum, Glycine max, Ambrosia trifida, Amsonia hubrichtii, Arabidopsis lyrata, Arnica chamissonis, Catharanthus roseus, Centaurea maculosa, Cichorium intybus and additional organisms as disclosed in Tables 1 and 2
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4959 - protein, 153 aa, Unknown
  Sequence found in Organisms: Oryza sativa, Setaria italica, Panicum virgatum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRLYASGA

SEQ ID NO: 4960 - protein, 153 aa, Amorphophallus konjac
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYASGA

SEQ ID NO: 4961 - protein, 153 aa, Persea americana
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSDNVAKHWKTNEAEAVETAKEWTRLYASGA

SEQ ID NO: 4962 - protein, 153 aa, Vaccinium corymbosum
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 4963 - protein, 153 aa, Brassica napus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSDEAEAVETAKEWTRLYASGA

SEQ ID NO: 4964 - protein, 153 aa, Unknown
  Sequence found in Organisms: Castanea mollissima, Quercus alba
MANSNLPRRIIKETQRLLSEPAPGISASPSEDNMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 4965 - protein, 153 aa, Unknown
  Sequence found in Organisms: Cichorium intybus, Guizotia abyssinica, Camellia sinensis, Valeriana officinalis, Vinca minor
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4966 - protein, 153 aa, Euonymus alatus
MANSNLPRRIIKETQRLLSEPAPGISASPSEENMRYFNVMILGPTQSPYEGGVFKLELFLTEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4967 - protein, 153 aa, Euonymus alatus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLHASGA

SEQ ID NO: 4968 - protein, 153 aa, Linum usitatissimum
MANSNLPRRIIKETQRLLSEPAPGISASPSEENMRYFNVMILGPTQSPYEGGVFKLELFLPEEYPMAPPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4969 - protein, 153 aa, Mesembryanthemum crystallinum
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 4970 - protein, 153 aa, Unknown
  Sequence found in Organisms: Ipomoea batatas, Petunia hybrida
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 4971 - protein, 153 aa, Unknown
  Sequence found in Organisms: Lotus japonicus, Solanum tuberosum, Solanum phureja
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYASGA

SEQ ID NO: 4972 - protein, 153 aa, Zea mays
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEVEAVETAKEWTRLYASGA

SEQ ID NO: 4973 - protein, 153 aa, Zea mays
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYTSGA

SEQ ID NO: 4974 - protein, 153 aa, Tropaeolum majus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRMYASGA

SEQ ID NO: 4975 - protein, 153 aa, Unknown
  Sequence found in Organisms: Solanum tuberosum, Solanum phureja
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWARLYASGA

SEQ ID NO: 4976 - protein, 153 aa, Raphanus sativus
MANSNLPRRIIKETQRLLSEPAPGISASPSEENMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGE

SEQ ID NO: 4977 - protein, 153 aa, Glycine max
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTQLYASGA

SEQ ID NO: 4978 - protein, 153 aa, Glycine max
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGV

SEQ ID NO: 4979 - protein, 153 aa, Unknown
  Sequence found in Organisms: Eutrema halophilum, Utricularia gibba
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVDTAKEWTRLYASGA

SEQ ID NO: 4980 - protein, 153 aa, Triphysaria pusilla
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 4981 - protein, 153 aa, Triphysaria pusilla
MANSNLPRRIIKETQRLLSEPAPGISASPSEENMRYFNVMILGPTQSPFEGGVFKLELFLPEEYPMAAPKVRFLTKIYHPNIDKLGRICLDILKDKWSPALQIRTVLLSIQALLSAPNPDDPLSENVAKHWKSNEAEAVNTAKEWTRLYASGA

SEQ ID NO: 4982 - protein, 153 aa, Unknown
  Sequence found in Organisms: Gossypium hirsutum, Musa acuminata, Fagus grandifolia, Theobroma cacao, Manihot esculenta, Ricinus communis, Castanea mollissima, Citrus clementina, Cleome gynandra and additional organisms as disclosed in Tables 1 and 2
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 4983 - protein, 153 aa, Unknown
  Sequence found in Organisms: Solanum lycopersicum, Cicer arietinum, Humulus lupulus, Lippia dulcis
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYASGA

SEQ ID NO: 4984 - protein, 153 aa, Mimulus guttatus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYASGT

SEQ ID NO: 4985 - protein, 153 aa, Prunus mume
MANSNLPRRIIKETQRLLSEPAPGISASPSEENMRYFNVMILGPAQSPYEGGVFKLELFLPEEYPMAPPKVRFLTKIYHPNIDKLGRICLDILKDKWSPALQIRTVLLSIQALLSAPNPDDPLSENIAKHWKTNEAEAVETAKEWTRLYASGE

SEQ ID NO: 4986 - protein, 153 aa, Zostera marina
MANSNLPRRIIKETQRLLSEPAPGISASPSEDNMRYFNVMVLGPTQSPYEGGVFKLELFLPEEYPMAAPKVRFLTKIYHPNIDKLGRICLDILKDKWSPALQIRTVLLSIQALLSAPNPDDPLSENIAKHWKANEVEAVETAKEWTRLYASGA

SEQ ID NO: 4987 - protein, 153 aa, Unknown
  Sequence found in Organisms: Antirrhinum majus, Lippia dulcis
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEVEAVETAKEWTRLYASGA

SEQ ID NO: 4988 - protein, 153 aa, Arabidopsis thaliana
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVDTAKEWTRLYASGA

SEQ ID NO: 4989 - protein, 153 aa, Artemisia annua
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTHLYASGA

SEQ ID NO: 4990 - protein, 153 aa, Unknown
  Sequence found in Organisms: Persea americana, Fraxinus spp, Olea europaea
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYATGA

SEQ ID NO: 4991 - protein, 153 aa, Vaccinium corymbosum
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 4992 - protein, 153 aa, Bupleurum chinense
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNETEAVETAKEWTRLYASGA

SEQ ID NO: 4993 - protein, 153 aa, Cedrus atlantica
MANANLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4994 - protein, 153 aa, Centaurea maculosa
MANSNLPRRIIKETQRLLSEPAPGISASPSEENMRYFNVMILGPSQSPYEGGVFKLELFLPEDYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 4995 - protein, 153 aa, Gossypium hirsutum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNKAEAVETAKEWTRLYASGA

SEQ ID NO: 4996 - protein, 153 aa, Gossypium hirsutum
MANSNLPRRIIKETQRLLSEPAPGINASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 4997 - protein, 153 aa, Vigna unguiculata
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYAIGA

SEQ ID NO: 4998 - protein, 153 aa, Unknown
  Sequence found in Organisms: Vigna unguiculata, Cajanus cajan
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASDA

SEQ ID NO: 4999 - protein, 153 aa, Taraxacum officinale
MANSNLPRRIIKETQRLLSEPAPGISASPSEDNMRFFNVMVLGPSQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYASGA

SEQ ID NO: 5000 - protein, 153 aa, Eschscholzia californica
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKANEVEAVETAKEWTRLYASGA

SEQ ID NO: 5001 - protein, 153 aa, Unknown
  Sequence found in Organisms: Flaveria ramosissima, Guizotia abyssinica, Helianthus annuus
MANSNLPRRIIKETQRLLSEPAPGISASPSEDNMRYFNVMILGPTQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5002 - protein, 153 aa, Flaveria ramosissima
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGD

SEQ ID NO: 5003 - protein, 153 aa, Linum usitatissimum
MANSNLPRRIIKETQRLLSEPAPGISASPSEENMRYFNVMILGPTQSPYEGGVFKLELFLPEEYPMAPPKVRFLTKIYHPNIDKLGRICLDILKDKWSPALQIRTVLLSIQALLSAPNPDDPLSENIAKHWKSNEAEAVETAKEWSRLYASGA

SEQ ID NO: 5004 - protein, 153 aa, Ipomoea batatas
MANSNLPRRIIKETQRLLSEPAPGISASPSEENMRYFNVMILGPTQSPYEGGVFKLELFLPEEYPMAAPKVRFLTKIYHPNIDKPGRICLDILKDKWSPALQIRTVLLSIQALLSAPNPDDPLSENIAKHWKTNEAEAVETAKEWTRLYASGA

SEQ ID NO: 5005 - protein, 153 aa, Ipomoea nil
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRLYASGA

SEQ ID NO: 5006 - protein, 153 aa, Actinidia deliciosa
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTLLYASGA

SEQ ID NO: 5007 - protein, 153 aa, Unknown
  Sequence found in Organisms: Zea mays, Sorghum bicolor, Saccharum officinarum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEVEAVETAKEWTRLYASGA

SEQ ID NO: 5008 - protein, 154 aa, Zea mays
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAFETAKEWTRLYASGAL

SEQ ID NO: 5009 - protein, 153 aa, Orobanche aegyptiaca
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVQTAKEWTRLYASGA

SEQ ID NO: 5010 - protein, 153 aa, Parthenium argentatum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVILSIQALLSAPNPDDPLSENIAKHWKSNEAEAVETAKEWTRLYASGA

SEQ ID NO: 5011 - protein, 153 aa, Unknown
  Sequence found in Organisms: Capsicum annuum, Papaver somniferum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 5012 - protein, 153 aa, Papaver somniferum
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTNLYASGA

SEQ ID NO: 5013 - protein, 153 aa, Unknown
  Sequence found in Organisms: Prunus persica, Rosa hybrid cultivar, Fragaria vesca
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGV

SEQ ID NO: 5014 - protein, 153 aa, Silene vulgaris
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLSENVAKHWKSNEVEAVETAKEWTRSYATGA

SEQ ID NO: 5015 - protein, 153 aa, Silene vulgaris
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKTDEAEAVETAKEWTQLYASGA

SEQ ID NO: 5016 - protein, 153 aa, Glycine max
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALGIRTVLLSIQALLSAPNPDDPLSENIAKHWKSNEAEAVETAKEWTRLYASGA

SEQ ID NO: 5017 - protein, 153 aa, Panicum virgatum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTHLYASGA

SEQ ID NO: 5018 - protein, 153 aa, Thalictrum flavum
MANNNLPRRIIKETQRLLSEPAPGISASPSEENMRYFKVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5019 - protein, 153 aa, Tragopogon dubius
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 5020 - protein, 153 aa, Trigonella foenum-graecum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYANGA

SEQ ID NO: 5021 - protein, 153 aa, Tripterygium wilfordii
MANSNLPRRIIKETQRLLSEPAPGISASPSEDNMRYFNVMILGPTQSPYEGGVFKLELFLTEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5022 - protein, 81 aa, Artemisia annua
MANSNLPRRIIKETQRLLSEPAPGISASPSEDNMRYFNVMILGPTQSPYEGSFQAGVIFAGRISNGCSQGSFSYKNLPSKH

SEQ ID NO: 5023 - protein, 92 aa, Brassica rapa
MANSNLPRRIIKETQRLLSEPAPGISASPSEDNMRYFNVMVLVLHNHLMKEEFLSWSSFCLKNTLCQLPRLGFSPRYTIPTLISLEESVLIF

SEQ ID NO: 5024 - protein, 88 aa, Unknown
  Sequence found in Organisms: Ambrosia trifida, Flaveria ramosissima, Sarracenia psittacina
MAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5025 - protein, 107 aa, Sarracenia psittacina
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVL

SEQ ID NO: 5026 - protein, 59 aa, Senecio madagascariensis
WIPRAAGFNSMANSNLPRRIIKETQRLLSEPAPGISASPSEDNMRYFNVMILGINAVSL

SEQ ID NO: 5027 - protein, 73 aa, Triticum aestivum
MANSNLPRRIIKETQRLLSEPAPGISASPSEENMRYFNVMILGPAQSPYEGGVFKLELFLPEEYPMAAPKLGF

SEQ ID NO: 5028 - protein, 107 aa, Flaveria ramosissima
MANSNLPRRIIKETQRLLSEPAPGISASPSEDNMRYFNVMILGPTQSPYEGGVFKLELFLPEEYPMAAPKVRFLTKFTIPTLTSLVGFVLTFSKTNGALLFRFALYS

SEQ ID NO: 5029 - protein, 114 aa, Papaver somniferum
MILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYATGA

SEQ ID NO: 5030 - protein, 153 aa, Phaseolus vulgaris
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYAIGA

SEQ ID NO: 5031 - protein, 153 aa, Acacia harpophylla
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTSEAEAVETAKEWTRLYASGA

SEQ ID NO: 5032 - protein, 153 aa, Amorphophallus konjac
MANINLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSDIVAKHWKTNEAEAVETAKEWTRLYASGA

SEQ ID NO: 5033 - protein, 153 aa, Antirrhinum majus
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGE

SEQ ID NO: 5034 - protein, 153 aa, Unknown
  Sequence found in Organisms: Aristolochia fimbriata, Elaeis guineensis
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGA

SEQ ID NO: 5035 - protein, 153 aa, Musa acuminata
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGA

SEQ ID NO: 5036 - protein, 152 aa, Ocimum basilicum
ANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 5037 - protein, 153 aa, Beta vulgaris
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKMDEAEAVETAKEWTRLYASGA

SEQ ID NO: 5038 - protein, 153 aa, Beta vulgaris
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLSENIAKHWKSNEVEAVETAKEWTRLYATGA

SEQ ID NO: 5039 - protein, 153 aa, Vaccinium corymbosum
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYATGA

SEQ ID NO: 5040 - protein, 153 aa, Catharanthus roseus
MANSNLPKRIIKETQRLLSEPAPGISASPSEDNMRYFNVMILGPAQSPYEGGVFKLELFLPEEYPMAPPKVRFLTKIYHPNIDKLGRICLDILKDKWSPALQIRTVLLSIQALLSAPNPDDPLSENIAKHWKSNEAEAVETAKEWTRLYATGA

SEQ ID NO: 5041 - protein, 153 aa, Unknown
  Sequence found in Organisms: Centaurea maculosa, Cirsium arvense, Carthamus tinctorius
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKTNEADAVETAKEWTHLYASGT

SEQ ID NO: 5042 - protein, 153 aa, Chelidonium majus
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRLYASGA

SEQ ID NO: 5043 - protein, 153 aa, Unknown
  Sequence found in Organisms: Cirsium arvense, Cynara scolymus
MANSNLPRRIIKETQRLLSEPAPGISASPSEENMRYFNVMILGPSQSPYEGGVFKLELFLPEDYPMAAPKVRFLTKIYHPNIDKLGRICLDILKDKWSPALQIRTVLLSIQALLSAPNPDDPLSENIAKHWKSNEVEAVETAKEWTRLYATGA

SEQ ID NO: 5044 - protein, 153 aa, Cucurbita pepo
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTQLYASGA

SEQ ID NO: 5045 - protein, 153 aa, Unknown
  Sequence found in Organisms: Eucalyptus grandis, Heritiera littoralis, Populus trichocarpa
MASSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 5046 - protein, 153 aa, Euonymus alatus
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTDEAEAVETAKEWTRLYATGA

SEQ ID NO: 5047 - protein, 153 aa, Fagopyrum esculentum
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTDEAEAVETAKEWTRLYASGE

SEQ ID NO: 5048 - protein, 153 aa, Fagopyrum esculentum
MTNSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLSENVAKHWKTNEAEAVETAKEWTRLYATGA

SEQ ID NO: 5049 - protein, 153 aa, Linum usitatissimum
MANSDLPRRIIKETQRLLSEPAPGISASPSEENMRYFNVMILGPTQSPYEGGVFKLELFLPEEYPMAPPKVRFLTKIYHPNIDKLGRICLDILKDKWSPALQIRTVLLSIQALLSAPNPDDPLSENIAKHWKSNEAEAVETAKEWSRLYASGA

SEQ ID NO: 5050 - protein, 153 aa, Fraxinus spp
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGE

SEQ ID NO: 5051 - protein, 153 aa, Panax ginseng
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWSRLYATGA

SEQ ID NO: 5052 - protein, 151 aa, Guizotia abyssinica
NSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5053 - protein, 153 aa, Mesembryanthemum crystallinum
MANSNLPRRIIKETQRLLSEPAPGISASPSEENMRYFNVMVLGPSQSPYEGGVFKLELFLPEEYPMAPPKVRFLTKIYHPNIDKLGRICLDILKDKWSPALQIRTVLLSIQALLSAPNPDDPLSENIAKHWKTNEVEAVETAKEWTRLYATGA

SEQ ID NO: 5054 - protein, 153 aa, Unknown
  Sequence found in Organisms: Ipomoea batatas, Populus trichocarpa
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRLYASGA

SEQ ID NO: 5055 - protein, 153 aa, Ipomoea nil
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRLYASGA

SEQ ID NO: 5056 - protein, 153 aa, Actinidia deliciosa
MANSNLPRRIIKETQRLLSEPAPGISASPSEDNMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASDE

SEQ ID NO: 5057 - protein, 153 aa, Liriodendron tulipifera
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRQYASGA

SEQ ID NO: 5058 - protein, 153 aa, Orobanche aegyptiaca
MSNSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENVAKHWKSNESEAVDTAKEWTRLYATGA

SEQ ID NO: 5059 - protein, 153 aa, Pinus taeda
MANANLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEVEAVETAKEWTRLYASGA

SEQ ID NO: 5060 - protein, 153 aa, Plantago ovata
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLSENIAKHWKSNETEAVETAKEWTRSYATGA

SEQ ID NO: 5061 - protein, 153 aa, Papaver somniferum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYATGA

SEQ ID NO: 5062 - protein, 153 aa, Prunus persica
MANSNLPRRIIKETQRLLSEPAPGISASPSEENMRYFNVMILGPAQSPYEGGVFKLELFLPEEYPMAPPKVRFLTKIYHPNIDKLGRICLDILKDKWSPALQIRTVLLSVQALLSAPNPDDPLSENIAKHWKTNEAEAVETAKEWTRLYASGE

SEQ ID NO: 5063 - protein, 153 aa, Pseudotsuga menziesii
MANANLPRRIIKETQRLLSEPAPGISASPSEDNMRYFNVMILGPTQSPYEGGVYKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5064 - protein, 153 aa, Raphanus sativus
MANGNLPRRIIKETQRLLSEPAPGISASPSEDNMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 5065 - protein, 153 aa, Salvia sclarea
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYATGA

SEQ ID NO: 5066 - protein, 153 aa, Sarracenia psittacina
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTSLYATGA

SEQ ID NO: 5067 - protein, 153 aa, Unknown
  Sequence found in Organisms: Scabiosa columbaria, Valeriana officinalis
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEADAVETAKEWTRLYATGA

SEQ ID NO: 5068 - protein, 153 aa, Silene vulgaris
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTDEAEAVETAKEWTRLYASGE

SEQ ID NO: 5069 - protein, 153 aa, Unknown
  Sequence found in Organisms: Sorghum bicolor, Saccharum officinarum
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANEAEAVETAKEWTRVYASGA

SEQ ID NO: 5070 - protein, 153 aa, Picea glauca
MANANLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 5071 - protein, 153 aa, Fragaria vesca
MANSNLPRRIIKETQRLLSEPAPGISASPSEENMRYFNVMILGPAQSPYEGGVFKLELFLPEEYPMAPPKVRFLTKIYHPNIDKLGRICLDILKDKWSPALQIRTVLLSIQALLSAPNPDDPLSENIAKHWKSNETEAVETAKEWTRLYGSGE

SEQ ID NO: 5072 - protein, 153 aa, Helianthus annuus
MASSNLPRRIIKETQRLLSEPAPGISASPSEDNMRYFNVMILGPTQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5073 - protein, 153 aa, Taxus baccata
MSNSNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 5074 - protein, 153 aa, Tragopogon dubius
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTHLYASGA

SEQ ID NO: 5075 - protein, 153 aa, Utricularia gibba
MANANLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 5076 - protein, 153 aa, Utricularia gibba
MANANLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 5077 - protein, 153 aa, Valeriana officinalis
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTLSYASGE

SEQ ID NO: 5078 - protein, 153 aa, Phaseolus vulgaris
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSSEVEAVETAKEWTRLYASDA

SEQ ID NO: 5079 - protein, 153 aa, Olea europaea
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASAE

SEQ ID NO: 5080 - protein, 153 aa, Panicum virgatum
MANSNLPRRIIKETQRLLSDPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANEAEAVETAKEWTRVYASGA

SEQ ID NO: 5081 - protein, 153 aa, Abies balsamea
MANANLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNELEAVETAKEWTRLYASGA

SEQ ID NO: 5082 - protein, 151 aa, Unknown
  Sequence found in Organisms: Ambrosia trifida, Arnica chamissonis
NSNLPRRIIKETQRLLSEPAPGISASPSEDNMRYFNVMILGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5083 - protein, 153 aa, Amorphophallus konjac
MANSNLPRRIIKETQRLLSEPAPGISASPAEDNMRYFNVMILGPTQSPYEGGVFKLELFLPEEYPMAPPKVRFLTKIYHPNIDKLGRICLDILKDKWSPALQIRTVLLSIQALLSAPNPDDPLSDNVAKHWKTNEAEAVETAKEWTRLYASGA

SEQ ID NO: 5084 - protein, 154 aa, Artemisia annua
MATNSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLSENVAKHWKANEAEAVETAKEWTNLYASGT

SEQ ID NO: 5085 - protein, 153 aa, Musa acuminata
MASSNLPPRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAREWTRLYATGA

SEQ ID NO: 5086 - protein, 153 aa, Cannabis sativa
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLSENIAKHWKTNETEAVETAKEWTRLYASGE

SEQ ID NO: 5087 - protein, 153 aa, Brassica napus
MANSSLPRRIIKETQRLLSEPAPGISASPSEDNMRYFNVMVLGPSQSPYEGGVFKLELFLPEEYPMSAPKVRFLTKIYHPSIDKLGRICLDILQDKWSPALQIRTVLLSIQALLSAPNPDDPLSENIAKHWKSNEAEAVETAKEWTRLYASGA

SEQ ID NO: 5088 - protein, 153 aa, Cephalotaxus harringtonia
MSNSNLPRRIIKETQRLLSEPAPGISASPSEDNLRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 5089 - protein, 153 aa, Cirsium arvense
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEADAVETAKEWTNLYASGT

SEQ ID NO: 5090 - protein, 153 aa, Cleome gynandra
MANNNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYANGA

SEQ ID NO: 5091 - protein, 153 aa, Unknown
  Sequence found in Organisms: Gossypium hirsutum, Gossypium raimondii
MANTNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYATGA

SEQ ID NO: 5092 - protein, 153 aa, Gossypium hirsutum
MANTNLPRRIIKETQRLLSEPAPGISASPSEDNMRYFNVMILGPTQSPYEGGVFKLELFLPEEYPMTAPKVRFLTKIYHPNIDKLGRICLDILKDKWSPALQIRTVLLSIQALLSAPNPDDPLSENIAKHWKMNEAEAVETAKEWTRLYASGA

SEQ ID NO: 5093 - protein, 153 aa, Unknown
  Sequence found in Organisms: Gossypium hirsutum, Gossypium raimondii
MANTNLPRRIIKETQRLLSEPAPGISASPSEDNMRYFNVMILGPTQSPYEGGVFKLELFLPEEYPMTAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 5094 - protein, 153 aa, Unknown
  Sequence found in Organisms: Gossypium hirsutum, Gossypium raimondii
MANSNLPRRIIKETQRLLSEPAPGINASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYANGA

SEQ ID NO: 5095 - protein, 153 aa, Cycas rumphii
MASSNLPRRIIKETQRLLSEPAPGISASPSEENLRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGT

SEQ ID NO: 5096 - protein, 153 aa, Taraxacum officinale
MANSNLPRRIIKETQRLLSEPAPGISASPSEENMRYFNVMILGPTQSPYEGGVFKLELFLPEEYPMAAPKVRFLTKIYHPNIDKLGRICLGILKDKWSPALQVRTVLLSIQALLSAPNPDDPLSENIAKHWKTNEVEAVETAKEWTHMYASGA

SEQ ID NO: 5097 - protein, 153 aa, Eschscholzia californica
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKADEVEAVETAKEWTRLYASGA

SEQ ID NO: 5098 - protein, 153 aa, Fagopyrum esculentum
MANSNLPRRIIKETQRLLSEPAPGISASPSEDNMRYFNVMILGPSQSPYEGGVFKLELFLPEEYPMAPPKVRFLTKIYHPNIDKLGRICLDILKDKWSPALQIRTVLLSIQALLSAPNPDDPLSENIAKHWKSNEVEAVETAKEWTRLYATGA

SEQ ID NO: 5099 - protein, 153 aa, Zingiber officinale
  misc_feature (13)..(13): Xaa can be any naturally occurring amino acid
  misc_feature (25)..(26): Xaa can be any naturally occurring amino acid
MANSNLPRRIIKXTQRLLSEPAPGXXASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5100 - protein, 153 aa, Gnetum gnemon
MANANLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNESEAVETAKEWTRLYASGA

SEQ ID NO: 5101 - protein, 153 aa, Humulus lupulus
MANSNLPRRIIKETQRLLSEPAPGISASPSEENMRYFNVMVLGPSQSPYEGGVFKLELFLPEEYPMTPPKVRFLTKIYHPNIDKLGRICLDILKDKWSPALQIRTVLLSIQALLSAPNPDDPLSENIAKHWKTNETEAVETAKEWTRLYASGE

SEQ ID NO: 5102 - protein, 153 aa, Actinidia deliciosa
  misc_feature (147)..(147): Xaa can be any naturally occurring amino acid
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTXLYATGA

SEQ ID NO: 5103 - protein, 153 aa, Liriodendron tulipifera
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGV

SEQ ID NO: 5104 - protein, 153 aa, Pinus pinaster
MANANLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEVEAVETAKEWTRLYASGA

SEQ ID NO: 5105 - protein, 153 aa, Pennisetum glaucum
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKSNETEAVETAKEWTRVYASGE

SEQ ID NO: 5106 - protein, 153 aa, Allium cepa
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTHLHASGT

SEQ ID NO: 5107 - protein, 153 aa, Catharanthus roseus
MANSNLPKRIIKETQRLLSEPAPGISASPSEDNMRDFNVMILGPAQSPYEGGVFKLELFLPEEYPMAPPKVRFLTKIYHPNIDKLGRICLDILKDKWSPALQIRTVLLSIQALLSAPNPDDPLSENIAKHWKSNEAEAVETAKEWTRLYATGA

SEQ ID NO: 5108 - protein, 153 aa, Phalaenopsis aphrodite
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGP

SEQ ID NO: 5109 - protein, 153 aa, Phalaenopsis aphrodite
MANSNLPRRIIKETQRLLSEPAPGISASPSEDNMRYFNVMILGPSQSPFEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGA

SEQ ID NO: 5110 - protein, 153 aa, Primula obconica
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVDTAKEWTRVYANGE

SEQ ID NO: 5111 - protein, 154 aa, Raphanus sativus
MANSSNLPKRIIKETQRLLSEPAPGISASPSEDNMRYFNVMVLGPSQSPYEGGVFKLELFLPEDYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5112 - protein, 153 aa, Rosa hybrid cultivar
MANSNLPRRIIKETQRLLSEPAPGISASPSEENMRYFNVMILGPAQSPYEGGVFKLELFLPEEYPMAPPKVRFLTKIYHPNIDKLGRICLDILKDKWSPALQIRTVLLSVQALLSAPNPDDPLSENIAKHWKSNETEAVDTAKEWTRLYASGE

SEQ ID NO: 5113 - protein, 153 aa, Sciadopitys verticillata
MANTNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKSNEVEAVETAKEWTRLYASGA

SEQ ID NO: 5114 - protein, 153 aa, Sciadopitys verticillata
MSNSNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKSNETEAVETAKEWTRLYASGA

SEQ ID NO: 5115 - protein, 153 aa, Olea europaea
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPEDPLSENIAKHWKTDESEAVETAKEWTRLYASGA

SEQ ID NO: 5116 - protein, 120 aa, Allium cepa
MRYFNVMILGPTQSPYEGGVFKLELFLPEEYPMAAPKVRFLTKIYHPNIDKLGRICLDILKDKWSPALQIRTVLLSIQALLSAPNPDDPISENIAKHWKANEAEAVETAKEWTRLYASGA

SEQ ID NO: 5117 - protein, 88 aa, Sarracenia psittacina
MAAPKVRFLTKIYHPNIDKLGRICLDILKDKWSPALQIRTVLLSIQALLSAPNPDDPLSENIAKHWKTSEAEAVETAKEWTRLYASGA

SEQ ID NO: 5118 - protein, 96 aa, Sarracenia psittacina
MFLPEEYPMAAPKVRFLTKIYHPNIDKLGRICLDILKDKWSPALQIRTVLLSIQALLSAPNPDDPLSENIAKHWKTSEAEAVETAKEWTRLYASGA

SEQ ID NO: 5119 - protein, 81 aa, Tragopogon dubius
MANSNLPRRIIKETQRLLSEPAPGISASPSEDNMRYFNVMILGPSQSPYEGGVFKLELFLPEEYPMAAPKVRFLTKFTTQH

SEQ ID NO: 5120 - protein, 421 aa, Tripterygium wilfordii
MAIRPPLHQFTIYQDLHRQKLLSLLFISSKSLLLCPSPPTSQSISPVNFLRRLASSAPLPNHRRRALKKSLSPPPDTLAQKIGKSIRRLGAPSKARVYPDVNVIRPKEYWDYESLTVQWGEQDDYEVVRKVGRGKYSEVFEGIHATNNEKCIIKILKPVKKKKIKREIKILQNLCGGPNIVKLLDIVRDQQSKTPSLIFEHVNNTDFKVLYPTLSDYDIRYYIFELLKALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNHDQLVKIAKVLGTDELNAYLNKYRIELDPRLAALVGRHSRKPWSKFINVDNQHLAVPEAIDFVDKLLRYDHQERPTAKEAMAHPYFYPIRNAESSRT

SEQ ID NO: 5121 - protein, 156 aa, Aquilegia formosa
MANTNLPRRIIKETQRLLSEPAPGISASPSEENMRYFNVMILGPSQSPYEGGVFKLELFLPEEYPMAAPKVRFLTKIYHPNIDKAMQLGRICLDILKDKWSPALQIRTVLLSIQALLSAPNPDDPLSENIAKHWKANEAEAVETAKEWTRLYASGA

SEQ ID NO: 5122 - protein, 88 aa, Amborella trichopoda
MAAPKVRFLTKIYHPNIDKLGRICLDILKDKWSPALQIRTVLLSIQALLSAPNPDDPLSENIAKHWKTNEAEAVETAKEWTRLYATGA

SEQ ID NO: 5123 - protein, 180 aa, Fraxinus spp
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPEDPLSETLLSIGKQTRLKPLKQQRMDALVCKWCMKCVERKASVNNKPCTDRLLNELGKIVI

SEQ ID NO: 5124 - protein, 158 aa, Olea europaea
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPEDPLSETLLSIGKQTSLKPLKQQKNGHVYMQVGHEVRRA

SEQ ID NO: 5125 - protein, 153 aa, Panicum virgatum
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANETEAVGTAKEWTRVYASGA

SEQ ID NO: 5126 - protein, 153 aa, Amsonia hubrichtii
MANSNLPKRIIKETQRLLSEPAPGISASPSEDNMRYFNVMILGPAQSPYEGGVFKLELFLPEEYPMAPPKVRFLTKIYHPNIDKLGRICLDILKDKWSPALQIRTVLLSIQALLSAPNPDDPLSENIAKHWKTNEAEAVETAKEWTQLYATGA

SEQ ID NO: 5127 - protein, 153 aa, Musa acuminata
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSDNIARHWKTNEAEAVETAKEWTRLYATGA

SEQ ID NO: 5128 - protein, 153 aa, Cichorium intybus
MANSNLPLRIIKETQRLLIEPAPGISASPSEENMRYFNVMILGPTQSPYEGGVFKLELFLPEEYPMAAPKVRFLTKIYHPNIDKLGRICLDILKDKWSPALQIRTVLLSIQTLLSAPNPDDPLSENIAKHWKTNEAEAVETAKEWTHLYASGA

SEQ ID NO: 5129 - protein, 153 aa, Eschscholzia californica
MANSNLPKRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKANEVEAVETAKEWTQLYASGA

SEQ ID NO: 5130 - protein, 153 aa, Ananas comosus
MANSNLPRRIIKETQRLLSEPAPGISAYPSEENMRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRLYASEG

SEQ ID NO: 5131 - protein, 153 aa, Platanus occidentalis
MASSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKTNEVEAVETAKEWTRLYASGE

SEQ ID NO: 5132 - protein, 153 aa, Podocarpus macrophillus
MANSNLPRRIIKETQRLLSEPAPGISASPSEENLRYFNVMILGPSQSPYEGGVFKLELFLPEDYPMAAPKVRFLTKIYHPNIDKLGRICLDILKDKWSPALQIRTVLLSIQALLSAPNPDDPLSDNIAKHWKANEAEAVETAKEWTRLYANGA

SEQ ID NO: 5133 - protein, 153 aa, Picea glauca
MSNSNLPRRIIKETQRLLTEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRLYASGA

SEQ ID NO: 5134 - protein, 153 aa, Tabernaemontana elegans
MANSNLPKRIIKETQRLLSEPAPGISASPSEDNMRYFNVMVLGPAQSPYEGGVFKLELFLPEEYPMAPPKVRFLTKIYHPNIDKLGRICLDILKDKWSPALQIRTVLLSIQALLSAPNPDDPLSENIAKHWKTNETEAVETAKEWTQLYATGA

SEQ ID NO: 5135 - protein, 150 aa, Zinnia violacea
SNLPRRIIKETQRLLSEPAPGISASPSEDNMRYFNVMILGPTQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5136 - protein, 153 aa, Abies balsamea
MSNSNLPRRIIKETQRLLSEPAPGISASPSEDNLRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEVDAVETAKEWTRLYASGA

SEQ ID NO: 5137 - protein, 153 aa, Amborella trichopoda
MANTNLPRRIIKETQRLLSDPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRLYASGT

SEQ ID NO: 5138 - protein, 153 aa, Unknown
  Sequence found in Organisms: Hordeum vulgare, Pseudoroegneria spicata, Triticum aestivum
MANSNLPRRIIKETQRLLSEPAPGISASPSEENMRYFNVMILGPTQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDA

SEQ ID NO: 5139 - protein, 153 aa, Distylium racemosum
MSNSNLPRRIIKETQRLLSEPAPGISASPSEDNLRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKTNESEAVETAKEWTRLYASGA

SEQ ID NO: 5140 - protein, 151 aa, Fagopyrum esculentum
NSNLPRRIIKETQRLLSEPAPGISASPSEDNMRYFNVMILGPSQSPYEGGVFKLELFLPEEYPMAPPKVRFLTKIYHPNIDKLGRICLDILKDKWSPALQIRTVLLSIQALLSAPNPDDPLSENIAKHWKSNEVEAVETAKEWTRLYATGA

SEQ ID NO: 5141 - protein, 153 aa, Setaria italica
MAHSNLPRRIIKETQRLLSEPAPGISASPTEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKSNETEAVETAKEWTRLYASGE

SEQ ID NO: 5142 - protein, 153 aa, Unknown
  Sequence found in Organisms: Pinus pinaster, Pinus taeda
MSNSNLPRRIIKETQRLLTEPAPGISASPSEDNLRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEIEAVETAKEWTRLYASGA

SEQ ID NO: 5143 - protein, 153 aa, Secale cereale
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDA

SEQ ID NO: 5144 - protein, 153 aa, Sequoia sempervirens
MSNSNLPRRIIKETQRLLTEPAPGISASASEDNLRYFNVMILGPAQSPYEGGCFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 5145 - protein, 149 aa, Vinca minor
NLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGT

SEQ ID NO: 5146 - protein, 73 aa, Cedrus atlantica
MSNSNLPRRIIKETQRLLSEPAPGISASPSEDNLRYFNVMILGPSQSPYEGGVFKLEYFCLKSILWQHQRFVF

SEQ ID NO: 5147 - protein, 88 aa, Gossypium raimondii
MAAPKVRFLTKIYHPNIDKLGRICLDILKDKWSPALQIRTVLLSIQALLSAPNPDDPLSENIAKHWKTNEAEAVETAKEWTRLYASSA

SEQ ID NO: 5148 - protein, 73 aa, Podocarpus macrophillus
MSNSNLPRRIIKETQRLLSEPAPGISASPSEENLRYFNVMILGPSQSPYEGVFSSWSYFCLKSILWQLQRFAF

SEQ ID NO: 5149 - protein, 153 aa, Avena sativa
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDG

SEQ ID NO: 5150 - protein, 149 aa, Platanus occidentalis
NLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRLYASGA

SEQ ID NO: 5151 - protein, 153 aa, Rhizophora mangle
MANSNLPRRIIKETQRLLSEPAPGISASPAEDNMRYFNAMILGPTQSPYEGGVFKLELFLPEEYPMAPPKVRFLTKIYHPNIDKLGRICLDILKDKWSPALQIRTVLLSIQALLSAPNPDDPLSENIAKHWKTNETEAVGTAKEWTRLYASGA

SEQ ID NO: 5152 - protein, 156 aa, Ceratodon purpureus
MSATANTNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENVAKHWKTNEAEAVETAKEWTRVYATGA

SEQ ID NO: 5153 - protein, 153 aa, Cephalotaxus harringtonia
MANTNLPRRIIKETQRLLSEPAPGISASPSEDNLRYFNVMILGPTQSPYEGGIFKLELFLPEEYPMAAPKVRFLTKIYHPNIDKLGRICLDILKDKWSPALQIRTILLSIQALLSAPNPDDPLSDNIAKHWKANEAEAVETAKEWARLYASGA

SEQ ID NO: 5154 - protein, 153 aa, Sequoia sempervirens
MANANLPRRIIKETQRLISEPAPGISASPSEDNLRYFNVMILGPSQSPYEGGFFKLELFLPEEYPMAAPKVRFLTKIYHPNIDKLGRICLDILKDKWSPALQIRTVLLSIQALLSAPNPDDPLSENIAKHWKANEVEAVETAKEWTRLYASGT

SEQ ID NO: 5155 - protein, 61 aa, Distylium racemosum
MANTNLPRRIIKETHRLLSDPAPGISASPSEENLRYFNVMILGPPQSPYEGGVFKLELFLP

SEQ ID NO: 5156 - protein, 114 aa, Pteridium aquilinum
MILGPTQSPYEGGVFKLELFLPEEYPMAAPKVRFLTKIYHPNIDKLGRICLDILKDKWSPALQIRTVLLSIQALLSAPNPEDPLSENIAKHWKTNETEAVETAKEWTRMYASGA

SEQ ID NO: 5157 - protein, 153 aa, Cryptomeria japonica
MANANLPRRIIKETQRLISEPAPGISASPSEDNLRYFNVMILGPSQSPYEGGFFKLELFLPEEYPMAAPKVRFLTKIYHPNIDKLGRICLDILKDKWSPALQIRTVLLSIQALLSAPNPDDPLSDKIAKHWKANEAEAMETAKEWTRMYASGT

SEQ ID NO: 5158 - protein, 83 aa, Picea glauca
SYVDSDLPRRIIKETQRLLTEPAPGISASPSEENLRYFNVMILGPTQSPYEGAFSSWSYSYLKNIQWPLQRSDFDKDIPSKYR

SEQ ID NO: 5159 - protein, 144 aa, Brassica juncea
IIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGE

SEQ ID NO: 5160 - protein, 144 aa, Epimedium sagittatum
ANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKES

SEQ ID NO: 5161 - protein, 153 aa, Fagopyrum esculentum
MANSSLPRRIIKETQRLLSEPAPGISASPSEDNMRYFNVMILGPTQSPYEGGVFKLELFLPEDYPMAAPKVRFLTKIYHPNIDKLGRICLDILKDKWSPALQIRTVLLSIQALLSAPNPDDPLSENIAKHWKADEHEAVETAKEWTHLYATSE

SEQ ID NO: 5162 - protein, 150 aa, Rhizophora mangle
MENSNLPRRIIKETQRLLSEPAPGISASPAEDNMRYFNVMILGPTQSPYEGGVFKLELFLPEEYPMAAPKVRFLTKIYHPNVDKLGRICLDILKDKWSPALQIRTVLLSIQALLSAPNPDDPLSENIARHWKTNEAEAVETAKEWTHLYA

SEQ ID NO: 5163 - protein, 157 aa, Physcomitrella patens
MSAAAANANLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENIAKHWKSNEQEAVETAREWTRSYASGV

SEQ ID NO: 5164 - protein, 157 aa, Physcomitrella patens
MSAATANTNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENIAKHWKTNEQEAVETAREWTRLYASGA

SEQ ID NO: 5165 - protein, 158 aa, Ceratodon purpureus
MSSAATANTNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENVAKHWKTNEVEAVDTAKQWTRLYASGA

SEQ ID NO: 5166 - protein, 156 aa, Adiantum capillus-veneris
MSAANTNSNLPRRIIKETQRLLSEPAPGISASPSEDNLRYFNVMILGPTQSAYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASA

SEQ ID NO: 5167 - protein, 97 aa, Fraxinus spp
MFLPEEYPMAAPKVRFLTKIYHPNIDKLGRICLDILKDKWSPALQIRTVLLSIQALLSAPNPEDPLSENIAKHWKTDEAEAVETAKEWTRLYASSGA

SEQ ID NO: 5168 - protein, 142 aa, Malus domestica
KETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGV

SEQ ID NO: 5169 - protein, 142 aa, Eschscholzia californica
KETQRLLSEPAPGISASPSEDNMRYFNVMVLGPSQSPYEGGVFKLELFLPEEYPMAAPKVRFLTKIYHPNIDKLGRICLDILKDKWSPALQIRTVLLSIQALLSAPNPDDPLSENVAKHWKANEVEAVETAKEWTRLYASGA

SEQ ID NO: 5170 - protein, 148 aa, Vinca minor
LTSSNHQETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5171 - protein, 157 aa, Marchantia polymorpha
MSGTTANSNLPRRIIKETQRLLSEPAPGISASPSEENLRYFNVMILGPTQSPYEGGVFKLELFLPEEYPMAAPKVRFLTKIYHPNIDKLGRICLDILKDKWSPALQIRTVLLSIQALLSAPNPDDPLAENIAKHWKTDEAQAVATAREWTRLYATGA

SEQ ID NO: 5172 - protein, 156 aa, Pteridium aquilinum
MSAANANSNLPRRIIKETQRLLSEPAPGISASPSEDNLRYFNVMILGPSQSAYEGGVFKLELFLPEEYPMSAPKVRFLTKIYHPNIDKLGRICLDILKDKWSPALQIRTVLLSIQALLSAPNPDDPLSENIAKHWKTNEAEAVETAKEWTQLYASA

SEQ ID NO: 5173 - protein, 141 aa, Arnica chamissonis
ETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5174 - protein, 153 aa, Unknown
  Sequence found in Organisms: Citrus clementina, Citrus sinensis
MASGNLPRRIVKETQRLLSEPAPGISASPAEDNMRYFNVMILGPSQSPYEGGVFKLELFLPEDYPMSAPKVRFLTKIYHPNIDKLGRICLDILKDKWSPALQIRTVLLSIQALLSAPNPDDPLSDNIAKHWKADETEAVETAKEWTRLYASDG

SEQ ID NO: 5175 - protein, 153 aa, Musa acuminata
MANRNLPQRIIKETQRLLSEPEPGISALPSEDNMRSFSVKILGPNQSPYEGGVFKLELFLPDEYPMVAPKVRFLTKIYHPNIDKLGRICLDILKDKWTPALQIRTVLLSIQALLSAPNPDDPLSENIAKHWKANEAEALETAKEWTHVYASGA

SEQ ID NO: 5176 - protein, 140 aa, Raphanus sativus
  misc_feature (121)..(121): Xaa can be any naturally occurring amino acid
  misc_feature (136)..(136): Xaa can be any naturally occurring amino acid
SNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLXENIAKHWKSNEAEAXETAK

SEQ ID NO: 5177 - protein, 143 aa, Cirsium arvense
SRKTQRLLSEPAPGISASPSEENMRYFNVMILGPSQSPYEGGVFKLELFLPEDYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 5178 - protein, 88 aa, Lippia dulcis
MAPPKVRFLTKIYHPNIDKLGRICLDILKDKWSPALQIRTVLISIQALLSAPNPDDPLADNIAKHWKANETEAVETAKEWTRLYASDA

SEQ ID NO: 5179 - protein, 157 aa, Ceratodon purpureus
MSAPATANAALPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENIAKHWKTNEAEAMETAREWTKAYASA

SEQ ID NO: 5180 - protein, 148 aa, Leymus cinereus x Leymus triticoides
RHEGIIKETQRLLSEPAPGISASPSEENMRYFNVMILGPSQSPYEGGVFKLELFLPEEYPMSPPKVRFLTKIYHPNIDKLGRICLDILKDKWSPALQIRTVLLSIQALLSAPNPDDPLADNVAKHWKANETEAVETAKEWTRVYANDA

SEQ ID NO: 5181 - protein, 104 aa, Primula obconica
MRYFNVMILGPTQSPYEGGVFKLELFLPEEYPMTAPKVRFLTKIYHPNIDKLGRICLDILKDKWSPALQIRTVLLSIQALLSAPNPDDPLSENIAKHWKSNEAE

SEQ ID NO: 5182 - protein, 120 aa, Allium cepa
MANSNLPRRIIKETQRLLSEPAPGISASPSEENMRYFNVMILGPSQSPYEGGVFKLELFLPEEYPMAAPKLGRICLDILKDKWSPALQIRTVLLSIQALLSAPNPDDPLSENNCQALENK

SEQ ID NO: 5183 - protein, 136 aa, Bupleurum chinense
LSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 5184 - protein, 133 aa, Fagus grandifolia
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKT

SEQ ID NO: 5185 - protein, 128 aa, Centaurea maculosa
MVSINLPRTIVKETPRLLGEPAPGIRASPSEDNMRDFNVTILGPTQSPYDGGVFKLELFLPEEYPMAASKVRFLTKIYHPNIDQLGRICLDILKDKWSPALHIPTVLLSIRALLSAPNPDDPLSENIA

SEQ ID NO: 5186 - protein, 148 aa, Cyamopsis tetragonoloba
  misc_feature (1)..(1): Xaa can be any naturally occurring amino acid
  misc_feature (13)..(13): Xaa can be any naturally occurring amino acid
  misc_feature (20)..(20): Xaa can be any naturally occurring amino acid
  misc_feature (37)..(37): Xaa can be any naturally occurring amino acid
XNHVCDATKLELXSEPAPGXSASPSEDNMRYFNVMIXGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 5187 - protein, 132 aa, Pteridium aquilinum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWK

SEQ ID NO: 5188 - protein, 120 aa, Pisum sativum
MRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 5189 - protein, 104 aa, Papaver somniferum
IIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQAL

SEQ ID NO: 5190 - protein, 169 aa, Carpinus betulus
MANTLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRFICKWCMMMGVLCSYEFPKCMLK

SEQ ID NO: 5191 - protein, 172 aa, Carthamus tinctorius
IPLFSLSLKGKKKTSKFHFNGERNLPRRIIKETQRLLSEPAPGISASPSEENMRYFNVMILGPTQSPYEGGVFKLELFLPEDYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 5192 - protein, 153 aa, Scabiosa columbaria
MANTNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTMKSRLLKQQRSGRVCMQVEL

SEQ ID NO: 5193 - protein, 137 aa, Prunus mume
GIIYTAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGV

SEQ ID NO: 5194 - protein, 158 aa, Volvox carteri
MNADQAAQAAQLPRRIIKETQKLLSEPAPGISASPSEENLRYFNVMILGPQQSPYEGGVFKLELFLPEDYPMAPPKVRFLTKIYHPNIDKLGRICLDILKDKWSPALQIRTVLLSIQALLSAPNPDDPLADNVAKHWKENEKEAIATARQWTSMYAQG

SEQ ID NO: 5195 - protein, 134 aa, Bruguiera gymnorhiza
  misc_feature (30)..(30): Xaa can be any naturally occurring amino acid
  misc_feature (68)..(68): Xaa can be any naturally occurring amino acid
MANSNLPRRIIKETQRLLSEPAPGISASPXEDNMRYFNVMILGPTQSPYEGGVFKLELFLPEEYPMAXPKVRFLTKIYHPNIDKLGRICLDILKDKWSPALQIRTVLLSIQALLSAPNPDDPLSENIAKHWKVK

SEQ ID NO: 5196 - protein, 139 aa, Cannabis sativa
FFFFGDSAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYASGA

SEQ ID NO: 5197 - protein, 158 aa, Chlamydomonas reinhardtii
MNPDQAAQAAQLPRRIIKETQKLLSEPAPGISASPSEENLRYFNVMILGPQQSPYEGGVFKLELFLPEDYPMAPPKVRFLTKIYHPNIDKLGRICLDILKDKWSPALQIRTVLLSIQALLSAPNPDDPLAEHVAKHWKENEKEAIATARQWTAMHAQG

SEQ ID NO: 5198 - protein, 186 aa, Lolium multiflorum
MANSNLPRRIIKETQRLLSEPGLFGILGGGFRGGIWVSCVVLIRVLCCVGCVRAAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRVYASGA

SEQ ID NO: 5199 - protein, 88 aa, Persea americana
MAAPKVRFLTKIYHPNIDKLGRICLDILKDKWSPALQIRTVLLSIQALLSAPNPDDPLSDNIAKHWKSNETEAVATAKEWTRLYASGA

SEQ ID NO: 5200 - protein, 128 aa, Allium cepa
SASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 5201 - protein, 118 aa, Pinus taeda
TCDLGCHSIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPKSR

SEQ ID NO: 5202 - protein, 149 aa, Brachypodium distachyon
MSAVLTRPAPGTVQCFGRKKTAVAVAYCKPGRGLIKVNGAPIELIRPEMLRLKAFEPILLAGRSRFKDIDMRIRVRGGGKTSQIYAIRQAIAKGLVAYFQKYVDEAAKKEVKEIFGRYDRTLLVADPRRCEPKKFGGRGARARFQKSYR

SEQ ID NO: 5203 - protein, 149 aa, Unknown
  Sequence found in Organisms: Festuca arundinacea, Lolium multiflorum
MSAVLTRPTPGTVQCFGRKKTAVAVAYTKPGRGLIKVNGAPIELIRPEMLRLKAFEPIMLAGRSRFKDIDMRIRVRGGGKTSQIYAIRQAIAKALVAYYQKYVDEAAKKEVKDIFGRYDRTLLVADPRRCEPKKFGGRGARARFQKSYR

SEQ ID NO: 5204 - protein, 149 aa, Avena sativa
MAAVLTRPTPGTVQCFGRKKTAVAVAYTKPGRGLIKVNGAPIELIRPEGLRLKAFEPIMLAGRSRFKDIDMRIRVRGGGKTSQIYAIRQAIAKALVAYYQKYVDEAAKKEVKDIFGRYDRTLLVADPRRCEPKKFGGRGARARFQKSYR

SEQ ID NO: 5205 - protein, 149 aa, Secale cereale
MAAVLTRPTPGTVQCFGRKKTAVAVAYTKPGRGLIKVNGAPIELIRPEMLRLKAFEPILLAGRSRFKDIDMRIRVRGGGKTSQIYAIRQAVAKALVAYYQKYVDEAAKKEVKDIFARYDRTLLVADPRRCEPKKFGGRGARARFQKSYR

SEQ ID NO: 5206 - protein, 149 aa, Unknown
  Sequence found in Organisms: Hordeum vulgare, Triticum aestivum
MAAVLTRPTPGTVQCFGRKKTAVAVAYTKPGRGLIKVNGAPIELIRPEMLRLKAFEPIMLAGRSRFKDIDMRIRVRGGGKTSQIYAIRQAVAKALVAYYQKYVDEAAKKEVKDIFARYDRTLLVADPRRCEPKKFGGRGARARFQKSYR

SEQ ID NO: 5207 - protein, 149 aa, Setaria italica
MAAVLTRPTPGTVQCFGRKKTAVAVAYTKPGRGLIKVNGVPIELIRPEGLRLKAFEPILLAGRSRFKDIDMRIRVRGGGKTSQIYAIRQAIAKALVSYYQKYVDEAAKKEVKDIFGRYDRTLLVADPRRCEPKKFGGRGARARFQKSYR

SEQ ID NO: 5208 - protein, 149 aa, Unknown
  Sequence found in Organisms: Pennisetum glaucum, Setaria italica
MSTVLTRPTAGTVQCFGRKKTAVAVAYTKPGRGLIKVNGAPIELIRPEGLRLKAFEPILLAGRSRFKDIDMRIRVRGGGKTSQIYAIRQAIAKALVAYYQKYVDEAAKKEVKDIFGRYDRTLLVADPRRCEPKKFGGRGARARFQKSYR

SEQ ID NO: 5209 - protein, 149 aa, Pennisetum glaucum
MATVLTRPTAGTVQCFGRKKTAVAVAYTKPGRGLIKVNGALIELIRPEGLRLKAFEPILLAGRSRFKDIDMRIRVRGGGKTSQIYAIRQAIAKALVAYYQKYVDEAAKKEVKDIFGRYDRTLLVADPRRCEPKKFGGRGARARFQKSYR

SEQ ID NO: 5210 - protein, 149 aa, Oryza sativa
MAAALTRPPPGTVQCFGRKKTAVAVSYCKPGRGLIKVNGVPIELIRPEMLRLKAFEPILLAGRSRFKDIDMRIRVRGGGKTSQIYAIRQAIAKALVAYYQKYVDEASKKEVKDIFARYDRTLLVADPRRCEPKKFGGRGARARFQKSYR

SEQ ID NO: 5211 - protein, 67 aa, Oryza sativa
MTTARGRSACDDGRAGSPKQQTDHNVLRFFCHCFIDDFFIRSSIHLVVLVLVNVRWVVSGFVDPVWQ

SEQ ID NO: 5212 - protein, 149 aa, Brachypodium distachyon
MAAVLTRPTPGSVQCFGRKKTAVAVAYTKPGRGLIKVNGAPIELIRPEMLRLKAFEPILLAGRSRFKDIDMRIRVRGGGKTSQMYAIRQAIAKGLVSYLQKYVDEAAKKEAKDIFARYDRTLLVADPRRCEPKKFGGRGARARFQKSYR

SEQ ID NO: 5213 - protein, 149 aa, Zea mays
MSTVLQRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFTRYDRTLLVADPRRCEPKKFGGRGARARFQKSYR

SEQ ID NO: 5214 - protein, 149 aa, Avena sativa
MSTVLSRPAAGTVQCFGRKKTAVAVAYCKPGRGLIKVNGVPIELIRPEMLRLKAFEPILLAGRSRFKDIDMRIRVRGGGKTSQIYSIRQAIAKSLVSYFQKFVDEAAKKEVKDIFGRYDRTLLVADPRRCEPKKFGGRGARARFQKSYR

SEQ ID NO: 5215 - protein, 149 aa, Sorghum bicolor
MAAVLQRPAAGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFARYDRTLLVADPRRCEPKKFGGRGARARFQKSYR

SEQ ID NO: 5216 - protein, 149 aa, Panicum virgatum
MAAVLTRPAAGTVQCFGRKKTAVAVAYTKPGRGLIKVNGVPIELIRPEILRLKAFEPIMLAGRSRFKDIDMRIRVRGGGKTSQIYAIRQAVAKALVAYFQKYVDEAAKKEVKDIFGRYDRTLLVADPRRCEPKKFGGRGARARFQKSYR

SEQ ID NO: 5217 - protein, 148 aa, Sorghum bicolor
MSVLSRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFSRYDRTLLVADPRRCEPKKFGGRGARARFQKSYR

SEQ ID NO: 5218 - protein, 148 aa, Saccharum officinarum
MSVLSRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFARYDRTLLVADPRRCEPKKFGGRGARARFQKSYR

SEQ ID NO: 5219 - protein, 149 aa, Saccharum officinarum
MATVLQRPAAGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFARYDRTLLVADPRRCEPKKFGGRGARARFQKSYR

SEQ ID NO: 5220 - protein, 149 aa, Pennisetum glaucum
MANVLTRPTAGTVQCFGRKKTAVAVAYTKPGRGLIKVNGSPIELIRPEGLRLKAFEPILLAGRSRFQNIDMRIRVRGGGKTSQIYAIRQAIAKALVAYFQKYVDEASKKEVKDIFGRYDRTLLVADPRRCEPKKFGGRGARARFQKSYR

SEQ ID NO: 5221 - protein, 149 aa, Panicum virgatum
MATVLTRPAAGTVQCFGRKKTAVAVAYTKPGRGLIKVNGVPIELIRPEILRLKAFEPIMLAGRSRFKDIDMRIRVRGGGKTSQIYAIRQAVAKGLVAYFQKYVDEAAKKEVKDIFSRYDRTLLVADPRRCEPKKFGGRGARARFQKSYR

SEQ ID NO: 5222 - protein, 149 aa, Cenchrus ciliaris
MATVLTRPTAGTVQCFGRKKTAVAVAYTKPGRGLIKVNGAPIELIRPEGLRLKAFEPILLAGRSRFQNIDMRIRVRGGGKTSQIYAIRQAIAKALVAYFQKYVDEAAKKEVKDLFGRYDRTLLVADPRLFEPKKFGGRGARARFQKSYR

SEQ ID NO: 5223 - protein, 148 aa, Zea mays
MTVLSRPTPGTAQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEIKDIFTRYDRTLLVADPRRCEPKKFGGRGARARFQKSYR

SEQ ID NO: 5224 - protein, 528 aa, Zea mays
MELATVAAAVASAAARPHGPFSSPRAVSASVSWTSLSLAYTSRCLSSTSSRRRLRWLPVTSAAVELREATAGGGDSLRVTKTPQPGSSVKFSVEVPTSIIHECYQSTLQEYAKRVKVPGFRPGKTIPENVLINYVGPQHVQDATIEAILKHTLPQALSSVEERALEDSVRILTQFDDMRNSFSLDNVFRYDVAVDVAPEVRWLSEDKYRNLKVVVEIDEAVDAEKAAEKELQRRHKALGLLRIVADRGLQIGDLVVLDIFAESINNDGSRGEKISSAESTGFHLDTEENSNLVPGFLGSLIGIRAGETRSFPIQFPESFERESLRGVRAQFTVVCKELFYRELPVMDDSLAVKLLPGCTTIDEVRERILKRCKEVEKTAIEQATDNAILDQLGKLVEVDVPRALFQEQGQQLYGAKLLQLQAERKLDKDQLASLSTKRSVQAYLEDEKENITRIIKQMLAVGDIFKSENLQYSTDQLVKEVENSIAEFKQYNQDYDEDNIRQQVQDVLEAAKVLEWLKENCSVEYIRR

SEQ ID NO: 5225 - protein, 160 aa, Zea mays
IRRHLRKPPQPKPAVLQRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFTRYDRTLLVADPRRCEPKKFGGRGARARFQKSYR

SEQ ID NO: 5226 - protein, 154 aa, Triticum aestivum
MTVLSRPTPGTAQCFGRKKTAVAVAYTKPGRGLIKVNGVPIELIRPEMLRLKAFEPILLAGRSRFKDIDMRIRVRGGGKTSQIYAIRQAVAKGLVAYYKKYVDEAAKKEIKDIFTRYDRTSSSLTPALRAEEFGGRGAAQVQKSTVERCLLISI

SEQ ID NO: 5227 - protein, 129 aa, Cynodon dactylon
TAVAVAYTKPGRGLIKVNGVPIELIRPEMLRLKAFEPIMLAGRSRFKDIDMRIRVRGGGKTSQIYAIRQAIAKALVAYYQKYVDEAAKKEVKDIFARYDRTLLVADPRRCEPKKFGGRGARARFQKSYR

SEQ ID NO: 5228 - protein, 170 aa, Festuca arundinacea
AAEVPKPSPAPPRRLNQAAGATMSVLSRPAPGTVQCFGRKKTAVAVAYCKPGRGLIKVDGVPIELIRPEMLRLKAFEPILLAGRSRFKEIDMRIRVRGGGHTSQIYSIRQAIAKSLVAYCQKYVDEATKKEVKEIFARYDRTLLVADPRRCEPKKFGGRGARSRFQKSYR

SEQ ID NO: 5229 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 5230 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPEGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 5231 - protein, 443 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRGFCREGCNWHEGPYHGSQLCSWPEEGSVCEECPAYCYLDGKEARVC

SEQ ID NO: 5232 - protein, 843 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 5233 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTTKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDVMASDPLDPGTQSATLVTEIRKRKGLKEQMTPLSDFEDKL

SEQ ID NO: 5234 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTDIRKRKGLKEQMTPLSDFEDKL

SEQ ID NO: 5235 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 5236 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTDIRKRKGLKEQMTPLSDFEDKL

SEQ ID NO: 5237 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQALENALGGIYGVLNQKRGHVFEEMQRQGTPLYNIKAYLPVIESFGFSSTLRAATSGQAFPQCVFDHWDIMASDPLDPGTQSATLVTDIRKRKGLKEQMTPLSDFEDKL

SEQ ID NO: 5238 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 5239 - protein, 576 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDESKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPLSSPSVRLFWRSPAVPL

SEQ ID NO: 5240 - protein, 843 aa, Unknown
  Sequence found in Organisms: Secale cereale, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 5241 - protein, 843 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPEGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 5242 - protein, 286 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTTKNTGTATCKRGLFSSATSQSSKSSPPA

SEQ ID NO: 5243 - protein, 443 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRCFCREGCNWHEGPYHGSQLCSWPEEGSVCEECPAYCYLDGKEARVC

SEQ ID NO: 5244 - protein, 843 aa, Hordeum vulgare
MVKFTVEGLRIIMDKQNNIRNMSVIAHVDHGKSTLTDSLVAAAGIIAQEVAGDVRMTDTRADEAERGITIKSTGISLFYEMTEESLRAYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDMMSADPLEAGSQAAQLVLDIRKRKGLKEQMTPLSEFEDKL

SEQ ID NO: 5245 - protein, 843 aa, Brachypodium distachyon
MVKFTAEELRRIMDKKNNIRNMSVIAHVDHGKSTLTDSLVAAAGIIAQEVAGDVRMTDTRADEAERGITIKSTGISLFYEMTDESLQMYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPTTKKWTTKNTGSATCKRGFVQFCYEPIKQIINTCMNDQKDKLWPMLKKLGVTMKNDEKDLMGKALMKRVMQTWLPASRALLEMMVFHLPSPSKAQRYRVENLYEGPLDDIYATAIRNCDPEGPLMLYVSKMIPASDKGRFFAFGRVFAGRVATGMKVRIMGPNYVPGQKKDLYVKSVQRTVIWMGKKQESVEDVPCGNTVALVGLDQFITKNATLTNEKETDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSSRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGTQSATLVTEIRKRKGLKEQMTPLSEFEDKL

SEQ ID NO: 5246 - protein, 843 aa, Brachypodium distachyon
MVKFTAEELRRIMDKKNNIRNMSVIAHVDHGKSTLTDSLVAAAGIIAQEVAGDVRMTDTRADEAERGITIKSTGISLFYEMTDESLQMYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPTTKKWTTKNTGSATCKRGFVQFCYEPIKQIINTCMNDQKDKLWPMLKKLGVTMKNDEKDLMGKALMKRVMQTWLPASRALLEMMVFHLPSPSKAQRYRVENLYEGPLDDVYATAIRNCDPEGPLMLYVSKMIPASDKGRFFAFGRVFAGRVATGMKVRIMGPNYVPGQKKDLYVKSVQRTVIWMGKKQESVEDVPCGNTVALVGLDQFITKNATLTNEKETDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSSRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGTQSATLVTEIRKRKGLKEQMTPLSEFEDKL

SEQ ID NO: 5247 - protein, 805 aa, Triticum aestivum
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIM

SEQ ID NO: 5248 - protein, 843 aa, Brachypodium distachyon
MVKFTADDFRGIMDKKNNIRNMSVIAHVDHGKSTLTDSLVAAAGIIAQEVAGDVRMTDTRADEAERGITIKSTGISLYYEMTAESLRAYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDALLGDVQVYPEKGTVAFSAGLHGWAFTLTNFAKMYASKFGVDESKMMERLWGENFFDPTTKKWTSKNTGSPTCKRGFVQFCYDPIKQIINTCMNDQKDKLWPMLQKLGVTMKTDEKELMGKALMKRVMQTWLPASTALLEMMIFHLPSPSKAQKYRVENLYEGPLDDIYATAIRNCDPDGPLMLYVSKMIPASDRGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDTMSSDPLDAGSQAAQLVVDIRKRKGLKEQMTPLSDFEDKL

SEQ ID NO: 5249 - protein, 843 aa, Avena sativa
MVKFTAEELRRIMDKKNNIRNMSVIAHVDHGKSTLTDSLVAAAGIIAQEVAGDVRMTDTRADEAERGITIKSTGISLFYEMTDESLASYKGERDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDVLLGDVQVYPEKGTVAFSAGLHGWAFTLTNFAKMYASKFGVDESKMMERLWGENFFDPATKKWTTKSTGTATCKRGFVQFCYEPIKQIIEICMNDQKDKLWPMLKKLGIVMKNDEKDLMGKPLMKRVMQTWLPASRALLEMMVYHLPSPSKAQRYRVENLYEGPLDDIYANAIRNCDPDGPLMLYVSKMIPASDKGRFFAFGRVFAGKVATGMKVRIMGPNYVPGQKKDLYTKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQDDFMGGAEIIVSPPVVSFRETVLDKSCRTVMSKSPNKHNRLYMEARPLEENLPEAIDDGRIGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPENALGGIYGVLNQKRGHVFEEMQRPGTPLYNIKAYLPVIESFGFSATLRAATSGQAFPQCVFDHWDVMNSDPLEVGSQSHALVLDIRKRKGLKEQMTPLSEFEDKL

SEQ ID NO: 5250 - protein, 843 aa, Oryza sativa
MVKFTVEELRRIMDKKNNIRNMSVIAHVDHGKSTLTDSLVAAAGIIAQEVAGDVRMTDTRADEAERGITIKSTGISLFYEMSDESLKLYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDTLLGDVQVYPEKGTVAFSAGLHGWAFTLSSFAKMYASKFGVDEFKMMERLWGENFFDPATKKWTNKNTGSATCKRGFVQFCYEPIKQIINTCMNDQKDKLWPMLQKLGVVMKADEKELMGKALMKRVMQTWLPASNALLEMMIYHLPSPSKAQRYRVENLYEGPLDDVYATAIRNCDPEGPLMLYVSKMIPASDKGRFFAFGRVFSGRVATGMKVRIMGPNYVPGQKKDLYVKSVQRTVIWMGKKQESVEDVPCGNTVAMVGLDQFITKNATLTNEKESDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMTSDPLEAGSQASTLVQDIRKRKGLKEQMTPLSDFEDKL

SEQ ID NO: 5251 - protein, 211 aa, Secale cereale
MRGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPSCCLLP

SEQ ID NO: 5252 - protein, 843 aa, Panicum virgatum
MVKFTAEELRAIMDKKNNIRNMSVIAHVDHGKSTLTDSLVAAAGIIAQEVAGDVRMTDTRADEAERGITIKSTGISLYYEMTAESLKNYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLNVTMKADEKELVGKALMKRVMQTWLPASTALLEMMIFHLPSPAKAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIISGAGELHLEICLKDLQEDFMGGAEIIVSPPVVSFRETVLEKSCRTVMSKSPNKHNRLYMEARPLEEGLAEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 5253 - protein, 843 aa, Setaria italica
MVKFTAEELRAIMDKKNNIRNMSVIAHVDHGKSTLTDSLVAAAGIIAQEVAGDVRMTDTRADEAERGITIKSTGISLYYEMTDESLKSYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKNTGSATCKRGFVQFCYEPIKQIINTCMNDQKDKLWPMLQKLNVTMKSDEKELVGKALMKRVMQTWLPASTALLEMMIFHLPSPSKAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 5254 - protein, 843 aa, Panicum virgatum
MVKFTAEELRAIMDKKNNIRNMSVIAHVDHGKSTLTDSLVAAAGIIAQEVAGDVRMTDTRADEAERGITIKSTGISLYYEMTPESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLNVTMKADEKELVGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIISGAGELHLEICLKDLQEDFMGGAEIIVSPPVVSFRETVLEKSCRTVMSKSPNKHNRLYMEARPLEEGLAEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 5255 - protein, 843 aa, Oryza sativa
MVKFTVEELRRIMDKKNNIRNMSVIAHVDHGKSTLTDSLVAAAGIIAQEVAGDVRMTDTRADEAERGITIKSTGISLFYEMSDESLKLYKGERDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDTLLGDVQVYPEKGTVAFSAGLHGWAFTLSSFAKMYASKFGVDESKMMERLWGENFFDPATKKWTNKSTGSATCKRGFVQFCYEPIKQIINTCMNDQKDKLWPMLQKLGVVMKADEKDLMGKALMKRVMQTWLPASNALLEMMIYHLPSPSKAQKYRVENLYEGPLDDVYATAIRNCDPEGPLMLYVSKMIPASDKGRFFAFGRVFSGRVATGMKVRIMGPNYVPGQKKDLYVKSVQRTVIWMGKKQESVEDVPCGNTVAMVGLDQFITKNATLTNEKEADACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMTSDPLEVSSQANQLVLDIRKRKGLKEQMTPLSDFEDKL

SEQ ID NO: 5256 - protein, 843 aa, Cenchrus ciliaris
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKSTGSATCKRGFVQFCYEPIKQIINTCMNDQKDKLWPMLQKLNVTMKSDEKELVGKALMKRVMQTWLPASTALLEMMIFHLPSPAKAQRYRVENLYEGPLDDVYATAIRNCDPEGPLMLYVSKMIPASDKGRFFAFGRVFSGKVSTGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 5257 - protein, 747 aa, Pennisetum glaucum
MVKFTAEELRAIMDKKNNIRNMSVIAHVDHGKSTLTDSLVAAAGIIAQEVAGDVRMTDTRADEAERGITIKSTGISLYYEMTDESLKNYKGQRDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKSTGSATCKRGFVQFCYEPIKQIIKTCMNDQKDKLWPMLQKLNVTMKSDEKELIGKALMKRVMQTWLPASTALLEMMIFHLPSPATAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKRFGALDLRPLARTWLSICVRECSISMKSRILLWLASSGPRKRVRWLRRTCVAFALRSVMSSSMLMQFTGVVARSFQLPGGSFMLLSSLPSQGCSSQFTLWRSRPQKMHWVVSMVF

SEQ ID NO: 5258 - protein, 843 aa, Sorghum bicolor
MVKFTAEELRGIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSPTCKRGFVQFCYEPIKQIINTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDEGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 5259 - protein, 747 aa, Sorghum bicolor
MVKFTAEELRGIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSPTCKRGFVQFCYEPIKQIINTCMNDQKEKLWPMLQKLNVTMKSDEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPWRRVSLRPSMMAALAHVMILRCAPRSSLRSLGGTRISPRRFGVLDLRPLAQTWLLICVRECSISMKSRILSWLVSSGHQRRVHWLRRTCAEFALRSVMSFFMLMLSTGVVARSSQLPGGSSMLLSSRPSQGCWSQCTWWRFRPQKMHLVVSTVF

SEQ ID NO: 5260 - protein, 111 aa, Oryza sativa
MQTSRESNSSLLRVDLDITKECVFICCHNDIGILNDTGEGLIGLLTFNLKLKEAPVHLVHSKDRPNPLTKGLAKHSFSLHTDTLNTVNNHQSTISNTKSSSDLRRKINVPR

SEQ ID NO: 5261 - protein, 843 aa, Zea mays
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSPTCKRGFVQFCYEPIKQIIKTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAFLPVIESFGFSSQLRAATSGQAFPQCVFDHWDMMGSDPLEAGSQAAQLVLDIRKRKGLKEQMTPLSEFEDKL

SEQ ID NO: 5262 - protein, 843 aa, Zea mays
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKNTGSPTCKRGFVQFCYEPIKQIIKTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKETDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAFLPVIESFGFSSQLRAATSGQAFPQCVFDHWDMMGSDPLEAGSQAAQLVLDIRKRKGLKEQMTPLSEFEDKL

SEQ ID NO: 5263 - protein, 843 aa, Zea mays
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSPTCKRGFVQFCYEPIKQIIKTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKETDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQAVFDHWDMMGSDPLEAGSQAAQLVLDIRKRKGLKEQMIPLSEFEDKL

SEQ ID NO: 5264 - protein, 843 aa, Triticum aestivum
MVKFTVEGLRIIMDKQNNIRNMSVIAHVDHGKSTLTDSLVAAAGIIAQEVAGDVRMTDTRADEAERGITIKSTGISLFYEMTDESLRAYKGERDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDAKLGDVQVYPEKGTVAFSAGLHGWAFTLTNFAKMYASKFGVDETKMMERLWGENFFDTATKKWTNKNTGSPTCKRGFVQFCYDPIKQIINTCMNDQKDKLWPMLQKLGVTMKADEKELMGKPLMKRVMQTWLPASTALLEMMIFHLPSPSKAQKYRVENLYEGPLDDVYATAIRNCDPEGPLMLYVSKMIPASDKGRFFAFGRVFSGRIATGMKVRIMGPNYVPGQKKDLYVKSVQRTVIWMGKKQESVDDVPCGNTVAMVGLDQFITKNATLTNEKEVDACPIRAMKFSVSPVVRVAVQCKVASDLPKLVEGLKRLAKSDPMVVCSMEESGEHIIAGAGELHLEICLKDLQEDFMGGAEIIVSPPVVSFRETVLEKSCRTVMSKSPNKHNRLYMEARPMEEGLAEAIDDGRIGPRDDPKVRSKVLSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSGTLRAATSGQAFPQCVFDHWDMMSADPLEAGSQAAQLVLDIRKRKGLKEQMTPLSEFEDKL

SEQ ID NO: 5265 - protein, 843 aa, Zostera marina
MVKFTAEELRRIMDLKHNIRNMSVIAHVDHGKSTLTDSLVAAAGIIAQEVAGDVRMTDTRADEAERGITIKSTGISLYYEMTDASLKSFTGERVGNEYLINLIDSPGHVDFSSEVTAALRITDGALVVVDCIEGVCVQTETVLRQALGERIRPVLTVNKMDRCFLELQVDGEEAYQTFQRVIENANVIMATYEDVLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLKKLGVVMKSDEKDLMAKPLMKRVMQNWLPASTALLEMMIFHLPSPHTAQRYRVENLYEGPLDDIYANAIRNCDPNGPLMLYVSKMIPASDKGRFFAFGRVFSGKVSTGVKVRIMGPNYVPGQKKDLYVKSVQRTVIWMGKKQESVEDVPCGNTVALVGLDQFITKNATLTNEKEVDAHPIRAMKFSVSPVVRVAVQCKTASDLPKLVEGLKRLAKSDPMVMCMIEESGEHIIAGAGELHLEICLKDLQDDFMGGAEIVVSDPVVSFRETVMDKSSRTVMSKSPNKHNRLYMEARPLEDGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEGALGGIYGVLNQKRGHVFEEMQRPGTPLYNIKAYLPVVESFGFSSTLRAATSGQAFPQCVFDHWDIMSSDPLDPTSQSAILVKDIRKRKGLKEQMTPLSDFEDKL

SEQ ID NO: 5266 - protein, 843 aa, Quercus alba
MVKFTADELRRIMDYKHNIRNMSVIAHVDHGKSTLTDSLVAAAGIIAQEVAGDVRMTDTRADEAERGITIKSTGISLYYEMSTESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLTKLGVTMKSEEKDLMGKALMKRVMQTWLPASSALLEMMIFHLPSPSTAQRYRVENLYEGPLDDAYATAIRNCDPDGPLMLYVSKMIPASDKGRFFAFGRVFAGRVSTGLKVRIMGPNFVPGEKKDLYVKSVQRTVIWMGKKQETVEDVPCGNTVALVGLDQYITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSSRTVMSKSPNKHNRLYMEARPLEDGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSSTLRAATSGQAFPQCVFDHWDMMSSDPLEAGTQASQLVIDIRKRKGLKEQMTPLSEFEDKL

SEQ ID NO: 5267 - protein, 1616 aa, Malus domestica
MVKFTAEELRRIMDYKHNIRNMSVIAHVDHGKSTLTDSLVAAAGIIAQEVAGDVRMTDTRADEAERGITIKSTGISLYYEMTDESLQRFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPATKKWTSKNTGTATCKRGFVQFCYEPIKQIINTCMNDQKDKLWPMLTKLGVTMKSDEKDLMGKALMKRVMQTWLPASTALLEMMIFHLPSPSTAQRYRVENLYEGPLDDQYANAIRNCDPEGPLMLYVSKMIPASDKGRFFAFGRVFAGKVQTGLKVRIMGPNFVPGEKKDLYVKNVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLDKSCRTVMSKSPNKHNRLYMEARPLEEGLPEAIDEGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEGALGGIYSVLNQKRGHVFEEMQRPGTPLYNIKAYLPVKFTAEELRRIMDYKHNIRNMSVIAHVDHGKSTLTDSLVAAAGIIAQEVAGDVRMTDTRADEAERGITIKSTGISLYYEMTDESLQRYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKSTGTATCKRGFVQFCYEPIKQIINTCMNDQKDKLWPMLTKLGVTMKSDEKDLMGKALMKRVMQTWLPASTALLEMMIFHLPSPSTAQKYRVENLYEGPLDDQYANAIRNCDPDGPLMLYVSKMIPASDKGRFFAFGRVFAGRVQTGLKVRIMGPNFVPGEKKDLYVKNVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLDKSCRTVMSKSPNKHNRLYMEARPLEEGLPEAIDEGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEGALGGIYSVLNQKRGHVFEEMQRPGTPLYNIKAYLPVVESFGFSGQLRAATSGQAFPQCVFDHWEMMSSDPLEAGSQAATLVTDIRKRKGLKEQMTPLSEFEDKL

SEQ ID NO: 5268 - protein, 843 aa, Nicotiana benthamiana
MVKFTAEELRHIMDYKHNIRNMSVIAHVDHGKSTLTDSLVAAAGIIAQEVAGDVRMTDTRADEAERGITIKSTGISLYYQMTDESLKNFKGERNGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVDESKMMERLWGENFFDPATKKWTTKSTGSATCKRGFVQFCYEPIKQIINTCMNDQKDKLWPMLQKLGVTMKSEEKELMGKALMKRVMQTWLPASTALLEMMIFHLPSPSTAQKYRVENLYEGPLDDQYANAIRNCDPEGPLMLYVSKMIPASDKGRFFAFGRVFAGKVCTGMKVRIMGPNYVPGEKKDLYVKNVQRTVIWMGKKQETVEDVPCGNTVAMVGLDQFITKNATLTNEKEVEAHPIRAMKFSVSPVVRVAVQCKLASDLPKLVEGLKRLAKSDPMVLCSIEESGEHIIAGAGELHLEICLKDLQDDFMGGAEIIVSDPVVSFRETVLEKSSRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYGVLNQKRGHVFEEMQRPGTPLYNIKAYLPVIESFGFSGTLRAATSGQAFPQCVFDHWDMMSSDPLDAGTQAHQLVLDIRKRKGLKQTVTPLSEFEDKL

SEQ ID NO: 5269 - protein, 843 aa, Unknown
  Sequence found in Organisms: Citrus clementina, Citrus sinensis
MVKFTAEGLRRIMDFKHNIRNMSVIAHVDHGKSTLTDSLVAAAGIIAQEVAGDVRMTDTRADEAERGITIKSTGISLYYEMTDDALKSYKGERNGNEYLINLIDSPGHVDFSSEVTAALRITDGALVVVDCIEGVCVQTETVLRQALGERIRPVLTVNKMDRCFLELQVDGEEAYQTFSRVVENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVTMKSEEKDLMGKALMKRVMQTWLPASSALLEMMIFHLPSPSTAQKYRVENLYEGPLDDQYANAIRNCDPNGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLEKSCRTVMSKSPNKHNRLYMEARPLEEGLAEAIDDGRIGPRDDPKARSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYMVEIQAPEQALGGIYSVLNQKRGHVFEEMQRPGTPLYNIKAYLPVIESFGFSGTLRAATSGQAFPQCVFDHWDMMSSDPLEPGTQAAQLVADIRKRKGLKEQMTPLSEFEDKL

SEQ ID NO: 5270 - protein, 843 aa, Gossypium raimondii
MVKFTAEELRAIMDRKHNIRNMSVIAHVDHGKSTLTDSLVAAAGIIAQEVAGDVRMTDTRADEAERGITIKSTGISLYYEMSEDSLKSYKGERHGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVTMKSDEKDLMGKSLMKRVMQTWLPASNALLEMMIFHLPSPSKAQKYRVENLYEGPLDDIYANAIRNCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVLCTIEESGEHIVAGAGELHLEICLKDLQEDFMGGAEIIKSDPVVSFRETVLERSCRTVMSKSPNKHNRLYMEARPLEEGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAAAHVAEIRKRKGLKEQMTPLSEYEDKL

SEQ ID NO: 5271 - protein, 837 aa, Saccharum officinarum
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDEAKMMERLWGENFFDPATKKWTTKNTGSPTCKRGFVQFCYEPIKQIINTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDEGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEACSQAAQLVLDIRKRKGLKEQMTPSF

SEQ ID NO: 5272 - protein, 843 aa, Ricinus communis
MVKFTAEELRRIMDYKHNIRNMSVIAHVDHGKSTLTDSLVAAAGIIAQEVAGDVRMTDTRQDEAERGITIKSTGISLYYEMTDEALKSFKGERQGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDESKMMERLWGENFFDPATKKWTSKNTGSPTCKRGFVQFCYEPIKQIINTCMNDQKDKLWPMLQKLGVTMKSDEKELMGKALMKRVMQTWLPASSALLEMMIFHLPSPAKAQRYRVENLYEGPLDDPYATAIRNCDPEGPLMLYVSKMIPASDKGRFFAFGRVFAGKVSTGLKVRIMGPNYVPGEKKDLYVKSVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSCRVVMSKSPNKHNRLYMEARPMEEGLAEAIDEGRIGPRDDPKARAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEELQRPGTPLYNIKAYLPVIESFGFSGTLRAATSGQAFPQCVFDHWDMMSSDPMEPGSQAANLVTEIRKRKGLKEQMTPLSEFEDKL

SEQ ID NO: 5273 - protein, 843 aa, Aquilegia formosa
MVKFTAEELRRIMDLKHNIRNMSVIAHVDHGKSTLTDSLVAAAGIIAQEVAGDVRMTDTRADEAERGITIKSTGISLYYEMTDESLKSFKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPATKKWTSKNTGSSSCKRGFVQFCYEPIKQIINTCMNDQKDKLWPMLQKLGVTMKGEEKELLGKALMKRVMQTWLPASTALLEMMIFHLPSPSTAQRYRVENLYEGPLDDQYANAIRNCDPEGPLMLYVSKMIPASDKGRFFAFGRVFAGKVSTGMKVRIMGPNYVPGQKKDLYTKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICIKDLVDDFMGGAEIVQSPPVVSFRETVLEKSVRTVMSKSPNKHNRLYMEARPLEEGLAEAIDEGRIGPRDDPKFRSKILSEEFGWDKDLAKKIWCFGPETTGPNMVVDMCKGVQYLNEIKDSVVAGFQWASKEGALCEENMRGICFEVCDVVLHADAIHRGGGQVIPTARRVIYASQLTAKPRLLEPVYLVEIQAPEQALGGIYGVLNQKRGHVFEEMQRPGTPLYNIKAYLPVVESFGFSSQLRAATSGQAFPQCVFDHWDMMSSDPLESGSQASTLVTEIRKRKGLKEQMTPLSEFEDKL

SEQ ID NO: 5274 - protein, 843 aa, Gossypium hirsutum
MVKFTAEELRAIMDRKHNIRNMSVIAHVDHGKSTLTDSLVAAAGIIAQEVAGDVRMTDTRADEAERGITIKSTGISLYYEMSEDSLKSYKGERHGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVTMKSDEKDLMGKALMKRVMQTWLPASDALLEMMVFHLPSPSKAQKYRVENLYEGPLDDIYANAIRNCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVLCTIEESGEHIVAGAGELHLEICLKDLQEDFMGGAEIIKSDPVVSFRETVLERSCRTVMSKSPNKHNRLYMEARPLEEGLAEAIDDGRIGPRDDPKVRSKILAEEFGWDKDLAKKIWCFGPETTGPNMVVDMCKGVQYLNEIKDSVVAGFQWASKEGALAEENMRAICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAAAHVAEIRKRKGLKEQMTPLSEYEDKL

SEQ ID NO: 5275 - protein, 843 aa, Actinidia deliciosa
  misc_feature (454)..(454): Xaa can be any naturally occurring amino acid
MVKFTADELRRIMDLKHNIRNMSVIAHVDHGKSTLTDSLVAAAGIIAQEVAGDVRMTDTRADEAERGITIKSTGISLYYEMSDESLKNYTGERHGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVGESKMMERLWGENFFDPATKKWTSKNTGSATCKRGFVQFCYEPIKQIINTCMNDQKDKLWPMLQKLGVTMKSDEKDLMGKALMKRVMQTWLPASRALLEMMIFHLPSPAKAQRYRVENLYEGPLDDQYANAVRNCDPEGPLMLYVSKMIPASDKGRFFAFGRVFSGKVSTGLKVRIMGPNYVPGEKKDLYVKSVQRTVIWMGKRQETVEDVPCGNTVAXVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLEKSCRIVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYLVEIQAPEQALGGIYSVLNQKRGHVFEEMQRPGTPLYNIKAYLPVVESFGFSSTLRAATSGQAFPQCVFDHWDMMSSDPLEPGSQASTLVADIRKRKGLKEQMTPLSEFEDKL

SEQ ID NO: 5276 - protein, 843 aa, Actinidia deliciosa
MVKFTADELRRIMDYKHNIRNMSVIAHVDHGKSTLTDSLVAAAGIIAQEVAGDVRMTDTRADEAERGITIKSTGISLYYEMSDESLKSYKGERHGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTGKNTGSATCKRGFVQFCYEPIKQIINTCMNDQKDKLWPMLQKLGVAMKSEEKDLMGKALMKRVMQTWLPASNALLEMMIFHLPSPSKAQKYRVENLYEGPLDDQYANAIRNCDPEGPLMLYVSKMIPASDKGRFFAFGRVFSGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSSRTVMSKSPNKHNRLYMEARPMEEGLAEAIDDGRVGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAEPRLLEPVYLVEIQAPENALGGIYSVLNQKRGHVFEEMQRPGTPLYNIKAYLPVIESFGFSSTLRAATSGQAFPQCVFDHWEMMSSDPLESGSQAATLVTEIRKRKGLKEQMTPLSEFEDKL

SEQ ID NO: 5277 - protein, 456 aa, Sequoia sempervirens
MVKFTAEELRRIMDLKHNIRNMSVIAHVDHGKSTLTDSLVAAAGIIAQEVAGDVRMTDTRADEAERGITIKSTGISLYYEMTDESLKSYKGERMGNEYLINLIDSPGHVDFSSEVTAALRITDGALVVVDCIEGVCVQTETVLRQALGERIRPVLTVNKMDRCFLELQVEGEEAYQTFLRVIENANVIMATYEDPLLGDCQVYPEKGTVAFSAGLHGWAFTLTNFAKMYASKFKVDEVKMMERLWGENFFDPATKKWTSKNTGSPSCKRGFVQFIYEPIKQIINICMNDQKDKLWPMLQKLGVVMKSDEKELAGKALMKRVMQTWLPASSALLEMMIFHLPSPSKAQRYRVENLYEGPLDDIYATAIRNCDPEGPLMLYVSKMIPASDKGRFFAFGRVFAGKVSTGVKVRIMGPNYVPGQKKDLYVKSVQRTVIWMGKNKNQLRMCPVEIRWLWLG

SEQ ID NO: 5278 - protein, 843 aa, Vaccinium corymbosum
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPATKKWTTKNTGSATCKRGFVQFCYEPIKQIINTCMNDQKDKLWPMLQKLGVTMKSDEKELMGKALMKRVMQTWLPASSALLEMMIFHLPSPSTAQKYRVENLYEGPLDDQYANAIRNCDPEGPLMLYVSKMIPASDKGRFFAFGRVFAGKVSTGLKVRIMGPNYVPGEKKDLYVKSVQRTVIWMGKKQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLVDDFMGGAEIIKSDPVVSFRETVLEKSSRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWDMMMSDPLESGSQAAVLVSDIRKRKGLKEQMTPLSEYEDKL

SEQ ID NO: 5279 - protein, 843 aa, Theobroma cacao
MVKFTADELRRIMDYKHNIRNMSVIAHVDHGKSTLTDSLVAAAGIIAQEVAGDVRMTDTRQDEAERGITIKSTGISLYYEMTDESLKNYKGERQGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKNTGSPTCKRGFVQFCYEPIKQIINTCMNDQKDKLWPMLQKLGVTMKAEEKDLMGKALMKRVMQTWLPASNALLEMMIFHLPSPGKAQKYRVENLYEGPLDDMYANAIRNCDPDGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIIKSDPVVSFRETVLERSCRTVMSKSPNKHNRLYMEARPMEEGLAEAIDDGRIGPRDDPKVRSKILSEEYGWDKDLAKKIWCFGPETTGPNMVVDMCKGVQYLNEIKDSVVAGFQWASKEGALAEENMRGICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPIEPGTQAATLVADIRKRKGLKEQMTPLSEFEDKL

SEQ ID NO: 5280 - protein, 843 aa, Tripterygium wilfordii
MVKFTAEELRRIMDLKHNIRNMSVIAHVDHGKSTLTDSLVAAAGIIAQEVAGDVRMTDTRADEAERGITIKSTGISLYYEMSDVSLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENYFDPATKKWTSKNSGSPTCKRGFVQFCYEPIKQIINTCMNDQKDKLWPMLQKLGVTMKSDEKDLMGKALMKRVMQTWLPASSALLEMMIFHLPSPATAQKYRVENLYEGPMDDQYATAIRNCDPDGPLMLYVSKMIPASDKGRFFAFGRVFAGKVSTGVKVRIMGPNYVPGEKKDLYVKNVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVKSDPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSGNLRAATSGQAFPQCVFDHWDMMTSDPLDPTSQASTLVHDIRKRKGLKEQMTPLSEFEDKL

SEQ ID NO: 5281 - protein, 687 aa, Ricinus communis
MVKFTAEELRRIMDYKHNIRNMSVIAHVDHGKSTLTDSLVAAAGIIAQEVAGDVRMTDTRQDEAERGITIKSTGISLYYEMTDESLKNYKGERQGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDESKMMERLWGENFFDPATKKWTSKNSGSATCKRGFVQFCYEPIKQIINTCMNDQKDKLWPMLQKLGVTMKSEEKELMGKALMKRVMQTWLPASSALLEMMIFHLPSPAKAQRYRVENLYEGPLDDPYATAIRNCDAEGPLMLYVSKMIPASDKGRFFAFGRVFAGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSCRVVMSKSPNKHNRLYMEARPMEEGLAEAIDDGRIGPRDDPKVRAKILSEEFGWDKDLAKKIWCFGPETTGPNMVVDMCKGVQYLNEIKDSVVAGFQWASKEGALAERKHERYLL

SEQ ID NO: 5282 - protein, 843 aa, Prunus mume
MVKFTAEELRRIMDYKHNIRNMSVIAHVDHGKSTLTDSLVAAAGIIAQEVAGDVRMTDTRADEAERGITIKSTGISLYYEMTDEALKSYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPATKKWTSKNTGSATCKRGFVQFCYEPIKQIINTCMNDQKDKLWPMLTKLGVTMKSDEKELMGKGLMKRVMQTWLPASSALLEMMIFHLPSPSTAQRYRVENLYEGPLDDQYANAIRNCDPEGPLMLYVSKMIPASDKGRFFAFGRVFAGKVQTGLKVRIMGPNFVPGEKKDLYVKNVQRTVIWMGKKQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSSRTVMSKSPNKHNRLYMEARPLEEGLPEAIDDGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSGQLRASTSGQAFPQCVFDHWEMMSSDPLETGSQASQLVTDIRKRKGLKEQMTPLSEFEDKL

SEQ ID NO: 5283 - protein, 843 aa, Vaccinium corymbosum
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPATKKWTTKNSGSATCKRGFVQFCYEPIKQIINTCMNDQKDKLWPMLQKLGVTMKSDEKELMGKALMKRVMQTWLPASSALLEMMIFHLPSPSTAQKYRVENLYEGPLDDQYANAIRNCDPEGPLMLYVSKMIPASDKGRFFAFGRVFAGKVSTGVKVRIMGPNYVPGEKKDLYVKSVQRTVIWMGKKQETVEDVPCGNTVALVGLDQYITKNATLTNEKEVDAHPIRAMKFSVSPVVRVAVQCKVASDLPKLVEGLKRLAKSDPMVVCTIEESGEHIIAGAGELHLEICLKDLVDDFMGGAEIIKSDPVVSFRETVLEKSSRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYLVEIQAPEQALGGIYSVLNQKRGHVFEEMQRPGTPLYNIKAYLPVVESFGFSSTLRASTSGQAFPQCVFDHWDMMMSDPLESGSQAHGLVTDIRKRKGLKEQMTPLSEFEDKL

SEQ ID NO: 5284 - protein, 843 aa, Ricinus communis
MVKFTAEELRRIMDYKHNIRNMSVIAHVDHGKSTLTDSLVAAAGIIAQEVAGDVRMTDTRQDEAERGITIKSTGISLYYEMTDESLKNYKGERQGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDESKMMERLWGENFFDPATKKWTSKNSGSATCKRGFVQFCYEPIKQIINTCMNDQKDKLWPMLQKLGVTMKSEEKELMGKALMKRVMQTWLPASSALLEMMIFHLPSPAKAQRYRVENLYEGPLDDPYATAIRNCDAEGPLMLYVSKMIPASDKGRFFAFGRVFAGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSCRVVMSKSPNKHNRLYMEARPMEEGLAEAIDDGRIGPRDDPKVRAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSGTLRAATSGQAFPQCVFDHWDMMSSDPMEAGSQAAQLVTDIRKRKGLKEQMTPLSEFEDKL

SEQ ID NO: 5285 - protein, 843 aa, Unknown
  Sequence found in Organisms: Gossypium hirsutum, Gossypium raimondii
MVKFTAEELRAIMDRKHNIRNMSVIAHVDHGKSTLTDSLVAAAGIIAQEVAGDVRMTDTRADEAERGITIKSTGISLYYEMSDDSLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATRKWTTKNTGTATCKRGFVQFCYEPIKQIINTCMNDQKDKLWPMLQKLGVTMKSEEKDLMGKALMKRVMQTWLPASSALLEMMIFHLPSPSVAQKYRVENLYEGPLDDIYANAIRNCDPEGPLMLYVSKMIPASDKGRFFAFGRVFSGRVATGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIIKSDPVVSFRETVLERSCRTVMSKSPNKHNRLYMEARPLEEGLAEAIDEGRIGPRDDPKVRSKILAEEYGWDKDLAKKIWCFGPETTGPNMVVDMCKGVQYLNEIKDSVVAGFQWASKEGAMAEENMRGICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAAAHVAEIRKRKGLKEQMTPLSEYEDKL

SEQ ID NO: 5286 - protein, 843 aa, Gossypium hirsutum
MVKFTAEELRAIMDRKHNIRNMSVIAHVDHGKSTLTDSLVAAAGIIAQEVAGDVRMTDTRADEAERGITIKSTGISLYYEMSDDSLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTTKNTGSGTCKRGFVQFCYEPIKQIINTCMNDQKDKLWPMLQKLGVTMKSDEKDLMGKSLMKRVMQTWLPASSALLEMMIFHLPSPSKAQKYRVENLYEGPLDDIYANAIRNCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIVKSDPVVSFRETVLERSCRTVMSKSPNKHNRLYMEARPLEEGLAEAIDEGRIGPRDDPKVRSKILAEEYGWDKDLAKKIWCFGPETTGPNMVVDMCKGVQYLNEIKDSVVAGFQWASKEGAMAEENMRGICFEVCDVVLHTDAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAATHVAEIRKRKGLKEQMTPLSDYEDKL

SEQ ID NO: 5287 - protein, 843 aa, Tripterygium wilfordii
MVKFTAEELRRIMDLKHNIRNMSVIAHVDHGKSTLTDSLVAAAGIIAQEVAGDVRMTDTRADEAERGITIKSTGISLYYEMSDAALKSYKGERSGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENYFDPATKKWTSKNSGSPTCKRGFVQFCYEPIKQIINTCMNDQKDKLWPMLQKLGVTMKSDEKDLMGKALMKRVMQTWLPASSALLEMMIFHLPSPATAQKYRVENLYEGPMDDQYATAIRNCDPDGPLMLYVSKMIPASDKGRFFAFGRVFSGKVSTGVKVRIMGPNYVPGEKKDLYVKNVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVKSDPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSGNLRAATSGQAFPQCVFDHWDMMTSDPLDPTSQAATLVHDIRKRKGLKEQMTPLSEFEDKL

SEQ ID NO: 5288 - protein, 843 aa, Chelidonium majus
MVKFTAEELRRIMDLKHNIRNMSVIAHVDHGKSTLTDSLVAAAGIIAQEVAGDVRMTDTRADEAERGITIKSTGISLYYEMTDASLKAFKGERSGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFADMYASKFGVDTSKMMERLWGENFFDPATKKWTSKNTGSPTCKRGFVQFCYEPIKQIINTCMNDQKDKLWPMLQKLNVTMKSEEKDLMGKALMKRVMQTWLPASTALLEMMIFHLPSPHTAQRYRVENLYEGPLDDMYANAIRNCDPEGPLMLYVSKMIPASDKGRFFAFGRVFAGKVSTGLKVRIMGPNYVPGQKKDLYTKSVQRTVIWMGKKQESVEDVPCGNTVALVGLDQYITKNATLTNEKEVDAHPIKAMKFSVSPVVRVAVQCKVASDLPKLVEGLKRLAKSDPMVVCSIEESGEHIIAGAGELHLEICLKDLQDDFMGGAEIVKSDPVVSFRETVLEKSSRTVMSKSPNKHNRLYMEARPLEEGLPEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYGVLNQKRGHVFEEMQRQGTPLYNIKAYLPVIESFGFSGQLRAATSGQAFPQCVFDHWDMMSADPLESGSQAAQLVMDIRKRKGLKEQMTPLSEFEDKL

SEQ ID NO: 5289 - protein, 843 aa, Castanea mollissima
MVKFTADELRRIMDYKHNIRNMSVIAHVDHGKSTLTDSLVAAAGIIAQEVAGDVRMTDTRADEAERGITIKSTGISLYYEMSTESLKSYKGERNGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLTKLGVTMKSEEKDLMGKPLMKRVMQTWLPASSALLEMMIFHLPSPSTAQKYRVENLYEGPLDDAYANAIRNCDPDGPLMLYVSKMIPASDKGRFFAFGRVFAGRVSTGLKVRIMGPNYVPGEKKDLYVKSVQRTVIWMGKKQETVEDVPCGNTVALVGLDQYITKNATLTNEKETDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSSRIVMSKSPNKHNRLYMEARPMEDGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYMVEIQAPEQALGGIYSVLNQKRGHVFEEMQRPGTPLYNIKAYLPVIESFGFSSTLRAATSGQAFPQCVFDHWDMMSSDPLESGSQASQLVLDIRKRKGLKEQMTPLSEFEDKL

SEQ ID NO: 5290 - protein, 843 aa, Gossypium hirsutum
MVKFTAEELRAIMDRKHNIRNMSVIAHVDHGKSTLTDSLVAAAGIIAQEVAGDVRMTDTRADEAERGITIKSTGISLYYEMSDDSLMSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTTKNTGSGTCKRGFVQFCYEPIKQIINTCMNDQKDKLWPMLQKLGVTMKSDEKDLMGKSLMKRVMQTWLPASSALLEMMIFHLPSPSKAQKYRVENLYEGPLDDVYANAIRNCDPEGPLMLYVSKMIPASDKGRFYAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIIKSDPVVSFRETVLERSCRTVMSKSPNKHNRLYMEARPLEEGLAEAIDEGRIGPRDDPKVRSKILAEEYGWDKDLAKKIWCFGPETTGPNMVVDMCKGVQYLNEIKDSVVAGFQWASKEGAMAEENMRGICFEVCDVVLHTDAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAATHVAEIRKRKGLKEQMTPLSDYEDKL

SEQ ID NO: 5291 - protein, 843 aa, Cucumis sativus
MVKFTAEELRRIMDYKHNIRNMSVIAHVDHGKSTLTDSLVAAAGIIAQEVAGDVRMTDTRQDEAERGITIKSTGISLYYEMSDESLKSYKGERHGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTSKNTGTATCKRGFVQFCYEPIKQIIATCMNDRKDKLWPMLQKLGVVMKSDEKDLMGKPLMKRVMQTWLPASTALLEMMIFHLPSPAKAQKYRVENLYEGPQDDVYASAIRNCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVLERSCRTVMSKSPNKHNRLYMEARPMEDGLAEAIDDGRIGPRDDPKVRSKILSEEFAWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWEMMSSDPLESGSQAAQLVADIRKRKGLKEQMTPLSDFEDKL

SEQ ID NO: 5292 - protein, 843 aa, Eucalyptus grandis
MVKFTADELRRIMDYKHNIRNMSVIAHVDHGKSTLTDSLVAAAGIIAQEVAGDVRMTDTRADEAERGITIKSTGISLYYEMSDASLKSYTGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSPTCKRGFVQFCYEPIKQIISTCMNDQKDKLWPMLQKLGVTMKSDEKDLMGKALMKRVMQTWLPASTALLEMMIFHLPSPSKAQRYRVENLYEGPLDDQYATAIRNCDPEGPLMLYVSKMIPASDKGRFFAFGRVFAGKVSTGLKVRIMGPNYVPGEKKDLYVKSVQRTVIWMGKRQETVEDVPCGNTVAMVGLDQYITKNATLTNEKEVDAHPIRAMKFSVSPVVRVAVQCKVASDLPKLVEGLKRLAKSDPMVVCSIEESGEHIIAGAGELHLEICLKDLVDDFMGGAEIVKSDPVVSFRETVLEKSIRTVMSKSPNKHNRLYMEARPLEEGLAEAIDDGRIGPRDDPKARSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWDMMMSDPLESGSQAAQLVTDIRKRKGLKEQMTPLSEFEDKL

SEQ ID NO: 5293 - protein, 843 aa, Pinus pinaster
MVKFTAEELRKIMDRKHNIRNMSVIAHVDHGKSTLTDSLVAAAGIIAQEVAGDVRMTDTRADEAERGITIKSTGISLYYVMEDSAVKNFKGDREGHEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDEAKMMERLWGENFFDPATKKWTTKNTGSATCKRGFVQFIYEPIKQIINICMNDQKDKLWPMLQKLGVVMKSDEKELVAKALMKRVMQTWLPASSALLEMMIFHLPSPAKAQRYRVENLYEGPLDDVYATAIRNCDPEGPLMLYVSKMIPASDKGRFFAFGRVFAGRVATGMKVRIMGPNYVPGQKKDLYTKSVQRTVIWMGKRQESVEDVPCGNTVALVGLDQFITKNATLTNEKEADAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSCRTVMSKSPNKHNRLYFEARPLEEGLAEAIDDGRIGPKDDPKARAKILSEEFGWDKDLAKKIWCFGPETTGPNMVVDMCKGVQYLNEIKDSVVAAFQWASKEGALAEENMRGICFEVCDVVLHTDAIHRGGGQVIPTARRVMYASQLTAKPRLLEPVYLVEIQAPENALGGIYGVLNQKRGHVFEEMQRPGTPLYNIKAYLPVVESFGFSSTLRAATSGQAFPQCVFDHWDMMGSDPLEPGSQAGQLVTDIRKRKGLKESMTPLSEFEDKL

SEQ ID NO: 5294 - protein, 616 aa, Fagus grandifolia
MYASKFGVDESKMMERLWGENFFDPATKKWTTKNSGSPTCKRGFVQFCYEPIKQIINTCMNDQKDKLWPMLTKLGVTMKSDEKDLMGKALMKRVMQTWLPASTALLEMMIFHLPSPSTAQRYRVENLYEGPLDDAYANAIRNCDPEGPLMLYVSKMIPASDKGRFFAFGRVFAGKVTTGLKVRIMGPNYVPGEKKDLYVKSVQRTVIWMGKKQETVEDVPCGNTVALVGLDQYITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSCRTVMSKSPNKHNRLYMEARPMEEGLAEAIDDGRIGPRDDPKARSKILSEEFGWDKDLAKKIWCFGPDTTGPNMVVDMCKGVQYLNEIKDSVVAGFQWASKEGALAEENMRGICFEVCDVVLHSDAIHRGGGQVIPTARRVIYASQITAKPRLLEPVYLVEIQAPEQALGGIYSVLNQKRGHVFEEIQRPGTPLYNIKAYLPVVESFGFSGTLRAATSGQAFPQCVFDHWDTMSSDPLEAGSQAALLVTDIRKRKGLKEQMTPLSDFEDKL

SEQ ID NO: 5295 - protein, 843 aa, Musa acuminata
MVKFTAEELRKIMDLKHNIRNMSVIAHVDHGKSTLTDSLVAAAGIIAQEVAGDVRMTDTRQDEAERGITIKSTGISLYYEMTDESLKNYKGERVGNEYLINLIDSPGHVDFSSEVTAALRITDGALVVVDCVEGVCVQTETVLRQALGERIRPVLTVNKMDRCFLELQVDGEEAYQTFQRVIENANVIMATYEDVLLGDVQVYPEKGTVAFSAGLHGWAFTLTNFAKMYAAKFGVDEAKMMERLWGENYFDPATKKWTTKSTGSPTCKRGFVQFCYEPIRQIISTCMNDQKDKLWPMLQKLGVTMKSDEKDLIGKALMKRVMQTWLPASSALLEMMIFHLPSPAKAQRYRVENLYEGPLDDIYANAIRNCDPEGPLMLYVSKMIPASDKGRFFAFGRVFSGKVSTGLKVRIMGPNYVPGQKKDLYVKSVQRTVIWMGKKQESVEDVPCGNTVAMVGLDQFITKNATLTNEKETDAHPIRAMKFSVSPVVRVAVQCKVASDLPKLVEGLKRLAKSDPMVVCTIEESGEHIVAGAGELHLEICLKDLQEDFMGGAEIIVSDPVVSFRETVLEKSCRTVMSKSPNKHNRLYMEARPMEEGLAEAIDDGRIGPRDDPKARSKILSEEFGWDKDLAKKIWCFGPETTGPNMVVDMCKGVQYLNEIKDSVVAGFQWASKEGAVAEENMRAICFEVCDVVLHADAIHRGGGQIIPTARRAIYAAQLTAKPRLLEPVYLVEIQAPEQALGGIYGVLNQKRGHVFEEMQRPGTPLYNIKAYLPVIESFGFSSTLRAATSGQAFPQCVFDHWDMMSSDPLEPGSQAGQLVSDIRKRKGLKEQMTPLSEFEDKL

SEQ ID NO: 5296 - protein, 843 aa, Gossypium hirsutum
MVKFTAEELRAIMDRKHNIRNMSVIAHVDHGKSTLTDSLVAAAGIIAQEVAGDVRMTDTRADEAERGITIKSTGISLYYEMSDDSLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATRKWTTKNTGTATCKRGFVQFCYEPIKQIINTCMNDQKDKLWPMLQKLGVTMKSEEKDLMGKALMKRVMQTWLPASSALLEMMIFHLPSPSVAQKYRVENLYEGPLDDVYANAIRNCDPEGPLMLYVSKMIPASDKGRFFAFGRVFSGRVATGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIVKSDPVVSFRETVLERSCRTVMSKSPNKHNRLYMEARPLEEGLAEAIDEGRIGPRDDPKVRSKILAEEYGWDKDLAKKIWCFGPETTGPNMVVDMCKGVQYLNEIKDSVVAGFQWASKEGAIAEENMRGICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAAGHVAEIRKRKGLKEQMTPLSEYEDKL

SEQ ID NO: 5297 - protein, 843 aa, Medicago truncatula
MVKFTADELRRIMDYKHNIRNMSVIAHVDHGKSTLTDSLVAAAGIIAQEVAGDVRMTDTRADEAERGITIKSTGISLYYEMTDDSLKRFKGERNGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQVINTCMNDQKDKLWPMLTKLGVTMKSEEKDLMGKPLMKRVMQTWLPASTALLEMMIFHLPSPSTAQRYRVENLYEGPLDDQYANAIRNCDPEGPLMLYVSKMIPASDKGRFFAFGRVFAGKVSTGLKVRIMGPNFVPGEKKDLYVKSVQRTVIWMGKRQETVEDVPCGNTVALVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPLEDGLAEAIDDGKIGPRDDPKNRSKILSEEYGWDKDLAKKIWCFGPETTGPNMVVDMCKGVQYLNEIKDSVVAGFQWASKEGALSEENMRAICFEVCDVVLHTDAIHRGGGQIIPTARRVFYASQLTAKPRLLEPVYMVEIQAPEQALGGIYSVLNQKRGHVFEEMQRPGTPLYNIKAYLPVIESFGFSSQLRAATSGQAFPQCVFDHWDMMSSDPLEAGSQAATLVTDIRKRKGLKEQMTPLSEFEDKL

SEQ ID NO: 5298 - protein, 843 aa, Cucumis melo
MVKFTAEELRRIMDYKHNIRNMSVIAHVDHGKSTLTDSLVAAAGIIAQEVAGDVRMTDTRQDEAERGITIKSTGISLYYEMSDESLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTSKNTGSPTCKRGFVQFCYEPIKQIIATCMNDQKDKLWPMLQKLGVVMKSDEKDLMGKPLMKRVMQTWLPASTALLEMMIFHLPSPAKAQKYRVENLYEGPLDDAYASAIRNCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQEDFMGGAEIIKSDPVVSFRETVLERSCRTVMSKSPNKHNRLYMEARPMEDGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWEMMSSDPLESGSQAAQLVADIRKRKGLKEQMTPLSEFEDKL

SEQ ID NO: 5299 - protein, 843 aa, Elaeis guineensis
MVKFTVEELRRIMDMKHNIRNMSVIAHVDHGKSTLTDSLVAAAGIIAQEVAGDVRMTDTRQDEAERGITIKSTGISLYYEMSDESLKNYKGERNGNEYLINLIDSPGHVDFSSEVTAALRITDGALVVVDCVEGVCVQTETVLRQALGERIRPVLTVNKMDRCFLELQVEGEEAYQTFLRVIENANVIMATYEDPLLGDVQVYPEKGTVAFSAGLHGWAFTLTNFAKMYATKFGVDEAKMMERLWGENYFDPTTKKWTSKHTGSPTCKRGFVQFCYEPIKQIISTCMNDQKDKLWPMLQKLGVTMKSDEKELVGKALMKRVMQTWLPASNALLEMMIFHLPSPSKAQKYRVENLYEGPLDDIYATAIRNCDPEGPLMLYVSKMIPASDKGRFFAFGRVFSGRVATGMKVRIMGPNYVPGQKKDLYVKSVQRTVIWMGKKQESVEDVPCGNTVAMVGLDQYITKNATLTNEKEVDAHPIRAMKFSVSPVVRVAVQCKVASDLPKLVEGLKRLAKSDPMVVCAIEESGEHIVAGAGELHLEICLKDLQEDFMGGAEIVVSDPVVSFRETVLEKSCRTVMSKSPNKHNRLYMEARPMEDGLAEAIDEGRIGPRDDPKVRAKILSEEFGWDKDLAKKIWCFGPETTGPNMVVDMCKGVQYLNEIKDSVVAGFQWASKEGALAEENMRAICFEVCDVVLHADAIHRGGGQVIPTARRVIYASQLTAKPRLLEPVYLVEIQAPEQALGGIYGVLNQKRGHVFEELQRPGTPLYNIKAYLPVIESFGFSSTLRAATSGQAFPQCVFDHWDMMSSDPLEPGTQAAQLVSDIRKRKGLKEQMTPLSEYEDKL

SEQ ID NO: 5300 - protein, 843 aa, Citrullus lanatus
MVKFTAEELRRIMDFKHNIRNMSVIAHVDHGKSTLTDSLVAAAGIIAQEVAGDVRMTDTRQDEAERGITIKSTGISLYYEMSDESLKSYKGERQGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKNTGSPTCKRGFVQFCYEPIKQIIATCMNDQKDKLWPMLQKLGVVMKSEEKDLMSKALMKRVMQTWLPASNALLEMMIFHLPSPATAQKYRVENLYEGPLDDAYASAIRSCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVLERSCRTVMSKSPNKHNRLYMEARPMEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAAQLVADIRKRKGLKEQMTPLSEFEDKL

SEQ ID NO: 5301 - protein, 406 aa, Sequoia sempervirens
MVKFTAEELRRIMDLKHNIRNMSVIAHVDHGKSTLTDSLVAAAGIIAQEVAGDVRMTDTRADEAERGITIKSTGISLYYEMTDESLKSFKGERMGNEYLINLIDSPGHVDFSSEVTAALRITDGALVVVDCIEGVCVQTETVLRQALGERIRPVLTVNKMDRCFLELQVEGEEAYQTFLRVIENANVIMATYEDPLLGDCQVYPEKGTVAFSAGLHGWAFTLTNFAKMYASKFKVDEVKMMERLWGENFFDPATKKWTSKNTGSPTCKRGFVQFIYEPIKQIINICMNDQKDKLWPMLQKLGVVMKSEEKELAGKALMKRVMQTWLPASSALLEMMIFHLPSPSKAQRYRVENLYEGPLDDIYATAIRNCDPEGPLMLYVSKMIPASDKGRFFAFGGFLQGRYLQE

SEQ ID NO: 5302 - protein, 843 aa, Coffea canephora
MVKFTAEELRRIMDYKHNIRNMSVIAHVDHGKSTLTDSLVAAAGIIAQEVAGDVRMTDTRADEAERGITIKSTGISLYYEMTDEALKAYKGERQGNEYLINLIDSPGHVDFSSEVTAALRITDGALVVVDCIEGVCVQTETVLRQALGERIRPVLTVNKMDRCFLELQVEGEEAYQTFQKVIENANVIMATYEDPLLGDVQVYPEKGTVAFSAGLHGWAFTLSNFAKMYASKFGVDESKMMERLWGENFFDPATKKWTSKNTGSPTCKRGFVQFCYEPIKQIISTCMNDQKDKLWPMLSKLGVTMKSDEKELMGKALMKRVMQTWLPASSALLEMMIYHLPSPAKAQKYRVENLYEGPLDDQYANAVRNCDPEGPLMVYVSKMIPASDKGRFFAFGRVFSGKIATGMKVRIMGPNYVPGEKKDLYVKNVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSCRTVMSKSPNKHNRLYMEARPLEEGLAEAIDDGRIGPRDDPKNRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYAAQLTAKPRLLEPVYLVEIQAPEQALGGIYSVLNQKRGHVFEEMQRPGTPLYNIKAYLPVVESFGFSGTLRAATSGQAFPQCVFDHWDMMSSDPLESGSQAAQLVTDIRKRKGLKDQITPLSEFEDKL

SEQ ID NO: 5303 - protein, 843 aa, Gossypium raimondii
MVKFTAEELRAIMDRKHNIRNMSVIAHVDHGKSTLTDSLVAAAGIIAQEVAGDVRMTDTRADEAERGITIKSTGISLYYEMSDDSLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTTKNTGSGTCKRGFVQFCYEPIKQIINTCMNDQKDKLWPMLQKLGVTMKSDEKDLMGKSLMKRVMQTWLPASSALLEMMIFHLPSPSKAQKYRVENLYEGPLDDVYANAIRNCDPEGPLMLYVSKMIPASDKGRFYAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIVKSDPVVSFRETVLERSCRTVMSKSPNKHNRLYMEARPLEEGLAEAIDEGRIGPRDDPKVRSKILAEEYGWDKDLAKKIWCFGPETTGPNMVVDMCKGVQYLNEIKDSVVAGFQWASKEGAMAEENMRGICFEVCDVVLHTDAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAANHVAEIRKRKGLKEQMTPLSDYEDKL

SEQ ID NO: 5304 - protein, 843 aa, Capsicum annuum
MVKFTAEELRKIMDFKHNIRNMSVIAHVDHGKSTLTDSLVAAAGIIAQEVAGDVRMTDTRADEAERGITIKSTGISLYYEMSDDSLKNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGTASCKRGFVQFCYEPIKQIINTCMNDQKDKLWPMLQKLGVTMKSDEKDLMGKALMKRVMQTWLPASTALLEMMIYHLPSPSTAQKYRVENLYEGPLDDAYANAIRNCDPEGPLMLYVSKMIPASDKGRFFAFGRVFAGKVSTGMKVRIMGPNYVPGEKKDLYVKNIQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSCRTVMSKSPNKHNRLYMEARPMEEGLAEAIDEGRIGPRDDPKVRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSGTLRAATSGQAFPQCVFDHWDMMSSDPLEAGTQAHQLVLDIRKRKGLKEQMTPLSEFEDKL

SEQ ID NO: 5305 - protein, 843 aa, Lippia dulcis
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKNTGSATCKRGFVQFCYEPIKQIINTCMNDQKDKLWPMLQKLGVTMKSDEKELMGKALMKRVMQTWLPASTALLEMMIFHLPSPSRAQKYRVENLYEGPLDDAYANAIRNCDPEGPLMLYVSKMIPAPDKGRFFAFGRVFSGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIVAGAGELHLEICLKDLQDDFMGGAEIIKSDPVVSFRETVLERSCRTVMSKSPNKHNRLYMEARPMEEGLAEAIDDGRIGPRDDPKVRSKILSEEFGWDKELAKKIWAFGPETTGPNMVVDMCKGVQYLNEIKDSVVAGFQWASKEGPLAEENMRGICFEVCDVVLHADAIHRGGGQVIPTARRVIYASQITAKPRLLEPVYLVEIQAPEQALGGIYSVLNQKRGHVFEEMQRPGTPLYNIKAYLPVIESFGFSSTLRASTSGQAFPQCVFDHWDMMSSDPLEAGSQAATLVADIRKRKGLKEQMTPLSDFEDRL

SEQ ID NO: 5306 - protein, 843 aa, Plantago ovata
MVKFTADELRRIMDMKHNIRNMSVIAHVDHGKSTLTDSLVAAAGIIAQEVAGDVRMTDTRADEAERGITIKSTGISLYYQMSDESLKNFHGERVGNEYLINLIDSPGHVDFSSEVTAALRITDGALVVVDCIEGVCVQTETVLRQALGERIRPVLTVNKMDRCFLELQVEGEEAYQTFCRVIENANVIMATYEDPLLGDCQVYPEKGTVAFSAGLHGWAFTLTNFAKMYASKFGVDESKMMERLWGENFFDPKTKKWTTKNTGSPTCKRGFVQFCYEPIKQIIATCMNDQKDKLWPMLQKLGVTMKSDEKDLMAKPLMKRVMQTWLPASTALLEMMIEHLPSPAKAQRYRVENLYEGPLDDQYANAIRNCDPDGPLMLYVSKMIPASDKGRFFAFGRVFAGKVSTGLKVRIMGPNYVPGEKKDLYTKSVQRTVIWMGKKQETVEDVPCGNTVAMVGLDQYITKNATLTNEKEVDAHPIRAMKFSVSPVVRVAVQCKTASDLPKLVEGLKRLAKSDPMVLCTMEESGEHIVAGAGELHLEICLKDLQDDFMGGAEIIVSDPVVSFRETVLERSCRTVMSKSPNKHNRLYMEARPLEDGLAEAIDDGRIGPRDDPKIRSKILSEEFGWDKELAKKIWAFGPETTGPNMVVDMCKGVQYLNEIKDSVVAGFQWASKEGSLAEENMRGICFEVCDVVLHTDAIHRGGGQVIPTARRVIYASQITAKPRLLEPVYMVEIQAPEQALGGIYSVLNQKRGHVFEELQRPGTPLYNIKAYLPVVESFGFSSALRAATSGQAFPQSVFDHWDMMASDPLEPGTQAANLVADIRKRKGLKEQMTPLSDFEDKL

SEQ ID NO: 5307 - protein, 843 aa, Populus trichocarpa
MVKFTAEELRRIMDFKHNIRNMSVIAHVDHGKSTLTDSLVAAAGIIAQEVAGDVRMTDTRADEAERGITIKSTGISLYYEMSDESLKRYKGERHGNEYLINLIDSPGHVDFSSEVTAALRITDGALVVVDCIEGVCVQTETVLRQALGERIRPVLTVNKMDRCFLELQVDGEEAFQTFSRVIENANVIMATYEDPLLGDCQVYPEKGTVAFSAGLHGWAFTLTNFAQMYASKFGVDESKMMERLWGENFFDPATKKWTTKNTGSATCKRGFVQFCYEPIKQIIKTCMNDQKDKLWPMLQKLGVVMKSDEKDLMGKPLMKRVMQTWLPASTALLEMMIFHLPSPATAQRYRVENLYEGPLDDAYANAIRNCDPNGPLMLYVSKMIPASDKGRFFAFGRVFAGKVTTGLKVRIMGPNYVPGEKKDLYVKSVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVIDKSCRVVMSKSPNKHNRLYMEARPMEEGLAEAIDDGRIGPRDDPKIRGKILSEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYMVEIQAPEQALGGIYSVLNQKRGHVFEEIQRPGTPLYNIKAYLPVVESFGFSGTLRAATSGQAFPQCVFDHWDTMSSDPMEAGTQAAQLVTEIRKRKGLKEQMTPLSDFEDKL

SEQ ID NO: 5308 - protein, 843 aa, Populus trichocarpa
MVKFTAEELRRIMDFKHNIRNMSVIAHVDHGKSTLTDSLVAAAGIIAQEVAGDVRMTDTRADEAERGITIKSTGISLYYEMSDESLKRYKGERQGNEYLINLIDSPGHVDFSSEVTAALRITDGALVVVDCIEGVCVQTETVLRQALGERIRPVLTVNKMDRCFLELQVDGEEAFQTFSRVIENANVIMATYEDPLLGDCQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVVMKSDEKDLMGKPLMKRVMQTWLPASTALLEMMIFHLPSPATAQRYRVENLYEGPLDDAYANAIRNCDPNGPLMLYVSKMIPASDKGRFFAFGRVFAGKVTTGLKVRIMGPNYVPGEKKDLYVKSVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVIEKSSRVVMSKSPNKHNRLYMEARPMEEGLAEAIDDGRIGPRDDPKIRGKILSEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYMVEIQAPEQALGGIYSVLNQKRGHVFEELQRPGTPLYNIKAYLPVVESFGFSGTLRAATSGQAFPQCVFDHWDTMSSDPMEAGTQAAQLVTEIRKRKGLKEQMTPLSEFEDKL

SEQ ID NO: 5309 - protein, 843 aa, Prunus persica
MVKFTAEELRRIMDYKHNIRNMSVIAHVDHGKSTLTDSLVAAAGIIAQEVAGDVRMTDTRADEAERGITIKSTGISLYYEMTDEALKSYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPATKKWTSKNTGSATCKRGFVQFCYEPIKQIINTCMNDQKEKLWPMLTKLGVTMKSDEKELMGKGLMKRVMQTWLPASSALLEMMIFHLPSPSTAQRYRVENLYEGPLDDQYANAIRNCDPEGPLMLYVSKMIPASDKGRFFAFGRVFAGKVQTGLKVRIMGPNYVPGEKKDLYVKNVQRTVIWMGKKQETVEDVPCGNTVALVGLDQFITKNATLTNEKEADAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSSRTVMSKSPNKHNRLYMEARPLEEGLPEAIDDGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSGQLRASTSGQAFPQCVFDHWEMMSSDPLEAGSQASQLVTDIRKRKGLKEQMTPLSEFEDKL

SEQ ID NO: 5310 - protein, 843 aa, Glycine max
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENFFDPATKKWTSKNSGSATCKRGFVQFCYEPIKQIINTCMNDQKDKLWPMLQKLGVTMKSEEKDLMGKALMKRVMQTWLPASSALLEMMIFHLPSPSTAQKYRVENLYEGPLDDQYASAIRNCDPEGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPLEEGLAEAIDDGKIGPRDDPKVRSKILSEEFGWDKDLAKKIWCFGPETLGPNMVVDMCKGVQYLNEIKDSVVAGFQWASKEGALAEENMRAICFEVCDVVLHADAIHRGGGQIIPTARRVFYASQITAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQAAQLVTDIRKRKGLKEQMTPLSEFEDKL

SEQ ID NO: 5311 - protein, 843 aa, Picea glauca
MVKFTAEELRKIMDRKHNIRNMSVIAHVDHGKSTLTDSLVAAAGIIAQEVAGDVRMTDTRADEAERGITIKSTGISLYYEMEDEAVKNFKGDRVGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDEVKMMERLWGENFFDPATKKWTTKNTGSATCKRGFVQFIYEPIKQIINICMNDQKDKLWPMLQKLGVVMKSEEKELVAKALMKRVMQTWLPASSALLEMMIFHLPSPSKAQRYRVENLYEGPLDDVYATAIRNCDPEGPLMLYVSKMIPASDKGRFFAFGRVFSGRVATGMKVRIMGPNYIPGQKKDLYTKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSCRTVMSKSPNKHNRLYFEARPLEEGLAEAIDDGRIGPKDDPKARAKILSEEFGWDKDLAKKIWCFGPETTGPNLVVDMCKGVQYLNEIKDSVVAAFQWASKEGALAEENMRGICFEVCDVVLHTDAIHRGGGQIIPTARRVMYASQLTAKPRLLEPVYLVEIQAPENALGGIYGVLNQKRGHVFEEMQRQGTPLYNIKAYLPVVESFGFSSTLRAATSGQAFPQCVFDHWDMMGSDPLETGSQAGQLVTDIRKRKGLKESMTPLSDFEDKL

SEQ ID NO: 5312 - protein, 843 aa, Citrullus lanatus
MVKFTVEELRRIMDFKHNIRNMSVIAHVDHGKSTLTDSLVAAAGIIAQEVAGDVRMTDTRQDEAERGITIKSTGISLYYEMSDESLKNYKGERQGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDEAKMMERLWGENFFDPATKKWTTKNTGSATCKRGFVQFCYEPIKQIIATCMHDQKDKLWPMLQKLGVVMKSEEKDLMGKALMKRVMQTWLPASNALLEMMIFHLPSPATAQKYRVENLYEGPLDDVYASAIRSCDPEGPLMLYVSKMIPASDKGRFFAFGRVFSGRVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQEDFMGGAEIIKSDPVVSFRETVLERSCRTVMSKSPNKHNRLYMEARPMEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLESGSQAAQLVADIRKRKGLKEQMTPLSEFEDKL

SEQ ID NO: 5313 - protein, 72 aa, Ricinus communis
MGINFLLIGQSCILSNKLIQTNHGHSVTTRNILNSFLPFPHPNNSSLNTLNIQIFLFTRDIIWTHDPHLQTS

SEQ ID NO: 5314 - protein, 256 aa, Euonymus alatus
MVKFTADELRRIMDLKHNIRNMSVIAHVDHGKSTLTDSLVAAAGIIAQEVAGDVRMTDTRADEAERGITIKSTGISLYYEMSDESLKSYKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENYFDPATKK

SEQ ID NO: 5315 - protein, 843 aa, Phaseolus vulgaris
MVKFTAEELRRIMDYKHNIRNMSVIAHVDHGKSTLTDSLVAAAGIIAQEVAGDVRMTDTRADEAERGITIKSTGISLYYEMTDESLKNYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKNTGSATCKRGFVQFCYEPIKQIINTCMNDQKDKLWPMLQKLGVTMKSDEKDLMGKALMKRVMQTWLPASTALLEMMIFHLPSPSTAQKYRVENLYEGPLDDQYAASIRACDPEGPLMLYVSKMIPASDKGRFFAFGRVFSGKVSTGLKVRIMGPNYVPGEKKDLYVKSVQRTVIWMGKRQETVEDVPCGNTVALVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPMEDGLAEAIDDGKIGPRDDPKVRSKILSEEYGWDKDLAKKIWCFGPETTGPNMVVDMCKGVQYLNEIKDSVVAGFQWASKEGALAEENMRAICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQASQLVTDIRKRKGLKEQMTPLAEFEDKL

SEQ ID NO: 5316 - protein, 843 aa, Musa acuminata
MVKFTAEELRRIMDMKHNIRNMSVIAHVDHGKSTLTDSLVAAAGIIAQEVAGDVRMTDTRQDEAERGITIKSTGISLYYEMTEESLKNYKGERSGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYAAKFGVDESKMMERLWGENYFDPATKKWTSKNTGSGTCKRGFVQFCYEPIRQIISTCINDQKDKLWPMLQKLGVTMKSEEKELVGKALMKRVMQTWLPASTALLEMMIFHLPSPAKAQKYRVENLYEGPLDDIYANAIRNCDPEGPLMLYVSKMIPASDKGRFFAFGRVFSGRVATGMKVRIMGPNYVPGQKKDLYVKSVQRTVIWMGKRQESVEDVPCGNTVAMVGLDQYITKNATLTNEKEVDAHPIRAMKFSVSPVVRVAVQCKVASDLPKLVEGLKRLAKSDPMVVCTMEESGEHIVAGAGELHLEICLKDLQEDFMGGAEIVVSDPVVSFRETVLEKSCRTVMSKSPNKHNRLYMEARPMEEGLAEAIDEGRIGPRDDPKVRSKILSEEFGWDKDLAKKIWCFGPETTGPNMVVDMCKGVQYLNEIKDSVVAGFQWASKEGAVAEENMRAICFEVCDVVLHADAIHRGGGQIIPTARRVIYASQLTAKPRLLEPVYLVEIQAPEQALGGIYGVLNQKRGHVFEELQRPGTPLYNIKAYLPVIESFGFSSTLRAATSGQAFPQCVFDHWDMMSSDPLETGSQAGQLVSEIRKRKGLKEQITPLSEFEDKL

SEQ ID NO: 5317 - protein, 843 aa, Manihot esculenta
MVKFTAEELRRIMDFKHNIRNMSVIAHVDHGKSTLTDSLVAAAGIIAQEVAGDVRMTDTRQDEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDCQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVTMKSEEKDLMGKALMKRVMQTWLPASNALLEMMIFHLPPPSKAQKYRVENLYEGPLDDPYATAIRNCDPEGPLMLYVSKMIPASDKGRFFAFGRVFSGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSCRVVMSKSPNKHNRLYMEARPMEEGLAEAIDDGRIGPRDDPKARAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEELQRPGTPLYNIKAYLPVIESFGFSSTLRAATSGQAFPQCVFDHWDMMSSDPLEAGSQAAQLVSDIRKRKGLKEQMTPLSEYEDKL

SEQ ID NO: 5318 - protein, 843 aa, Pinus pinaster
MVKFTAEGLRTIMDRKHNIRNMSVIAHVDHGKSTLTDSLVAAAGIIAQEVAGDVRMTDTRADEAERGITIKSTGISLYYEMEDAAVKNFKGDREGHEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDEAKMMERLWGENFFDPATKKWTTKNTGSATCKRGFVQFIYEPIKQIINICMNDQKDKLWPMLQKLGVVMKSEEKELVAKALMKRVMQTWLPASSALLEMMIFHLPSPAKAQRYRVENLYEGPLDDIYATAIRNCDPEGPLMLYVSKMIPASDKGRFFAFGRVFAGRVATGMKVRIMGPNYVPGQKKDLYTKSVQRTVIWMGKKQESVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSCRTVMSKSPNKHNRLYFEARPLEEGLAEAIDEGRIGPKDDPKARSKILSEEFGWDKDLAKKIWCFGPETTGPNMVVDMCKGVQYLNEIKDSVVAAFQWASKEGALAEENMRGICFEVCDVVLHTDAIHRGGGQVIPTARRVMYASQLTAKPRLLEPVYLVEIQAPENALGGIYGVLNQKRGHVFEEMQRPGTPLYNIKAYLPVVESFGFSSTLRAATSGQAFPQCVFDHWDMMGSDPLESGSQAGQLVIDIRKRKGLKESMTPLSEYEDKL

SEQ ID NO: 5319 - protein, 843 aa, Populus trichocarpa
MVKFTAEELRRIMDYKHNIRNMSVIAHVDHGKSTLTDSLVAAAGIIAQEVAGDVRMTDTRADEAERGITIKSTGISLYYEMADEALKNFKGERQGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFANMYASKFKVDEGKMMERLWGENFFDPATKKWSSKNTGSPTCKRGFVQFCYEPIKQIINTCMNDQKDKLWPMLQKLGVVMKSEEKDLMGKALMKRVMQTWLPASTALLEMMIFHLPSPAKAQKYRVENLYEGPLDDVYANAIRNCDPEGPLMLYVSKMIPASDKGRFFAFGRVFSGKVSTGLKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQEDFMGGAEIIKSDPVVSFRETVLEKSCRVVMSKSPNKHNRLYMEARPMEEGLAEAIDDGRIGPRDDPKNRAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEQALGGIYSVLNQKRGHVFEEMQRPGTPLYNIKAYLPVIESFGFSGTLRAATSGQAFPQCVFDHWDMMSSDPLEAGTQAAQLVTDIRKRKGLKEQMTPLSDFEDKL

SEQ ID NO: 5320 - protein, 843 aa, Solanum tuberosum
MVKFTAEELRRIMDFKHNIRNMSVIAHVDHGKSTLTDSLVAAAGIIAQEVAGDVRMTDTRADEAERGITIKSTGISLYYEMTDESLRNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNSGTASCKRGFVQFCYEPIKQIINTCMNDQKDKLWPMLQKLGVTMKSDEKDLMGKALMKRVMQTWLPASTALLEMMIYHLPSPSTAQRYRVENLYEGPLDDAYANAIRNCDPEGPLMLYVSKMIPASDKGRFFAFGRVFAGKVCTGMKVRIMGPNYVPGEKKDLYVKNIQRTVIWMGKRQETVEDVPCGNTVAMVGLDQYITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSTRTVMSKSPNKHNRLYMEARPMEEGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYLVEIQAPEQALGGIYSVLNQKRGHVFEEMQRPGTPLYNIKAYLPVVESFGFSGTLRAATSGQAFPQCVFDHWEMMSSDPLEVGSQANQLVLDIRKRKGLKEQMTPLSEFEDKL

SEQ ID NO: 5321 - protein, 843 aa, Solanum phureja
MVKFTAEELRRIMDFKHNIRNMSVIAHVDHGKSTLTDSLVAAAGIIAQEVAGDVRMTDTRADEAERGITIKSTGISLYYEMTDESLRNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNSGTASCKRGFVQFCYEPIKQIINTCMNDQKDKLWPMLQKLGVTMKSDEKDLMGKALMKRVMQTWLPASTALLEMMIYHLPSPAIAQRYRVENLYEGPLDDAYANAIRNCDPEGPLMLYVSKMIPASDKGRFFAFGRVFAGKVCTGMKVRIMGPNYVPGEKKDLYVKNIQRTVIWMGKRQETVEDVPCGNTVAMVGLDQYITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSTRTVMSKSPNKHNRLYMEARPMEEGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYLVEIQAPEQALGGIYSVLNQKRGHVFEEMQRQGTPLYNIKAYLPVVESFGFSGTLRAATSGQAFPQCVFDHWEMMSSDPLEVGSQANQLVLDIRKRKGLKEQMTPLSEFEDKL

SEQ ID NO: 5322 - protein, 843 aa, Glycine max
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENFFDPATKKWSSKNTGSATCKRGFVQFCYEPIKQIINTCMNDQKDKLWPMLQKLGVTMKSEEKDLMGKALMKRVMQTWLPASSALLEMMIFHLPSPSTAQKYRVENLYEGPLDDQYASAIRNCDPEGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPLEEGLAEAIDDGKIGPRDDPKIRSKILSEEFGWDKDLAKKIWCFGPETLGPNMVVDMCKGVQYLNEIKDSVVAGFQWASKEGALAEENMRAICFEVCDVVLHADAIHRGGGQIIPTARRVFYASQITAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQAAQLVTDIRKRKGLKEQMTPLSEFEDKL

SEQ ID NO: 5323 - protein, 832 aa, Panicum virgatum
MVKFTAEELRAIMDKKNNIRNMSVIAHVDHGKSTLTDSLVAAAGIIAQEVAGDVRMTDTRADEAERGITIKSTGISLYYEMTPESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKNTGSATCKRGFVQFCYEPIKQIINTCMNDQKDKLWPMLQKLNVTMKADEKELVGKALMKRVMQTWLPASTALLEMMIFHLPSPSKAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQLLSWCWTSARGRVSRNR

SEQ ID NO: 5324 - protein, 843 aa, Populus trichocarpa
MVKFTAEELRRIMDFKHNIRNMSVIAHVDHGKSTLTDSLVAAAGIIAQEVAGDVRMTDTRADEAERGITIKSTGISLYYEMSDESLKRFKGERHGNEYLINLIDSPGHVDFSSEVTAALRITDGALVVVDCIEGVCVQTETVLRQALGERIRPVLTVNKMDRCFLELQVDGEEAFQTFSRVIENANVIMATYEDPLLGDCQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVVMKSDEKDLMGKPLMKRVMQTWLPASTALLEMMIFHLPSPATAQRYRVENLYEGPLDDAYANAIRNCDPNGPLMLYVSKMIPASDKGRFFAFGRVFAGKVTTGLKVRIMGPNYVPGEKKDLYVKSVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVIDKSCRVVMSKSPNKHNRLYMEARPMEEGLAEAIDDGRIGPRDDPKIRGKILSEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYMVEIQAPEQALGGIYSVLNQKRGHVFEELQRPGTPLYNIKAYLPVVESFGFSGTLRAATSGQAFPQCVFDHWDTMSSDPMEAGTQAAQLVTEIRKRKGLKEQMTPLSEFEDKL

SEQ ID NO: 5325 - protein, 443 aa, Pinus taeda
MVKFTAEELRKIMDRKHNIRNMSVIAHVDHGKSTLTDSLVAAAGIIAQEVAGDVRMTDTRADEAERGITIKSTGISLYYVMEDAAVKNFKGDREGHEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDEAKMMERLWGENFFDPATKKWTTKNTGSATCKRGFVQFIYEPIKQIINICMNDQKDKLWPMLQKLGVVMKSDEKELVAKALMKRVMQTWLPASSALLEMMIFHLPSPAKAQRYRVENLYEGPLDDVYATAIRNCDPEGPLMLYVSKMIPASDKGRFFAFGRVFAGRVATGMKVRIMGPNYVPGQKKDLYTKSVQRTVIWMGKKQESR

SEQ ID NO: 5326 - protein, 507 aa, Gossypium hirsutum
MVKFTAEELRAIMDRKHNIRNMSVIAHVDHGKSTLTDSLVAAAGIIAQEVAGDVRMTDTRADEAERGITIKSTGISLYYEMSDDSLMSYKGERQGNEYLINLIDSPGHVDFSSEVTAALRITDGALVVVDCIEGVCVQIETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATRKWTTKNTGTATCKRGFVQFCYEPIKQIINTCMNDQKDKLWPMLQKLGVTMKSEEKDLMGKALMKRVMQTWLPASSALLEMMIFHLPSPSVAQKYRVENLYEGPLDDVYANAIRNCDPEGPLMLYVSKMIPASDKGRFFAFGRVFSGRVATGLKVRIMGPNYVPGEKKDLYVKSVQRTVIWMGKKQETVEDVPCGNTVAMVGLDQFITKNATLTNEKEVDAHPIRAMSFLSPLLSVLLFSARLHQILPNLLKG

SEQ ID NO: 5327 - protein, 843 aa, Manihot esculenta
MVKFTAEELRRIMDFKHNIRNMSVIAHVDHGKSTLTDSLVAAAGIIAQEVAGDVRMTDTRQDEAERGITIKSTGISLYYEMSDEALKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDCQVYPEKGTVAFSAGLHGWAFTLTNFAKMYASKFGVDESKMMERLWGENFFDPATKKWTTKNTGSPTCKRGFVQFCYEPIKQIINTCMNDQKDKLWPMLQKLGVTMKSEEKDLMGKALMKRVMQTWLPASNALLEMMIFHLPSPSKAQRYRVENLYEGPLDDPYATAIRNCDPEGPLMLYVSKMIPASDKGRFFAFGRVFSGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQEDFMGGAEIIKSDPVVSFRETVLEKSCRVVMSKSPNKHNRLYMEARPMEDGLAEAIDDGRIGPRDDPKARAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQAAQLVADIRKRKGLKEQMTPLSEYEDKL

SEQ ID NO: 5328 - protein, 843 aa, Vigna unguiculata
MVKFTAEELRRIMDFKHNIRNMSVIAHVDHGKSTLTDSLVAAAGIIAQEVAGDVRMTDTRADEAERGITIKSTGISLYYEMSDESLKNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENFFDPATKKWTSKNTGSATCKRGFVQFCYEPIKQIINTCMNDQKDKLWPMLLKLGVTMKSEEKDLMGKALMKRVMQTWLPASTALLEMMIFHLPSPSTAQKYRVENLYEGPLDDQYAAAIRACDPEGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPMEEGLAEAIDDGKIGPRDDPKVRSKILSEDYGWDKDLAKKIWCFGPETTGPNMVVDMCKGVQYLNEIKDSVVAGFQWASKEGALAEENMRGICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQAAQLVADIRKRKGLKEQMTPLSEYEDKL

SEQ ID NO: 5329 - protein, 843 aa, Elaeis guineensis
MVKFTVEELRRIMDMKHNIRNMSVIAHVDHGKSTLTDSLVAAAGIIAQEVAGDVRMTDTRQDEAERGITIKSTGISLYYEMSDESLKNYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYAAKFGVDEAKMMERLWGENYFDPATKKWTNKNTGSPTCKRGFVQFCYEPIKQIIRTCMNDQKDKLWPMLQKLGVSMKSDEKELMGKALMKRVMQTWLPASSALLEMMIFHLPSPSKAQKYRVENLYEGPLDDVYANAIRNCDPEGPLMLYVSKMIPASDKGRFFAFGRVFSGRVSTGMKVRIMGPNYVPGQKKDLYVKSVQRTVIWMGKRQESVEDVPCGNTVAMVGLDQFITKNATLTNEKEADAHPIRAMKFSVSPVVRVAVQCKIASDLPKLVEGLKRLAKSDPMVVCTIEESGEHIIAGAGELHLEICLKDLQEDFMGGAEIVVSDPVVSFRETVLEKSCRTVMSKSPNKHNRLYMEARPMEDGLAEAIDEGRIGPRDDPKVRAKILSEEFGWDKDLAKKIWCFGPETTGPNMVVDMCKGVQYLNEIKDSVVAGFQWASKEGAMAEENMRGICFEVCDVVLHADAIHRGGGQIIPTARRVIYASQLTAKPRLLEPVYLVEIQAPEQALGGIYGVLNQKRGHVFEELQRPGTPLYNIKAYLPVIESFGFSGTLRAATSGQAFPQCVFDHWDMMSSDPLEPGTQAAQLVSDIRKRKGLKDQMTPLSEYEDKL

SEQ ID NO: 5330 - protein, 843 aa, Arachis hypogaea
MVKFTAEELRRIMDYKHNIRNMSVIAHVDHGKSTLTDSLVAAAGIIAQEVAGDVRMTDTRADEAERGITIKSTGISLYYEMSDEALKNYKGERQGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDESKMMERLWGENFFDPATKKWTSKNTGSATCKRGFVQFCYEPIKQIINTCMNDQKDKLWPMLQKLGVTMKSDEKELMGKALMKRVMQTWLPASTALLEMMIFHLPSPAKAQKYRVENLYEGPLDDQYAAAIRACDPEGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVLCTIEESGEHIVAGAGELHLEICLKDLQEDFMGGAEIIKSDPVVSFRETVLERSCRTVMSKSPNKHNRLYMEARPMEDGLAEAIDDGKIGPRDDPKVRSKILSEEYGWDKDLAKKIWCFGPETTGPNMVVDMCKGVQYLNEIKDSVVAGFQWASKEGALAEENMRAICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLESGSQAAQLVMDIRKRKGLKEQMTPLSEYEDKL

SEQ ID NO: 5331 - protein, 843 aa, Populus trichocarpa
MVKFTAEELRRIMDFKHNIRNMSVIAHVDHGKSTLTDSLVAAAGIIAQEVAGDVRMTDTRADEAERGITIKSTGISLYYEMSDESLKRFKGERHGNEYLINLIDSPGHVDFSSEVTAALRITDGALVVVDCIEGVCVQTETVLRQALGERIRPVLTVNKMDRCFLELQVDGEEAFQTFSRVIENANVIMATYEDPLLGDCQVYPEKGTVAFSAGLHGWAFTLTNFAQMYASKFGVDESKMMERLWGENFFDPATKKWTTKNTGSATCKRGFVQFCYEPIKQIIKTCMNDQKDKLWPMLQKLGVVMKSDEKDLMGKPLMKRVMQTWLPASTALLEMMIFHLPSPATAQRYRVENLYEGPLDDAYANAIRNCDPNGPLMLYVSKMIPASDKGRFFAFGRVFAGKVTTGLKVRIMGPNYVPGEKKDLYVKSVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVIDKSCRVVMSKSPNKHNRLYMEARPMEEGLAEAIDDGRIGPRDDPKIRGKILSEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYMVEIQAPEQALGGIYSVLNQKRGHVFEEIQRPGTPLYNIKAYLPVVESFGFSGTLRAATSGQAFPQCVFDHWDTMSSDPMEAGTQAAQLVAEIRKRKGLKEQMTPLSDFEDKL

SEQ ID NO: 5332 - protein, 843 aa, Prunus persica
MVKFTAEELRRIMDYKHNIRNMSVIAHVDHGKSTLTDSLVAAAGIIAQEVAGDVRMTDTRADEAERGITIKSTGISLYYEMTDEALKSYKGERNGNEYLINLIDSPGHVDFSSEVTAALRITDGALVVVDCIEGVCVQTETVLRQALGERIRPVLTVNKMDRCFLELQVDGEEAYQAFQRVIENANVIMATYEDPLLGDVQVYPEKGTVAFSAGLHGWAFTLTNFAKMYASKFGVDESKMMERLWGENYFDPATKKWTSKNTGSATCKRGFVQFCYEPIKQIINICMNDQKEKLWPMLTKLGVTMKSDEKELMGKALMKRVMQTWLPASSALLEMMIFHLPSPSTAQRYRVENLYEGPLDDQYANAIRNCDPEGPLMLYVSKMIPASDKGRFFAFGRVFAGKVQTGLKVRIMGPNYVPGEKKDLYVKNVQRTVIWMGKKQETVEDVPCGNTVALVGLDQFITKNATLTNEKEADAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSSRTVMSKSPNKHNRLYMEARPLEEGLPEAIDDGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEQALGGIYSVLNQKRGHVFEEIQRPGTPLYNIKAYLPVIESFGFSGQLRASTSGQAFPQCVFDHWEMMSSDPLEVGSQAAQLVTDIRKRKGLKEQMTPLSEFEDKL

SEQ ID NO: 5333 - protein, 843 aa, Fragaria vesca
MVKFTAEELRRIMDYKHNIRNMSVIAHVDHGKSTLTDSLVAAAGIIAQEVAGDVRMTDTRADEAERGITIKSTGISLYYEMTDESLKMFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYADKFKVDEAKMMERLWGENFFDPATKKWTSKNTGSPTCKRGFVQFCYEPIKQVIATCMNDQKDKLWPMLTKLGITMKGEEKDLMGKPLMKRVMQTWLPASSALLEMMIFHLPSPHTAQRYRVENLYEGPLDDQYANAIRNCDPDGPLMLYVSKMIPASDKGRFFAFGRVFAGKVQTGLKVRIMGPNYVPGEKKDLYVKNVQRTVIWMGKKQETVEDVPCGNTVALVGLDQFITKNATLTNEKETDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSCRTVMSKSPNKHNRLYMEARPLEDGLAEAIDDGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEGALGGIYSVLNQKRGHVFEEMQRPGTPLYNIKAYLPVVESFGFSGQLRASTSGQAFPQCVFDHWEMMSSDPLETGSQASQLVQDIRKRKGLKEQMTPLSDFEDKL

SEQ ID NO: 5334 - protein, 843 aa, Tabernaemontana elegans
MVKFTVEELRRIMDYKHNIRNMSVIAHVDHGKSTLTDSLVAAAGIIAQEVAGDVRMTDTRADEAERGITIKSTGISLYYEMADEALKGYKGERQGNEYLINLIDSPGHVDFSSEVTAALRITDGALVVVDCIEGVCVQTETVLRQALGERIRPVLTVNKMDRCFLELQVDGEEAYQTFQKVIENANVIMATYEDPLLGDVQVYPEKGTVAFSAGLHGWAFTLTNFAKMYASKFGVDESKMMERLWGENFFDPATKKWTSKNTGSATCKRGFVQFCYEPIKQIISTCMNDQKDKLWPMLQKLGVTMKSEEKDLMGKALMKRVMQTWLPASNALLEMMIFHLPSPAKAQRYRVENLYEGPLDDAYATAIRNCDPEGPLMLYVSKMIPASDKGRFFAFGRVFAGKVATGLKVRIMGPNYVPGEKKDLYVKNVQRTVIWMGKRQETVDDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSSRTVMSKSPNKHNRLYMEARPMEEGLAEAIDDGRIGPRDDPKTRAKILAEEFGWDKDLAKKIWCFGPETTGPNMVVDMCKGVQYLNEIKDSVVAGFQWASKEGALAEENMRGICFEVCDVVLHADAIHRGGGQIIPTARRVIYASQITAKPRLLEPVYLVEIQAPEQALGGIYSVLNQKRGHVFEEMQRPGTPLYNIKAYLPVIESFGFSGTLRAATSGQAFPQCVFDHWDMMSSDPLESGSQASQLVADIRKRKGLKEQMTPLSEFEDKL

SEQ ID NO: 5335 - protein, 843 aa, Taxus baccata
MVKFTAEELRRIMDLKHNIRNMSVIAHVDHGKSTLTDSLVAAAGIIAQEVAGDVRMTDTRADEAERGITIKSTGISLYYEMTDASLKSFTGERVGNEYLINLIDSPGHVDFSSEVTAALRITDGALVVVDCIEGVCVQTETVLRQALGERIKPVLTVNKMDRCFLELQVEGEEAYQTFLRVIENANVIMATYEDPLLGDCQVYPEKGTVAFSAGLHGWAFTLTNFAKMYASKFGVDESKMMERLWGENYFDPATKKWTSKNTGTATCKRGFVQFIYEPIKQIIKICMNDQKDKLWPMLQKLGVVMKSEEKELAGKALMKRVMQTWLPASTALLEMMIFHLPSPSKAQRYRVENLYEGPLDDIYATAIRNCDPEGPLMLYISKMIPASDKGRFFAFGRVFAGKVSTGQKVRIMGPNYVPGQKKDLYVKSVQRTVIWMGKKQESVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSVRTVMSKSPNKHNRLYFEARPLEEGLPEAIDDGRIGPRDDPKARAKILSEEFGWDKDLAKKIWCFGPETTGPNMVVDMCKGVQYLNEIKDSVVAAFQWASKEGALAEENMRGICFEVCDVVLHTDAIHRGGGQIIPTARRVMYAAQLTAKPRLLEPVYLVEIQAPEQALGGIYGVLNQKRGHVFEEMQRPGTPLYNIKAYLPVVESFGFSGTLRAATSGQAFPQCVFDHWDMMGSDPMEHGTQAEKLVIDIRKRKGLKEQMTPLSEFEDKL

SEQ ID NO: 5336 - protein, 843 aa, Olea europaea
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENFFDPATKKWTTKNTGSPTCKRGFVQFCYEPIKQIINTCMNDQKDKLWPMLQKLGVVMKSDEKDLMGKALMKRVMQTWLPASTALLEMMIFHLPSPSKAQRYRVENLYEGPMDDSYATAIRNCDPDGPLMLYVSKMIPASDKGRFFAFGRVFSGRVSTGLKVRIMGPNYVPGEKKDLYVKSVQRTVIWMGKRQETVEDVPCGNTVAMVGLDQYITKNATLTNEKEVDAHPIRAMKFSVSPVVRVAVQCKVASDLPKLVEGLKRLAKSDPMVVCTIEESGEHIIAGAGELHLEICLKDLQEDFMGGAEIIKSDPVVSFRETVLERSSRIVMSKSPNKHNRLYMEARPLEEGLAEAIDDGRIGPRDDPKLRSKILSEEFGWDKELAKKIWCFGPETTGPNMVVDMCKGVQYLNEIKDSVVAGFQWASKEGPLAEENMRGICFEVCDVVLHADAIHRGGGQVIPTARRVIYASHLTAKPRLLEPVYLVEIQAPEQALGGIYSVLNQKRGHVFEELQRPGTPLYNIKAYLPVIESFGFSSTLRAATSGQAFPQCVFDHWDMMSSDPLEAGSQAAQLVIDIRKRKGLKEQMTPLSEFEDRL

SEQ ID NO: 5337 - protein, 843 aa, Arnica chamissonis
MVKFTAEELRRIMDFKHNIRNMSVIAHVDHGKSTLTDSLVAAAGIIAQEVAGDVRMTDTRADEAERGITIKSTGISLYYEMTDAALKAFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPKTKKWTTKSTGAATCKRGFVQFCYEPIKQVINTCMNDQKDQLWPMLTKLGVSLKSDEKELMGKALMKRVMQTWLPAATALLEMMIFHLPSPHTAQRYRVENLYEGPLDDQYANAIRNCDPEGPLMLYVSKMIPASDKGRFFAFGRVFAGKVSTGLKVRIMGPNFVPGEKKDLYVKSVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPLEDGLAEAIDDGRIGPRDDPKVRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRQGTPLYNIKAYLPVVESFGFSGALRASTSGQAFPQCVFDHWDMMGSDPLEAGSQASTLVTQIRKRKGLKEQMTPLSDFEDKL

SEQ ID NO: 5338 - protein, 843 aa, Cycas rumphii
  misc_feature (209)..(209): Xaa can be any naturally occurring amino acid
MVKFTAEELRKIMDLKHNIRNMSVIAHVDHGKSTLTDSLVAAAGIIAQEVAGDVRMTDTRADEAERGITIKSTGISLYYEMSDESLKMYKGERSGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTXAFSAGLHGWAFTLTNFAKMYATKFGVDEAKMMERLWGENYFDPATRKWTSKNTGSATCKRGFVQFIYEPIKQIINICMNDQKDKLWPMLQKLGVTMKNEEKDLVAKALMKRVMQTWLPASSALLEMMIFHLPSPSKAQKYRVENLYEGPLDDQYANAIRNCDPDGPLMLYVSKMIPASDKGRFFAFGRVFSGRVATGMKVRIMGPNYVPGQKKDLYVKSVQRTVIWMGKKQESVEDVPCGNTVAMVGLDQYITKNATLTNEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSNHTVMSKSPNKHNRLYFEARPLEEGLPEAIDDGRIGPRDDPKVRSKILAEEFGWDKDLAKKIWCFGPETTGPNMVVDMCKGVQYLNEIKDSVVAAFQWASKEGALAEENMRGICFEVCDVVLHADAIHRGGGQVIPTARRVMYAAQLTAKPRLLEPVYLVEIQAPEQALGGIYGVLNQKRGHVFEEIQRPGTPLYNIKAYLPVIESFGFSGTLRAATSGQAFPQCVFDHWDMMSSDPMETSSQAGQLVIDIRKRKGLKEQMTPLSEYEDKL

SEQ ID NO: 5339 - protein, 730 aa, Eschscholzia californica
MVKFTAEELRRIMDLKHNIRNMSVIAHVDHGKSTLTDSLVAAAGIIAQEVAGDVRMTDTRADEAERGITIKSTGISLYYEMTDASLKAFKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFANMYASKFGVDVTKMMERLWGENFFDPATKKWTSKNTGSPTCKRGFVQFCYEPIKQIINTCMNDQKDKLWPMLQKLGVTMKSEEKDLLGKPLMKRVMQTWLPASTALLEMMIFHLPSPSTAQRYRVENLYEGPLDDQYANAIRNCDPEGPLMLYVSKMIPAPDKGRFFAFGRVFSGKVATGMKVRIMGPNFVPGQKKDLYTKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLDKSCRTVMSKSPNKHNRLYMEARPLEDGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLTLMPSTEVVDKSSPRPEELSMPHKSLPSPGYWSQST

SEQ ID NO: 5340 - protein, 843 aa, Lactuca sativa
MVKFTAEELRRIMDYKHNIRNMSVIAHVDHGKSTLTDSLVAAAGIIAQEVAGDVRMTDTRADEAERGITIKSTGISLYYEMTDAALKAFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPKTKKWTTKSTGTATCKRGFVQFCYEPIKQIINTCMNDQKDILWPMLAKLGVTMKGEEKELMGKALMKRVMQTWLPAATALLEMMIFHLPSPHTAQRYRVENLYEGPLDDQYANAIRNCDPDGPLMLYVSKMIPASDKGRFFAFGRVFAGRVSTGLKVRIMGPNYVPGEKKDLYVKSVQRTVIWMGKKQETVEDVPCGNTVALVGLDQFITKNATLTNEKETEAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEEGLAEAIDEGRIGPRDDPKVRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRQGTPLYNIKAYLPVVESFGFSGALRASTSGQAFPQCVFDHWDMMGSDPLEAGSQASTLVGQIRKRKGLKEQMTPLSDFEDKL

SEQ ID NO: 5341 - protein, 843 aa, Medicago truncatula
MVKFTADELRRIMDYKHNIRNMSVIAHVDHGKSTLTDSLVAAAGIIAQEVAGDVRMTDTRADEAERGITIKSTGISLYYEMTDESLKRFKGERNGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDETKMMERLWGENFFDPATKKWTTKNTGSATCKRGFVQFCYEPIKQVINTCMNDQKDKLWPMLTKLGITMKSEEKDLMGKPLMKRVMQTWLPASTALLEMMIFHLPSPSTAQRYRVENLYEGPLDDQYATAIRNCDPEGPLMLYVSKMIPASDKGRFFAFGRVFSGKVSTGLKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPLEDGLAEAIDEGTIGPRDDPKNRSKILSEQYGWDKDLAKKIWCFGPETTGPNMVVDMCKGVQYLNEIKDSVVAGFQWASKEGALSEENMRGICFEVCDVVLHTDAIHRGGGQIIPTARRVFYASQLTAKPRLLEPVYMVEIQAPEQALGGIYSVLNQKRGHVFEEMQRPGTPLYNIKAYLPVIESFGFSSQLRAATSGQAFPQCVFDHWDMMSSDPLEAGSQAATLVTDIRKRKGLKEQMTPLSEFEDKL

SEQ ID NO: 5342 - protein, 843 aa, Sciadopitys verticillata
MVKFTAEGLRRIMDLKHNIRNMSVIAHVDHGKSTLTDSLVAAAGIIAQEVAGDVRMTDTRADEAERGITIKSTGISLYYEMTDESLKSFKGDRMGNEYLINLIDSPGHVDFSSEVTAALRITDGALVVVDCIEGVCVQTETVLRQALGERIRPVLTVNKMDRCFLELQVDGEEAYQTFLRVIENANVIMATYEDPLLGDCQVYPEKGTVAFSAGLHGWAFTLTNFAKMYASKFGVDEAKMMERLWGENFFDPATKKWTSKNTGSPTCKRGFVQFIYEPIKQIINICMNDQKDKLWPMLKKLGVVMKSEEKDLAGKALMKRVMQTWLPASSALLEMMIFHLPSPSKAQKYRVENLYEGPLDDMYANAIRNCDPEGPLMLYVSKMIPASDKGRFFAFGRVFSGKVATGMKVRIMGPNYVPGQKKDLYVKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSTRTVMSKSPNKHNRLYFEARPLEDGLAEAIDDGRVGPRDDPKARAKILSEEFGWDKDLAKKIWCFGPETTGPNMVVDMCKGVQYLNEIKDSVVAAFQWASKEGVLAEENMRGICFEVCDVVLHTDAIHRGGGQIIPTARRVMYACQLTAKPRLLEPVYLVEIQAPEQALGGIYGVLNQKRGHVFEEMQRPGTPLYNIKAYLPVVESFGFSGTLRGATAGQAFPQCVFDHWDMMSSDPLEHGTQAEKLVFDIRKRKGLKEQMTPLSEFEDKL

SEQ ID NO: 5343 - protein, 843 aa, Solanum lycopersicum
MVKFTAEELRRIMDFKHNIRNMSVIAHVDHGKSTLTDSLVAAAGIIAQEVAGDVRMTDTRADEAERGITIKSTGISLYYEMTDDSLRNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGTASCKRGFVQFCYEPIKQIINTCMNDQKDKLWPMLQKLGVTMKSDEKDLMGKALMKRVMQTWLPASTALLEMMIYHLPSPSTAQKYRVENLYEGPLDDAYANAIRNCDPEGPLMLYVSKMIPASDKGRFFAFGRVFAGKVSTGMKVRIMGPNYVPGEKKDLYVKNIQRTVIWMGKRQETVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLEKSTRTVMSKSPNKHNRLYMEARPMEEGLAEAIDEGRIGPRDDPKVRSKILAEEFGWDKDLAKKIWCFGPETTGPNMVVDMCKGVQYLNEIKDSVVAGFQWASKEGALAEENMRGICFEVCDVVLHSDAIHRGGGQVIPTARRVIYASQLTAKPRLLEPVYLVEIQAPEQALGGIYSVLNQKRGHVFEEMQRPGTPLYNIKAYLPVVESFGFSGTLRAATSGQAFPQCVFDHWEMMSSDPLEAGSQAHQLVLDIRKRKGLKDQMTPLSEFEDKL

SEQ ID NO: 5344 - protein, 843 aa, Cicer arietinum
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSPSCKRGFVQFCYEPIKQIINTCMNDQKDKLWPMLTKLGVTMKSEEKDLMGKALMKRVMQTWLPASSALLEMMIFHLPSPSTAQRYRVENLYEGPLDDQYANAIRNCDPEGPLMLYVSKMIPASDKGRFFAFGRVFAGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLDRSCRTVMSKSPNKHNRLYMEARPLEDGLAEAIDEGTIGPRDDPKIRSKILSEQYGWDKDLAKKIWCFGPETTGPNMVVDMCKGVQYLNEIKDSVVAGFQWASKEGALAEENMRAICFEVCDVVLHTDAIHRGGGQIIPTARRVFYASQLTAKPRLLEPVYLVEIQAPEQALGGIYSVLNQKRGHVFEEMQRPGTPLYNIKAYLPVVESFGFSSQLRAATSGQAFPQCVFDHWDMMSSDPLEAGSQAATLVTDIRKRKGLKEQMTPLSEFEDKL

SEQ ID NO: 5345 - protein, 843 aa, Zostera marina
MVKFTAEELRRIMDLKHNIRNMSVIAHVDHGKSTLTDSLVAAAGIIAQEVAGDVRMTDTRSDEAERGITIKSTGISLYYEMTDESLKSFKGERMGNEYLINLIDSPGHVDFSSEVTAALRITDGALVVVDCIEGVCVQTETVLRQALGERIRPVLTVNKMDRCFLELQVNGDEAYQTFQRVIENANVIMATYEDALLGDVQVYPEKGTVAFSAGLHGWAFTLTNFAKMYASKFGVDESKMMERLWGENYFDPATKKWTSKMTASPTCKRGFVQFCYEPIKQIINTCMNDQKDKLWPMLKKLGVVMKSEEKELMGKPLMKRVMQNWLPASTALLEMMIFHLPSPHTAQRYRVENLYEGPLDDVYANAIRNCDPNGPLMLYVSKMIPASDKGRFFAFGRVFSGKVSTGVKVRIMGPNYVPGQKKDLYVKSVQRTVIWMGKKQESVEDVPCGNTVALVGLDQFITKNATLTNEKESDAHPIRAMKFSVSPVVRVAVQCKVASDLPKLVEGLKRLAKSDPMVMCMIEESGEHIIAGAGELHLEICLKDLQDDFMGGAQIVVSDPVVSFRETVMEKSSRTVMSKSPNKHNRLYMEARPLEDGLPEAIDDGRIGPRDDPKIRSKILAEEFGWDKDLAKKIWCFGPETTGPNMVVDMCKGVQYLNEIKDSVVAGFQWASKEGAMAEENMRGICFEVCDVVLHADAIHRGGGQVIPTARRVIYASQITAKPRLLEPVYLVEIQAPEGALGGIYGVLNQKRGHVFEEIQRPGTPLYNIKAYLPVIESFGFSSTLRASTSGQAFPQCVFDHWDMMMSDPLDPGTQAATLVKDIRKRKGLKDQMTPLSEFEDKL

SEQ ID NO: 5346 - protein, 843 aa, Ambrosia trifida
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDEAKMMERLWGENFFDPKTKKWTTKSTGTATCKRGFVQFCYEPIKQIINTCMNDQKDQLWPMLTKLGVTMKSEEKELMGKALMKRVMQNWLPAATALLEMMIFHLPSPHTAQRYRVENLYEGPLDDQYANAIRNCDPDGPLMLYVSKMIPASDKGRFFAFGRVFAGRVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEDGLAEAIDEGRVGPRDDPKVRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRPGTPLYNIKAYLPVVESFGFSGALRASTSGQAFPQCVFDHWDMMGSDPLEVGSQASTLVTQIRKRKGLKEQMTPLSEFEDKL

SEQ ID NO: 5347 - protein, 842 aa, Amorphophallus konjac
VKFTAEELRRIMDLKHNIRNMSVIAHVDHGKSTLTDSLVAAAGIIAQEVAGDVRMTDTRQDEAERGITIKSTGISLYYEMDADDLKDFKGERSGNEYLINLIDSPGHVDFSSEVTAALRITDGALVVVDCVEGVCVQTETVLRQALGERIRPVLTVNKMDRCFLELQVEGEEAYQTFLRVIENANVIMATYEDPLLGDVQVYPEKGTVAFSAGLHGWAFTLTNFAKMYASKFGVDESKMMERLWGENFFDPATKKWTTKNTGSPTCKRGFVQFCYEPIKQIISTCMNDQKDKLWPMLQKLKVTMKSEDKDLTGKALMKRVMQTWLPASDALLEMMIFHLPSPAKAQKYRVENLYEGPLDDIYANAIRNCDPDGPLMLYVSKMIPASDKGRFFAFGRVFSGKVSTGMKVRIMGPNYVPGQKKDLYVKSVQRTVIWMGKKQESVEDVPCGNTVAMVGLDQFITKNATLTNEKEVDAHPIRAMKFSVSPVVRVAVQCKVASDLPKLVEGLKRLAKSDPMVVCAMEESGEHIVAGAGELHLEICLKDLQEDFMGGAEIIVSDPVVSFRETVLEKSCRTVMSKSPNKHNRLYMEARPMEEGLAEAIDEGRIGPRDDPKARAKILSEEFGWDKDLAKKIWCFGPETTGPNMVVDMCKGVQYLNEIKDSVVAGFQWASKEGAVAEENMRGICFEVCDVVLHADAIHRGGGQVIPTARRVIYAAQLTAKPRLLEPVYLVEIQAPEQALGGIYGVLNQKRGHVFEELQRPGTPLYNIKAYLPVIESFGFSSTLRAATSGQAFPQCVFDHWDMMSSDPLDSGSQAAQIVSDIRKRKGLKEQMTPLSEYEDKL

SEQ ID NO: 5348 - protein, 831 aa, Cannabis sativa
MDLKENIRNMSVIAHVDHGKSTLTDSLVAAAGIIAQEVAGDVRMTDTRADEAERGITIKSTGISLYYQMSDESLSCYKGERKGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFANMYASKFGVDESKMMERLWGENFFDPATKKWTSKNTGSPTCKRGFVQFCYEPIRQIIATCMNDQKDKLWPMLKKLNVTMKNDEKELMGKALMKRVMQTWLPASSALLEMMIFHLPSPATAQKYRVENLYEGPLDDQYATAIRNCDPNGPLMLYVSKMIPASDKGRFFAFGRVFAGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSVRTVMSKSPNKHNRLYMEARPLEEGLAEAIDDGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEGALGGIYSVLNQKRGHVFEEMQRQGTPLYNIKAYLPVIESFGFSATLRAATSGQAFPQCVFDHWDMMSSDPLEAGTQASVLVADIRKRKGLKEQMTPLSEFEDKL

SEQ ID NO: 5349 - protein, 843 aa, Podocarpus macrophillus
MVKFTAEELRRIMDFKHNIRNMSVIAHVDHGKSTLTDSLVAAAGIIAQEVAGDVRMTDTRQDEAERGITIKSTGISLYYEMSDESLKRYTGERNGNEYLINLIDSPGHVDFSSEVTAALRITDGALVVVDCIEGVCVQTETVLRQALGERIRPVLTVNKMDRCFLELQVEGEEAYQTFLRVIENANVIMATYEDPLLGDCQVYPEKGTVAFSAGLHGWAFTLTNFAKMYASKFGVDEAKMMERLWGENFFDPATKKWTTKNTGSPTCKRGFVQFIYEPIKQIIKICMNDQKDKLWPMLQKLGVVMKSDEKDLVGKPLMKRVMQTWLPASTALLEMMIFHLPSPSKAQKYRVENLYEGPLDDIYANAIRNCDPEGPLMLYVSKMIPASDKGRFFAFGRVFAGKVSTGMKVRIMGPNYVPGQKKDLYVKSVQRTVIWMGKRQESVEDVPCGNTVAMVGLDQYITKNATLTSEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSIRTVMSKSPNKHNRLYFEARPLEEGLPEAIDEGRIGPRDDPKARAKILSEEFGWDKDLAKKIWCFGPETTGPNMVVDMCKGVQYLNEIKDSVVAAFQWASKEGALAEENMRGICFEVCDVVLHTDAIHRGGGQIIPTARRVMYAAQLTAKPRLLEPVYLVEIQAPEQALGGIYGVLNQKRGHVFEEMQRPGTPLYNIKAYLPVVESFGFSGTLRAATSGQAFPQCVFDHWDMMNSDPMDAGTQAHSLVIDIRKRKGLKEQMTPLSDFEDKL

SEQ ID NO: 5350 - protein, 843 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDESLKAYKGERMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTSSPTCKRGFVQFCYEPIKQIIATCMNDQKDKLWPMLQKLGVTMKNDEKELIGKPLMKRVMQTWLPAATALLEMMIYHLPSPHTAQKYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEPGTQAAELVTDIRKRKGLKAQMTPLSDFEDKL

SEQ ID NO: 5351 - protein, 843 aa, Rosa hybrid cultivar
MVKFTAEELRRIMDYKHNIRNMSVIAHVDHGKSTLTDSLVAAAGIIAQETAGDVRMTDTRADEAERGITIKSTGISLYYEMTDESLASFKGERNGNEYLINLIDSPGHVDFSSEVTAALRITDGALVVVDCIEGVCVQTETVLRQALGERIRPVLTVNKMDRCFLELQVDGEEAYQNFQRVIENANVIMATYEDPLLGDVQVYPEKGTVAFSAGLHGWAFTLTNFAKMYAEKFKVDEAKMMERLWGENFFDPATKKWTSKNTGSATCKRGFVQFCYEPIKQVIATCMNDQKDKLWPMLAKLGITMKGDEKDLMGKPLMKRVMQTWLPASTALLEMMIFHLPSPSTAQKYRVENLYEGPLDDRYATAIRNCDPDGPLMLYVSKMIPASDKGRFFAFGRVFAGRVQTGLKVRIMGPNYVPGEKKDLYVKNVQRTVIWMGKKQETVEDVPCGNTVALVGLDQFITKNATLTNEKESDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLEKSVRTVMSKSPNKHNRLYMEARPLEEGLAEAIDDGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEGALGGIYSVLNQKRGHVFEEIQRPGTPLYNIKAYLPVVESFGFSGQLRASTSGQAFPQCVFDHWEMMSSDPLEAGSQASQLVQDIRKRKGLKEQMTPLSDFEDKL

SEQ ID NO: 5352 - protein, 843 aa, Helianthus annuus
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKKWTTKSTGTATCKRGFVQFCYEPIKQIINTCMNDQKDQLWPMLTKLGVTMKSEEKELMGKALMKRVMQNWLPAATALLEMMIFHLPSPHTAQRYRVENLYEGPLDDQYANAIRNCDPDGPLMLYVSKMIPASDKGRFFAFGRVFAGRVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEDGLAEAIDEGRVGPRDDPKVRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRPGTPLYNIKAYLPVVESFGFSGALRASTSGQAFPQCVFDHWDMMGSDPLEAGSQASTLVTQIRKRKGLKEQMTPLSEFEDKL

SEQ ID NO: 5353 - protein, 843 aa, Vinca minor
MVKFTAEELRRIMDLKHNIRNMSVIAHVDHGKSTLTDSLVAAAGIIAQEVAGDVRMTDTRADEAERGITIKSTGISLYYEMTEEALRNFKGERVGNEYLINLIDSPGHVDFSSEVTAALRITDGALVVVDCVEGVCVQTETVLRQALGERIRPVLTVNKMDRCFLELQVDGEEAYQTFQKVIENANVIMATYEDPLLGDVMVYPEKGTVAFSAGLHGWAFTLTNFAKMYASKFGVDESKMMERLWGENFFDPATKKWTSKNTGSPTCKRGFVQFCYEPIKQIIKICMNDQKDKLWPMLQKLGVSMKSEEKELMGKALMKRVMQTWLPASTALLEMMIYHLPSPDKAQRYRVENLYEGPLDDMYANAIRNCDPEGPLMLYVSKMIPASDKGRFFAFGRVFSGKVSTGLKVRIMGPNYVPGEKKDLYVKNVQRTVIWMGKRQETVEDVPCGNTVALVGLDQFITKNATLTNEKETDAHPIRAMKFSVSPVVRVAVQCKVASDLPKLVEGLKRLSKSDPMVICSIEESGEHIIAGAGELHLEICLKDLVDDFMGGAEIIKSDPVVSFRETVLEKSCRTVMSKSPNKHNRLYMEARPLEEGLAEAIDDGRIGPRDDPKVRAKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQITAKPRLLEPVYLVEIQAPEQALGGIYSVLNQKRGHVFEEMQRPGTPLYNIKAYLPVVESFGFSSTLRAATSGQAFPQSVFDHWEMMMSDPLEAGSQAATLVADIRKRKGLKEQMTPLSDFEDKL

SEQ ID NO: 5354 - protein, 843 aa, Cicer arietinum
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSPSCKRGFVQFCYEPIKQIINTCMNDQKDKLWPMLTKLGVTMKSEEKDLMGKALMKRVMQTWLPASSALLEMMIFHLPSPSTAQRYRVENLYEGPLDDQYANAIRNCDPEGPLMLYVSKMIPASDKGRFFAFGRVFAGKVSTGLKVRIMGPNYVPGEKKDLYVKSVQRTVIWMGKRQETVEDVPCGNTVAMVGLDQYITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLDRSCRTVMSKSPNKHNRLYMEARPLEDGLAEAIDEGTIGPRDDPKIRSKILSEQYGWDKDLAKKIWCFGPETTGPNMVVDMCKGVQYLNEIKDSVVAGFQWASKEGALAEENMRAICFEVCDVVLHTDAIHRGGGQIIPTARRVFYASQLTAKPRLLEPVYLVEIQAPEQALGGIYSVLNQKRGHVFEEMQRPGTPLYNIKAYLPVVESFGFSSQLRAATSGQAFPQCVFDHWDMMSSDPLEAGSQAATLVTDIRKRKGLKEQMTPLSEFEDKL

SEQ ID NO: 5355 - protein, 843 aa, Olea europaea
MVKFTADELRRIMDYKHNIRNMSVIAHVDHGKSTLTDSLVAAAGIIAQEVAGDVRMTDTRADEAERGITIKSTGISLYYEMSDASLKSYTGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSATCKRGFVQFCYEPIKQIINTCMNDQKDKLWPMLQKLGVVMKSDEKDLMGKPLMKRVMQTWLPASTALLEMMIFHLPSPSKAQRYRVENLYEGPMDDVYATAIRNCDPDGPLMLYVSKMIPASDKGRFFAFGRVFSGKVSTGLKVRIMGPNYVPGEKKDLYVKSVQRTVIWMGKRQETVEDVPCGNTVAMVGLDQYITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLERSCRTVMSKSPNKHNRLYMEARPLEEGLAEAIDDGRIGPRDDPKVRSKILSEEFGWDKELAKKIWCFGPETTGPNMVVDMCKGVQYLNEIKDSVVAGFQWASKEGPLAEENMRGICFEVCDVVLHADAIHRGGGQVIPTARRVIYASHITAKPRLLEPVYMVEIQAPEQALGGIYSVLNQKRGHVFEELQRPGTPLYNIKAYLPVIESFGFSSTLRAATSGQAFPQCVFDHWDMMSSDPLEPGSQASQLVTDIRKRKGLKEQMTPLSEYEDRL

SEQ ID NO: 5356 - protein, 843 aa, Amsonia hubrichtii
MVKFTVDGLRRIMDYKHNIRNMSVIAHVDHGKSTLTDSLVAAAGIIAQEVAGDVRMTDTRADEAERGITIKSTGISLYYEMTDEALRGFKGERQGNEYLINLIDSPGHVDFSSEVTAALRITDGALVVVDCVEGVCVQTETVLRQALGERIRPVLTVNKMDRCFLELQVDGEEAYQTFQKVIENANVIMATYEDPLLGDVQVYPEKGTVAFSAGLHGWAFTLSNFAKMYASKFGVYESKMMERLWGENFFDPATKKWTNKNTGSPTCKRGFVQFCYEPIKQIISTCMNDQKDKLWPMLQKLGVTMKSEEKDLMGKALMKRVMQTWLPASNALLEMMIHHLPSPAKAQKYRVENLYEGPLDDAYANAIRNCDPEGPLMLYVSKMIPASDKGRFFAFGRVFAGKVSTGLKVRIMGPNYVPGEKKDLYVKNVQRTVIWMGKRQETVDDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSCRTVMSKSPNKHNRLYMEARPLEEGLAEAIDDGRIGPRDDPKVRAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEQALGGIYSVLNQKRGHVFEEMQRPGTPLYNIKAYLPVIESFGFSGTLRAATSGQAFPQCVFDHWDMMSSDPLEPGSQASQLVADIRKRKGLKEQMTPLSEFEDKL

SEQ ID NO: 5357 - protein, 843 aa, Catharanthus roseus
MVKFTAEELRRIMDYKHNIRNMSVIAHVDHGKSTLTDSLVAAAGIIAQEVAGDVRMTDTRADEAERGITIKSTGISLYYEMTDDALRAYKGERQGNEYLINLIDSPGHVDFSSEVTAALRITDGALVVVDCVEGVCVQTETVLRQALGERIRPVLTVNKMDRCFLELQVDGEEAYQTFQKVIENANVIMATYEDPLLGDVQVYPERGTVAFSAGLHGWAFTLSNFAKMYASKFGVDESKMMERLWGENFFDPATKKWTSKNTGSPTCKRGFVQFCYEPIKQIINTCMNDQKDKLWPMLTKLGVTMKNEEKELMGKALMKRVMQTWLPASTALLEMMIYHLPSPAKAQKYRVENLYEGPLDDMYATAIRNCDPEGPLMLYVSKMIPASDKGRFFAFGRVFAGKVSTGLKVRIMGPNYVPGEKKDLYVKNVQRTVIWMGKRQETVDDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIIKSDPVVSFRETVLEKSCRTVMSKSPNKHNRLYMEARPMEEGLAEAIDDGRIGPRDDPKVRAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEQALGGIYSVLNQKRGHVFEEMQRPGTPLYNIKAYLPVIESFGFSGQLRAATSGQAFPQCVFDHWDMMSSDPLEAGSQAALLVADIRKRKGLKEQMTPLSEYEDKL

SEQ ID NO: 5358 - protein, 843 aa, Citrus clementina
MVKFTAEELRRIMDFKHNIRNMSVIAHVDHGKSTLTDSLVAAAGIIAQEVAGDVRMTDTRQDEAERGITIKSTGISLYYEMTDAALKSFKGERQGNEYLINLIDSPGHVDFSSEVTAALRITDGALVVVDCIEGVCVQTETVLRQALGERIRPVLTVNKMDRCFLELQVDGEEAYQTFQKVIENANVIMATYEDPLLGDVQVYPEKGTVAFSAGLHGWAFTLTNFAKMYASKFGVDESKMMERLWGENFFDPATRKWTSRNTGSPTCKRGFVQFCYEPIKQIINICMNDEKDKLWPMLQKLGVTMKSEEKELMGKALMKRVMQTWLPASSALLEMMIFHLPSPATAQKYRVENLYEGPLDDAYANAIRNCDPEGPLMLYVSKMIPASDKGRFFAFGRVFSGKVATGLKVRIMGPNYVPGEKKDLYVKSVQRTVIWMGKKQETVEDVPCGNTVAMVGLDQYITKNATLTNEKEVDAHPIRAMKFSVSPVVRVAVQCKVASDLPKLVEGLKRLAKSDPMVVCSMEESGEHIIAGAGELHLEICLKDLQDDFMGGAEIIKSDPVVSFRETVLEKSCRTVMSKSPNKHNRLYMEARPLEEGLAEAIDDGRIGPRDDPKVRSKILSEEFGWDKDLAKKIWCFGPETIGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSSTLRAATSGQAFPQCVFDHWDMMSSDPLEPGSQASQLVLDIRKRKGLKEQMTPLSEYEDKL

SEQ ID NO: 5359 - protein, 843 aa, Distylium racemosum
MVKFTAEELRRIMDLKHNIRNMSVIAHVDHGKSTLTDSLVAAAGIIAQEVAGDVRMTDTRADEAERGITIKSTGISLYYEMTDAELKSFKGERMGNEYLINLIDSPGHVDFSSEVTAALRITDGALVVVDCIEGVCVQTETVLRQALGERIRPVLTVNKMDRCFLELQVDGEEAFQTFSRVIENANVIMATYEDPLLGDCQVYPDKGTVAFSAGLHGWAFTLTNFAKMYASKFGVDEGKMMERLWGENFFDPATKKWTTKNTGSGTCKRGFVQFIYEPIKQIINICMNDQKDKLWPMLQKLGVVMKGEEKELLGKHLMKRVMQTWLPASKALLEMMIFHLPSPSKAQRYRVENLYEGPLDDMYANAIRNCDPEGPLMLYVSKMIPASDKGRFFAFGRVFAGKVSTGMKVRIMGPNYVPGQKKDLYVKSVQRTVIWMGKRQESVEDVPCGNTVAMVGLDQYITKNATLTNEKEVDAHPIRAMKFSVSPVVRVAVQCKVASDLPKLVEGLKRLAKSDPMVMCSIEESGEHIIAGAGELHLEICLKDLQDDFMGGAEIVVSDPVVSFRETVLEKSCRTVMSKSPNKHNRLYFEARPLEEGLPEAIDDGRIGPRDDPKARSKILSEEFGWDKDLAKKIWCFGPETTGPNMVVDMCKGVQYLNEIKDSVVAAFQWASKEGALAEENMRGICFEVCDVVLHTDAIHRGGGQIIPTARRVMYAAQITAKPRLLEPVYLVEIQAPEQALGGIYGVLNQKRGHVFEEMQRPGTPLYNIKAYLPVIESFGFSGTLRAATSGQAFPQCVFDHWDMMNSDPMDHGTPAYNLVTDIRKRKGLKEQMTPLSEFEDKL

SEQ ID NO: 5360 - protein, 843 aa, Euphorbia peplus
MVKFTAEELRRIMDLKHNIRNMSVIAHVDHGKSTLTDSLVAAAGIIAQEVAGDVRMTDTRADEAERGITIKSTGISLYYEMTDASLKSFKGERMGNEYLINLIDSPGHVDFSSEVTAALRITDGALVVVDCIEGVCVQTETVLRQALGERIKPVLTVNKMDRCFLELQVDGEEAFQTFSRVIENANVIMATYEDPLLGDCQVYPEKGTVAFSAGLHGWAFTLTNFAKMYASKFGVDESKMMERLWGENFFDPATRKWTTKNTGTATCKRGFVQFCYEPIKQVINTCMNDQKDKLWPMLQKLGISIKSEEKDLMGKPLMKRVMQTWLPASSALLEMMIFHLPSPSTAQRYRVENLYEGPLDDMYANAIRNCDPEGPLMLYVSKMIPASDKGRFFAFGRVFAGKVSTGLKVRIMGPNYVPGEKKDLYTKSVQRTVIWMGKKQETVEDVPCGNTVALVGLDQYITKNATLTNEKEVDAHPIRAMKFSVSPVVRVAVQCKVASDLPKLVEGLKRLAKSDPMVVCSIEESGEHIIAGAGELHLEICLKDLVDDFMGGAEIIKSDPVVSFRETVLEKSCRIVMAKSPNKHNRLYMEARPLEDGLAEAIDDGRIGPRDDPKVRSKILAEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPEQALGGIYSVLNQKRGHVFEEMQRPGTPLYNIKAYLPVVESFGFSGTLRQATSGQAFPQCVFDHWDMMTSDPLDPTSQAATLIMDIRKRKGLKQQMTPLSEFEDKL

SEQ ID NO: 5361 - protein, 843 aa, Citrus sinensis
MVKFTAEELRRIMDFKHNIRNMSVIAHVDHGKSTLTDSLVAAAGIIAQEVAGDVRMTDTRQDEAERGITIKSTGISLYYEMTDAALKSYRGERQGNEYLINLIDSPGHVDFSSEVTAALRITDGALVVVDCIEGVCVQTETVLRQALGERIRPVLTVNKMDRCFLELQVDGEEAYQTFQKVIENANVIMATYEDPLLGDVQVYPEKGTVAFSAGLHGWAFTLTNFAKMYASKFGVDESKMMERLWGENFFDPATRKWTSRNTGSPTCKRGFVQFCYEPIKQIINICMNDEKDKLWPMLQKLGVTMKSEEKELMGKALMKRVMQTWLPASSALLEMMIFHLPSPATAQKYRVENLYEGPLDDAYANAIRNCDPEGPLMLYVSKMIPASDKGRFFAFGRVFSGKVATGLKVRIMGPNYVPGEKKDLYVKSVQRTVIWMGKKQETVEDVPCGNTVAMVGLDQYITKNATLTNEKEVDAHPIRAMKFSVSPVVRVAVQCKVASDLPKLVEGLKRLAKSDPMVVCSMEESGEHIIAGAGELHLEICLKDLQDDFMGGAEIIKSDPVVSFRETVLEKSCRTVMSKSPNKHNRLYMEARPLEEGLAEAIDDGRIGPRDDPKVRSKILSEEFGWDKDLAKKIWCFGPETIGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSSTLRAATSGQAFPQCVFDHWDMMSSDPLEPGSQASQLVLDIRKRKGLKEQMTPLSEYEDKL

SEQ ID NO: 5362 - protein, 843 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDESLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTASPTCKRGFVQFCYEPIKQIIATCMNDQKDKLWPMLQKLGVTMKNDEKELIGKPLMKRVMQTWLPAATALLEMMIYHLPSPHTAQKYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEQGTQASDLVTEIRRRKGLKAQMTPLSDFEDKL

SEQ ID NO: 5363 - protein, 843 aa, Pseudotsuga menziesii
MVKFTAEGLRGIMDRKHNIRNMSVIAHVDHGKSTLTDSLVAAAGIIAQEVAGDVRMTDTRADEAERGITIKSTGISLYYEMEDAAVRNFKGDRVGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDESKMMERLWGENFFDPATKKWTTKNTGSATCKRGFVQFIYEPIKQIINICMNDQKDKLWPMLQKLGVVMKSDEKELVAKALMKRVMQTWLPASSALLEMMIFHLPSPAKAQRYRVENLYEGPLDDVYATAIRNCDPEGPLMLYVSKMIPASDKGRFFAFGRVFAGKVATGMKVRIMGPNYVPGQKKDLYTKSVQRTVIWMGKKQESVEDVPCGNTVAMVGLDQFITKNATLTGEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSCRTVMSKSPNKHNRLYFEARPLEDGLPEAIDDGRIGPKDDPKARAKILSEEFGWDKDLAKKIWCFGPETTGPNMVVDMCKGVQYLNEIKDSVVAAFQWASKEGALAEENMRGICFEVCDVVLHTDAIHRGGGQVIPTARRVMYASQLTAKPRLLEPVYLVEIQAPEQALGGIYGVLNQKRGHVFEEMQRPGTPLYNIKAYLPVVESFGFSSTLRAATSGQAFPQCVFDHWDMMGSDPLEAGSQAGQLVTDIRKRKGLKESMTPLSEYEDKL

SEQ ID NO: 5364 - protein, 843 aa, Helianthus annuus
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKKWTTKSTGTATCKRGFVQFCYEPIKQIINTCMNDQKDQLWPMLTKLGVTMKSEEKELMGKALMKRVMQNWLPAATALLEMMIFHLPSPHTAQRYRVENLYEGPLDDQYANAIRNCDPDGPLMLYVSKMIPASDKGRFFAFGRVFAGRVSTGLKVRIMGPNYVPGEKKDLYVKSVQRTVIWMGKKQETVEDVPCGNTVAMVDLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEDGLAEAIDEGRVGPRDDPKVRAKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRPGTPLYNIKAYLPVVESFGFSGALRASTSGQAFPQCVFDHWDMMGSDPLEAGSQASTLVTQIRKRKGLKEQMTPLSEFEDKL

SEQ ID NO: 5365 - protein, 843 aa, Trigonella foenum-graecum
MVKFTADELRRIMDYKHNIRNMSVIAHVDHGKSTLTDSLVAAAGIIAQEVAGDVRMTDTRADEAERGITIKSTGISLYYEMTDESLQSFKGERDGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDETKMMERLWGENFFDPATKKWTTKNTGSATCKRGFVQFCYEPIKQVINTCMNDQKDKLWPMLTKLGITMKSEEKDLIGKPLMKRVMQTWLPASTALLEMMIFHLPSPSTAQRYRVENLYEGPLDDQYATAIRNCDPEGPLMLYVSKMIPASDKGRFFAFGRVFAGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLVDDFMGGAEIIVSDPVVSFRETVLERSCRTVMSKSPNKHNRLYMEARPLEDGLAEAIDDGKIGPRDEPKNRSKILSEEYGWDKDLAKKIWCFGPETTGPNMVVDMCKGVQYLNEIKDSVVAGFQWASKEGALSEENMRAVCFEVCDVVLHTDAIHRGGGQIIPTARRVFYASQLTAKPRLLEPVYMVEIQAPEQALGGIYSVLNQKRGHVFEEMQRPGTPLYNIKAYLPVIESFGFSSQLRAATSGQAFPQCVFDHWDMMSSDPLEAGSQAAQLVTDIRKRKGLKEQMTPLSEFEDKL

SEQ ID NO: 5366 - protein, 843 aa, Vinca minor
MVKFTAEGLRRIMDYKHNIRNMSVIAHVDHGKSTLTDSLVAAAGIIAQEVAGDVRMTDTRADEAERGITIKSTGISLYYEMTDDALRGFHGEREGNEYLINLIDSPGHVDFSSEVTAALRITDGALVVVDCVEGVCVQTETVLRQALGERIRPVLTVNKMDRCFLELQVDGEEAYQTFQKVIENANVIMATYEDPLLGDVMVYPEKGTVAFSAGLHGWAFTLSNFSKMYASKFGVDESKMMERLWGENFFDPATKKWTSKNTGSPTCKRGFVQFCYEPIKQIISTCMNDQKDKLWPMLQKLGVTMKSDEKDLMGKALMKRVMQTWLPASTALLEMMIYHLPSPSKAQRYRVENLYEGPLDDVYANAIRNCDPDGPLMLYISKMIPASDKGRFFAFGRVFAGKVSTGLKVRIMGPNYVPGEKKDLYVKNVQRTVIWMGKRQETVDDVPCGNTVALVGLDQFITKNATLTNEKETDAHPIRAMKFSVSPVVRVAVQCKVASDLPKLVEGLKRLAKSDPMVVCTIEESGEHIIAGAGELHLEICLKDLVDDFMGGAEIIKSDPVVSFRETVLEKSCRTVMSKSPNKHNRLYMEARPLEEGLAEAIDDGRIGPRDDPKLRAKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQITAKPRLLEPVYLVEIQAPEQALGGIYSVLNQKRGHVFEEMQRPGTPLYNIKAYLPVVESFGFSATLRAATSGQAFPQCVFDHWEMMSSDPMEPGSQASQLVSEIRKRKGLKEQMTPLSEFEDKL

SEQ ID NO: 5367 - protein, 848 aa, Citrullus lanatus
EIVCVQVKFTAEELRRIMDFKHNIRNMSVIAHVDHGKSTLTDSLVAAAGIIAQEVAGDVRMTDTRQDEAERGITIKSTGISLYYEMSDESLKSYKGERQGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKNTGSPTCKRGFVQFCYEPIKQIIATCMNDQKDKLWPMLQKLGVVMKSEEKDLMSKALMKRVMQTWLPASNALLEMMIFHLPSPATAQKYRVENLYEGPLDDAYASAIRSCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVLERSCRTVMSKSPNKHNRLYMEARPMEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAAQLVADIRKRKGLKEQMTPLSEFEDKL

SEQ ID NO: 5368 - protein, 405 aa, Artemisia annua
MVKFTAEELRRIMDYKHNIRNMSVIAHVDHGKSTLTDSLVAAAGIIAQETAGDVRMTDTRADEAERGITIKSTGISLYYEMTDEALKSFKGERDGNEYLINLIDSPGHVDFSSEVTAALRITDGALVVVDCIEGVCVQTETVLRQALGERIRPVLTVNKMDRCFLELQVDGEEAYQNFQRVIENANVIMATYEDPLLGDVMVYPEKGTVAFSAGLHGWAFTLTNFAQMYASKFGVDESKMMERLWGENFFDPKTKKWTTKNTGTATCKRGFVQFCYEPIKQIINTCMNDQKDILWPMLSKLGITMKSEEKELMGKTLMKRVMQNWLPAATALLEMMIFHLPSPHTAQRYRVENLYEGPLDDQYANAIRNCDPNGPLMLYVSKMIPASDKGRFFVVVFLLERFQLV

SEQ ID NO: 5369 - protein, 456 aa, Cephalotaxus harringtonia
MVKFTAEELRRIMDLKHNIRNMSVIAHVDHGKSTLTDSLVAAAGIIAQEVAGDVRMTDTRADEAERGITIKSTGISLYYEMSDESLKSYKGERMGNEYLINLIDSPGHVDFSSEVTAALRITDGALVVVDCIEGVCVQTETVLRQALGERIRPVLTVNKMDRCFLELQVEGEEAYQTFLRVIENANVIMATYEDPLLGDCQVYPEKGTVAFSAGLHGWAFTLTNFAKMYASKFGVDESKMMERLWGENFFDPATKKWTSKNTGSPTCKRGFVQFIYEPIKQIINICMNDQKDKLWPMLQKLGVVMKSEEKDLAGKALMKRVMQTWLPASSALLEMMIFHLPSPSIAQRYRVENLYEGPLDDVYATAIRNCDPEGPLMLYVSKMIPASDKGRFFAFGRVFAGKVSTGQKVRIMGPNYVPGQKKDLYVKSVQRTVIWMGKNKSLLRMCPVEIRWLWLG

SEQ ID NO: 5370 - protein, 508 aa, Trigonella foenum-graecum
MIFHLPSPSTAQRYRVENLYEGPLDDQYANAIRNCDPEGPLMLYVSKMIPASDKGRFFAFGRVFAGKVSTGMKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVIDRSIRTVMSKSPNKHNRLYMEARPLEDGLAEAIDEGTIGPRDDPKNRSKILSEQYGWDKDLAKKIWCFGPETTGPNMVVDMCKGVQYLNEIKDSVVAGFQWASKEGALSEENMRGICFEVCDVVLHTDAIHRGGGQIIPTARRVFYASQLTAKPRLLEPVYMVEIQAPEQALGGIYSVLNQKRGHVFEEMQRPGTPLYNIKAYLPVVESFGFSSQLRAATSGQAFPQCVFDHWDTMGSDPLEAGTQSAQLVMDIRKRKGLKETMTPLSEFEDKL

SEQ ID NO: 5371 - protein, 848 aa, Cajanus cajan
LCLYLQVKFTAEELRRIMDHKHNIRNMSVIAHVDHGKSTLTDSLVAAAGIIAQEVAGDVRMTDTRADEAERGITIKSTGISLYYEMTDEALKNYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMDRLWGENFFDPATKKWTSKNTGSATCKRGFVQFCYEPIKQIINTCMNDQKDKLWPMLQKLGVNMKSDEKELMGKALMKRVMQTWLPASSALLEMMIFHLPSPSTAQKYRVENLYEGPLDDQYAAAIRNCDPEGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIIKSDPVVSFRETVLERSCRTVMSKSPNKHNRLYMEARPLEEGLAEAIDDGKIGPRDDPKVRSKILSEEFGWDKDLAKKIWCFGPETLGPNMVVDMCKGVQYLNEIKDSVVAGFQWASKEGALAEENMRAICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQAAQLVTDIRKRKGLKEQMTPLSEFEDKL

SEQ ID NO: 5372 - protein, 406 aa, Cicer arietinum
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSPSCKRGFVQFCYEPIKQIINTCMNDQKDKLWPMLTKLGVTMKSEEKDLMGKALMKRVMQTWLPASSALLEMMIFHLPSPSTAQRYRVENLYEGPLDDQYANAIRNCDPEGPLMLYVSKMIPASDKGSFLLLVVYLLVRFQQV

SEQ ID NO: 5373 - protein, 843 aa, Cicer arietinum
MVKFTADELRRIMDYKHNIRNMSVIAHVDHGKSTLTDSLVAAAGIIAQEVAGDVRMTDTRADEAERGITIKSTGISLYYEMSDESLKSYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSPSCKRGFVQFCYEPIKQIINTCMNDQKDKLWPMLTKLGVTMKSEEKDLMGKALMKRVMQTWLPASSALLEMMIFHLPSPSTAQRYRVENLYEGPLDDQYATAIRNCDPEGPLMLYVSKMIPASDKGRFFAFGRVFAGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLDRSCRTVMSKSPNKHNRLYMEARPLEDGLAEAIDEGTIGPRDDPKIRSKILSEQYGWDKDLAKKIWCFGPETTGPNMVVDMCKGVQYLNEIKDSVVAGFQWASKEGALAEENMRAICFEVCDVVLHTDAIHRGGGQIIPTARRVFYASQLTAKPRLLEPVYLVEIQAPEQALGGIYSVLNQKRGHVFEEMQRPGTPLYNIKAYLPVVESFGFSSQLRAATSGQAFPQCVFDHWDMMSSDPLEAGSQAATLVIDIRKRKGLKEQMTPLSEFEDKL

SEQ ID NO: 5374 - protein, 843 aa, Mimulus guttatus
MVKFTAEELRRIMDLKHNIRNMSVIAHVDHGKSTLTDSLVAAAGIIAQEVAGDVRMTDTRADEAERGITIKSTGISLYYEMSPESLASYKGERSGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTTKNTGSASCKRGFVQFCYEPIKQIIATCMNDLKDKLWPMLKKLGVTMKSDEKDLIGKALMKRVMQTWLPASSALLEMMIFHLPSPATAQRYRVENLYEGPLDDIYATAIRNCDPDGPLMLYVSKMIPASDKGRFFAFGRVFAGKVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKHASDLPKLVEGLKRLAKSDPMVVCSIEESGEHIIAGAGELHLEICLKDLVDDFMGGAEIIKSDPVVSFRETVLDRSVRTVMSKSPNKHNRLYMEARPLEDGLAEAIDDGKIGPRDDPKIRSKLLSEEFGWDKELAKKIWAFGPETTGPNMVVDMCKGVQYLNEIKDSVVAGFQWASKEGPLAEENMRGVCFEVCDVVLHTDAIHRGGGQVIPTARRVIYASMITAKPRLLEPVYLVEIQAPEQALGGIYSVLNQKRGHVFEEMQRPGTPLYNIKAYLPVVESFGFSSTLRAATSGQAFPQCVFDHWEMMASDPLQAESQAAVLVADIRKRKGLKVTMTPLSDFEDKL

SEQ ID NO: 5375 - protein, 843 aa, Euonymus alatus
MVKFTADGLRRIMDLKHNIRNMSVIAHVDHGKSTLTDSLVAAAGIIAQEVAGDVRMTDTRADEAERGITIKSTGISLYYEMSDESLMSYKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENYFDPATRKWTTKNTGASSCKRGFVQFCYEPIKQIINTCMNDQKDKLWPMLQKLGVTMKSDEKELMGKPLMKRVMQTWLPASRALLEMMIFHLPSPSMAQRYRVENLYEGPMDDQYATAIRNCDPEGPLMLYVSKMIPASDKGRFFAFGRVFSGKVATGAKVRIMGPNYVPGEKKDLYVKNVQRTVIWMGKKQETVEDVPCGNTVALVGLDQFITKNATLTNEKEVDAHPIRAMKFSVSPVVRVAVQCKVASDLPKLVEGLKRLSKSDPMVVCSIEESGEHIIAGAGELHLEICLKDLQDDFMGGAEIIKSDPVVSFRETVLEKSSRTVMSKSPNKHNRLYMEARPLEEGLPEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYMVEIQAPEQALGGIYSVLNQKRGHVFEEIQRPGTPLYNIKAYLPVVESFGFSANLRAATSGQAFPQSVFDHWDMMMSDPLDPTSQAGILVHDIRKRKGLKEQMTPLSEFEDKL

SEQ ID NO: 5376 - protein, 843 aa, Vitis vinifera
MVKFTVEELRRIMDYKHNIRNMSVIAHVDHGKSTLTDSLVAAAGIIAQEVAGDVRMTDTRQDEAERGITIKSTGISLYYEMSDESLKNYRGERQGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDESKMMERLWGENFFDPSTRKWTTKNTGAPNCKRGFVQFCYEPIKQIINTCMNDQKDKLWPMLQKLGVTMKSDEKDLMGKALMKRVMQTWLPASTALLEMMIFHLPSPSTAQKYRVENLYEGPLDDIYATAIRNCDPEGPLMLYVSKMIPASDKGRFFAFGRVFSGKVSTGLKVRIMGPNYVPGEKKDLYVKSVQRTVIWMGKRQETVEDVPCGNTVAMVGLDQFITKNATLTNEKESDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLEKSCRTVMSKSPNKHNRLYMEARPLEEGLAEAIDDGRVGPRDDPKARSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEEMQRPGTPLYNIKAYLPVVESFGFSGTLRAATSGQAFPQCVFDHWDVMSADPLEAGSTAAQLVADIRKRKGLKEQMTPLSEFEDKL

SEQ ID NO: 5377 - protein, 843 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDESLKAYKGERMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTSSPTCKRGFVQFCYEPIKQIIATCMNDQKDKLWPMLQKLGVVMKNDEKELIGKPLMKRVMQTWLPAATALLEMMIYHLPSPHTAQRYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKIRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEAGTQAAELVTDIRKRKGLKAQMTPLSDFEDKL

SEQ ID NO: 5378 - protein, 647 aa, Amorphophallus konjac
MVKFTSEELRRIMDLKHNIRNMSVIAHVDHGKSTLTDSLVAAAGIIAQEVAGDVRMTDTRQDEAERGITIKSTGISLYYEMDDDKLKNFKGERNGNEYLINLIDSPGHVDFSSEVTAALRITDGALVVVDCVEGVCVQTETVLRQALGERIRPVLTVNKMDRCFLELQVEGEEAYQTFQRVIENANVIMATYEDPLLGDVQVYPEKGTVAFSAGLHGWAFTLTNFAKMYASRFGVDENKMMERLWGENYFDPATKKWTSKSTGSPSCKRGFVQFCYEPIKQIISTCMNDQKDKLWPMLQKLKVTMKSDEKELTGKALMKRVMQTWLPASDALLEMMIFHLPSPSKAQKYRVENLYEGPLDDMYANAIRNCDPDGPLMLYVSKMIPASDKGRFFAFGRVFSGKVSTGMKVRIMGPNYVPGQKKDLYVKSVQRTVIWMGKKQESVEDVPCGNTVAMVGLDQFITKNATLTNEKEVDAHPIRAMKFSVSPVVRVAVQCKVASDLPKLVEGLKRLAKSDPMVLCMIEESGEHIVAGAGELHLEICLKDLQEDFMGGAEIIVSDPVVSFRETVLEKSCRTVMSKSPNKHNRLYMEARPMEEGLAEAIDDGRIGPGTILKSVLRSWPKSLAGTRTSLRKSGVLAPKPPAQHGC

SEQ ID NO: 5379 - protein, 610 aa, Centaurea maculosa
MVKFTAEELRRIMDYKHNIRNMSVIAHVDHGKSTLTDSLVAAAGIIAQEVAGDVRMTDTRADEAERGITIKSTGISLYYEMTDAALKSFKGERDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKKWTTKNSGSPTCKRGFVQFCYEPIKQIINTCMNDQKDSLWPMLTKLGVTMKSDEKELMGKALMKRVMQTWLPAATALLEMMIFHLPSPHTAQRYRVENLYEGPLDDAYANAIRNCDPDGPLMLYVSKMIPASDKGRFFAFGRVFAGKVSTGLKVRIMGPNYVPGEKKDLYVKSVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEKDLQRPLMKESWASG

SEQ ID NO: 5380 - protein, 363 aa, Papaver somniferum
MKFSVSPVVRVAVQCKVASDLPKLVEGLKRLSKSDPMVVCTIEESGEHIIAGAGELHLEICLKDLQDDFMGGAEIIKSDPVVSFRETVLEKSSRTVMSKSPNKHNRLYMEARPLEDGLAEAIDDGRIGPRDDPKIRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEPGTQAADLVTDIRKRKGLKAQMTPLSDFEDKL

SEQ ID NO: 5381 - protein, 286 aa, Helianthus annuus
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKSGPLRAPALHPANVGSFSSVTSQLSRLSTHA

SEQ ID NO: 5382 - protein, 843 aa, Aquilegia formosa
MVKFTADELRRIMDLKHNIRNMSVIAHVDHGKSTLTDSLVAAAGIIAQETAGDVRMTDTRADEAERGITIKSTGISLYYEMSDESLKRYKGEKMGNDYLINLIDSPGHVDFSSEVTAALRITDGALVVVDCIEGVCVQTETVLRQALGERIRPVLTVNKMDRCFLELQVDGEEAYQNFQRVIENANVIMATYEDPLLGDVQVYPEKGTVAFSAGLHGWAFTLTNFAQMYASKFGVDESKMMERLWGENFFDPATKKWTTKNTGAPSCKRGFVQFCYEPIKQIIKTCMNDEKAKLWPMLQKLGVTMKGEEKELMGKPLMKRVMQTWLPASTALLEMMIFHLPSPAVAQKYRVENLYEGPLDDQYANAIRNCDPEGPLMLYVSKMIPASDKGRFFAFGRVFAGKVSTGMKVRIMGPNYIPGQKKDLYTKSVQRTVIWMGKRQESVEDVPCGNTVAMVGLDQFITKNATLTSEKEVDAHPIRAMKFSVSPVVRVAVQCKVASDLPKLVEGLKRLAKSDPMVVCSIEESGEHIIAGAGELHLEICLKDLVDDFMGGAEIIQSPPVVSFRETVLEKSSRTVMSKSPNKHNRLYMEARPLEDGLAEAIDDGRIGPRDDPKIRSKILSEEFGWDKDLAKKIWCFGPETTGPNMVVDMCKGVQYLNEIKDSVVAGFQWASKEGALCEENMRGICFEVCDVVLHADAIHRGGGQVIPTARRVIYASQLTAKPRLLEPVYMVEIQAPEQALGGIYGVLNQKRGHVFEEMQRPGTPLYNIKAYLPVIESFGFSSQLRAATSGQAFPQCVFDHWDMMSSDPLEAGSQASTLVADIRKRKGLKEQMTPLSEFEDKL

SEQ ID NO: 5383 - protein, 843 aa, Arabidopsis lyrata
MVKFTADELRRIMDYKHNIRNMSVIAHVDHGKSTLTDSLVAAAGIIAQEVAGDVRMTDTRADEAERGITIKSTGISLYYEMTDESLKSFTGARDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDETKMMERLWGENFFDPATRKWSGKNTGSPTCKRGFVQFCYEPIKQIIATCMNDQKDKLWPMLQKLGVTMKNDEKELMGKPLMKRVMQTWLPASTALLEMMIFHLPSPHTAQRYRVENLYEGPLDDQYANAIRNCDPNGPLMLYVSKMIPASDKGRFFAFGRVFAGKVSTGMKVRIMGPNYVPGEKKDLYTKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVSDRSIRTVMSKSPNKHNRLYMEARPMEDGLAEAIDDGRIGPRDDPKIRSKILAEEFGWDKDLAKKIWAFGPETTGPNMVVDMCKGVQYLNEIKDSVVAGFQWASKEGPLCEENMRGICFEVCDVVLHSDAIHRGGGQVIPTARRVIYASQITAKPRLLEPVYMVEIQAPEGALGGIYSVLNQKRGHVFEEMQRPGTPLYNIKAYLPVVESFGFSSQLRAATSGQAFPQCVFDHWEMMSSDPLEPGTQASVLVADIRKRKGLKEQMTPLSEFEDKL

SEQ ID NO: 5384 - protein, 843 aa, Brassica rapa
MVKFTADELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGSQASTLVTDIRKRKGMKEQMTPLSDFEDKL

SEQ ID NO: 5385 - protein, 843 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDESLKAYKGERMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTSSPTCKRGFVQFCYEPIKQIIATCMNDQKDKLWPMLQKLGVVMKNDEKELIGKPLMKRVMQTWLPAATALLEMMIYHLPSPHTAQKYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKIRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEAGTQAAELVTDIRKRKGLKAQMTPLSDFEDKL

SEQ ID NO: 5386 - protein, 843 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDASLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTSSPTCKRGFVQFCYEPIKQIIATCMNDQKDKLWPMLQKLGVVMKNDEKELIGKPLMKRVMQTWLPAATALLEMMIYHLPSPHTAQKYRVENLYEGPLDDKYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYMVEIQAPEGALGGIYGVLNQKRGHVFEEMQRPGTPLYNIKAYLPVVESFGFSAQLRAATSGQAFPQSVFDHWDMMMADPLEPGTQAADLVADIRKRKGLKAQMTPLSDFEDKL

SEQ ID NO: 5387 - protein, 843 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDASLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTSKRTASPTCKRGFVQFCYEPIKQIIATCMNDQKDKLWPMLQKLGVVMKNDEKELIGKPLMKRVMQTWLPAATALLEMMIYHLPSPHTAQKYRVENLYEGPLDDKYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQITAKPRLLEPVYMVEIQAPEGALGGIYGVLNQKRGHVFEEMQRPGTPLYNIKAYLPVVESFGFSAQLRAATSGQAFPQSVFDHWDMMMADPLEPGTQAAELVADIRKRKGLKIQMTPLSDFEDKL

SEQ ID NO: 5388 - protein, 776 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDESKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPLL

SEQ ID NO: 5389 - protein, 843 aa, Valeriana officinalis
MVKFTAEELRRIMDFKHNIRNMSVIAHVDHGKSTLTDSLVAAAGIIAQEVAGDVRMTDTRADEAERGITIKSTGISLYYEMNDESMRRYKGEKNGNDYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAEMYASKFGVDETKMMERLWGENFFDPATKKWTTKNSGSPTCKRGFVQFCYEPIKMVINTCMNDQKDKLWPMLTKLKVTMKNEEKDLMGKALMKRVMQAWLPASKALLEMMIYHLPSPSTAQRYRVENLYEGPLDDQYANAIRNCDPEGPLMLYVSKMIPASDKGRFFAFGRVFSGKISTGMKVRIMGPNFVPGEKKDLYTKSVQRTVIWMGKRQETVEDVPCGNTVALVGLDQYITKNATLTNEKEVDAHPIRAMKFSVSPVVRVAVQCKVASDLPKLVEGLKRLAKSDPMVVCSIEESGEHIIAGAGELHLEICLKDLVDDFMGGAEIIKSDPVVSFRETVLEKSVRTVMSKSPNKHNRLYMEARPLEDGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQITAKPRLLEPVYLVEIQAPEQALGGIYSVLNQKRGHVFEEMQRQGTPLYNIKAYLPVVESFGFSSTLRAATSGQAFPQCVFDHWDMMTSDPMDPTSQAAVLVMDIRKRKGLKQAMTPLSEFEDKL

SEQ ID NO: 5390 - protein, 843 aa, Abies balsamea
MVKFTAEELRKIMDRKHNIRNMSVIAHVDHGKSTLTDSLVAAAGIIAQEVAGDVRMTDTRADEAERGITIKSTGISLYYEMEDAAVKNFKGDRVGNEYLINLIDSPGHVDFSSEVTAALRITDGALVVVDCIEGVCVQTETVLRQALGERIKPVLTVNKMDRCFLELQVDGEEAYQTFSRVIENANVIMATYEDPLLGDCQVYPEKGTVAFSAGLHGWAFTLTNFAKMYASKFGVDEVKMMERLWGENFFDPATKKWTTKNTGSATCKRGFVQFIYEPIKQIINICMNDQKDKLWPMLQKLGVVMKSEEKELTAKALMKRVMQTWLPASSALLEMMIFHLPSPSKAQRYRVENLYEGPLDDVYATAIRNCDPEGPLMLYVSKMIPAADKGRFFAFGRVFAGRVATGMKVRIMGPNYVPGQKKDLYVKSVQRTVIWMGKRQESVEDVPCGNTVAMVGLDQFITKNATLTNEKEVDAHPIRAMKFSVSPVVRVAVQCKVASDLPKLVEGLKRLSKSDPMVVCTIEESGEHIIAGAGELHLEICLKDLQEDFMGGAEIVVSDPVVSFRETVLEKSCRTVMSKSPNKHNRLYFEARPLEDGLAEAIDDGRVGPKDDPKARAKILSEEFGWDKDLAKKIWCFGPETTGPNMVVDMCKGVQYLNEIKDSVVAAFQWASKEGALAEENMRGICFEVCDVVLHTDAIHRGGGQIIPTARRVMYASQLTAKPRLLEPVYLVEIQAPENALGGIYGVLNQKRGHVFEEMQRPGTPLYNIKAYLPVVESFGFSSALRAATSGQAFPQSIFDHWDMMGSDPLESGSQAGQLVIDIRKRKGLKENMTPLSEFEDKL

SEQ ID NO: 5391 - protein, 843 aa, Brassica napus
MVKFTADELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDEGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGSQASTLVTDIRKRKGMKEQMTPLSDFEDKL

SEQ ID NO: 5392 - protein, 843 aa, Cedrus atlantica
MVKFTAEELRKIMDRKHNIRNMSVIAHVDHGKSTLTDSLVAAAGIIAQEVAGDVRMTDTRADEAERGITIKSTGISLYYVMEDDAVKNFKGDREGHEYLINLIDSPGHVDFSSEVTAALRITDGALVVVDCIEGVCVQTETVLRQALGERIRPVLTVNKMDRCFLELQVDGEEAYQTFSRVIENANVITATYEDPLLGDCQVYPEKGTVAFSAGLHGWAFTLTNFAKMYASKFGVDEAKMMERLWGENFFDPATKKWTTKNTGSATCKRGFVQFVYEPIKQIINICMNDQKDKLWPMLQKLGVVMKSEEKELVAKALMKRVMQTWLPASSALLEMMIFHLPSPAKAQRYRVENLYEGPLDDIYATAIRNCDPEGPLMLYVSKMIPASDKGRFFAFGRVFAGRVATGMKVRIMGPNYVPGQKKDLYVKSVQRTVIWMGKRQESVEDVPCGNTVAMVGLDQFITKNATLTNEKESDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSCRTVMSKSPNKHNRLYFEARPLEDGLAEAIDEGRIGPKDDPKARAKILAEEFGWDKDLAKKIWCFGPETTGPNLVVDMCKGVQYLNEIKDSVVAAFQWASKEGALAEENMRGICFEVCDVVLHTDAIHRGGGQIIPTARRVMYASQLTAKPRLLEPVYLVEIQAPEQALGGIYGVLNQKRGHVFEELQRPGTPLYNIKAYLPVVESFGFSSTLRASTSGQAFPQCVFDHWDMMSSDPLEAGSQAGQLVTDIRKRKGLKESMTPLSEFEDKL

SEQ ID NO: 5393 - protein, 843 aa, Elaeis guineensis
MVKFTAEELRKIMDFKHNIRNMSVIAHVDHGKSTLTDSLVAAAGIIAQEVAGDVRMTDTRQDEAERGITIKSTGISLYYEMSDESLKNYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDSLLGDCQVYPEKGTVAFSAGLHGWAFTLTNFAKMYASKFGVDEGKMMERLWGENYFDSATRKWTSRNTGSPTCKRGFVQFCYEPIKQIISTCMNDQKDKLWPMLQKLGVTMKAEEKDLNGKALMKRVMQTWLPASTALLEMMIFHLPSPAKAQKYRVENLYEGPLDDIYANAIRNCDPDGPLMLYVSKMIPASDKGRFFAFGRVFSGRVNTGLKVRIMGPNYVPGEKKDLYVKSVQRTVIWMGKKQESVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQEDFMGGAEIIKSDPVVSFRETVLERSCRTVMSKSPNKHNRLYMEARPLEDGLAEAIDDGRIGPRDDPKSRSKILSEEFGWDKELAKKIWCFGPETTGPNMVVDMCKGVQYLNEIKDSVVAGFQWASKEGPLAEENMRGICFEVCDVVLHADAIHRGGGQIIPTARRVIYAAQMTAKPRLLEPVYLVEIQAPEQALGGIYSVLNQKRGHVFEEMQRPGTPLYNVKAYLPVIESFGFSGTLRAATSGQAFPQAVFDHWDMMSSDPLEPGSQTANLVADIRKRKGLKQQITPLSEYEDRL

SEQ ID NO: 5394 - protein, 82 aa, Papaver somniferum
MVKFTAEELRRIMDLKHNIRNMSVIAHVDHGKSTLTDSLVAAAGIIAQETAGDVRMTDTRADEAERGITIKSNWYLSLLRDE

SEQ ID NO: 5395 - protein, 843 aa, Helianthus annuus
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDEAKMMERLWGENFFDPKTKKWTTKNTGSASCQRGFVQFCYEPIKMIINTCTNDQKDKLWPMLTKLGVTMKSEEKELMGKALMKRVMQNWLPAATALLEMMIFHLPSPHTAQKYRVENLYEGPLDDMYANAIRNCDPDGPLMLYVSKMIPASDKGRFFAFGRVFAGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEEGLAEAIDEGRVGPRDDPKVRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRPGTPLYNIKAYLPVVESFGFSGALRASTSGQAFPQCVFDHWDMMSSDPLEVGSQASTLVTQIRKRKGLKEQMTPLSEFEDKL

SEQ ID NO: 5396 - protein, 843 aa, Brassica napus
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKDLMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDEGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQITAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGSQASTLVTDIRKRKGMKEQMTPLSDFEDKL

SEQ ID NO: 5397 - protein, 843 aa, Brassica napus
MVKFTADELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSGKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQITAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGSQASTLVTDIRKRKGMKEQMTPLSDFEDKL

SEQ ID NO: 5398 - protein, 53 aa, Vitis vinifera
MKTKQNYAHLEYHRHIPPIWSSFALFDNDHGPLIACPRTQIAGSSAPSSPSFF

SEQ ID NO: 5399 - protein, 843 aa, Eutrema halophilum
MVKFTADELRRIMDYKHNIRNMSVIAHVDHGKSTLTDSLVAAAGIIAQEVAGDVRMTDTRADEAERGITIKSTGISLYYEMSDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATRKWTGKNTGSPTCKRGFVQFCYEPIKQIIATCMNDQKDKLWPMLQKLGVQMKNDEKELMGKPLMKRVMQTWLPASTALLEMMIFHLPSPHTAQRYRVENLYEGPLDDQYATAIRNCDPNGPLMLYVSKMIPASDKGRFFAFGRVFAGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVLERSVRTVMSKSPNKHNRLYMEARPMEEGLAEAIDDGRIGPRDDPKIRSKILAEEFGWDKDLAKKIWAFGPETTGPNMVVDMCKGVQYLNEIKDSVVAGFQWASKEGPLAEENMRGICFEVCDVVLHSDAIHRGGGQVIPTARRVIYASQITAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGTQASVLVADIRKRKGLKEAMTPLSEFEDKL

SEQ ID NO: 5400 - protein, 239 aa, Taraxacum officinale
MVKFTAEELRRIMDYKHNIRNMSVIAHVDHGKSTLTDSLVAAAGIIAQEVAGDVRMTDTRADEAERGITIKSTGISLYYEMTDAALKAFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTTSRKCTRPNSVLTSPR

SEQ ID NO: 5401 - protein, 477 aa, Papaver somniferum
FTAEELRRIMDLKHNIRNMSVIAHVDHGKSTLTDSLVAAAGIIAQETAGDVRMTDTRADEAERGITIKSTGISLYYEMSDESLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTSSPTCKRGFVQFCYEPIKQIIATCMNDQKDKLWPMLQKLGVVMKNDEKELIGKPLMKRVMQTWLPAATALLEMMIYHLPSPHTAQKYRVENLYEGPLDDQYANAIRNCDPEGPLMLYVSKMIPASDKVDSLPLVVSLLVRLQQVLKSESWGLTTFLVGRRTCTPRVSRELLSGWERNRSQLRMYLVVTQLPWLDWINLLPRMQPSQTRRKLMLILSEP

SEQ ID NO: 5402 - protein, 843 aa, Amorphophallus konjac
MVKFTAEGLRRIMDLKHNIRNMSVIAHVDHGKSTLTDSLVAAAGIIAQEVAGDVRMTDTRQDEAERGITIKSTGISLYYEMEEETLKGFKGERQGNEYLINLIDSPGHVDFSSEVTAALRITDGALVVVDCVEGVCVQTETVLRQALGERIRPVLTVNKMDRCFLELQVEGEEAYQTFQRVIENANVIMATYEDPLLGDVQVYPEKGTVAFSAGLHGWAFTLSNFAKMYASRFGVDEKKMMERLWGENYFDPATKKWTTKNTGSPTCKRGFVQFCYEPIKQIISTCMNDQKDKLWPMLQKLKVNMKADEKELIGKALMKRVMQTWLPASDALLEMMIFHLPSPAKAQKYRVENLYEGPLDDIYANAIRNCDPEGPLMLYVSKMIPASDKGRFFAFGRVFSGRVSTGMKVRIMGPNYVPGQKKDLYVKSVQRTVIWMGKKQESVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIIVSDPVVSFRETVLEKSCRTVMSKSPNKHNRIYMEARPMEEGLAEAIDEGRIGPRDDPKARAKILSEEFGWDKDLAKKIWCFGPETTGPNMVVDMCKGVQYLNEIKDSVVAGFQWASKEGAVAEENMRAICFEVCDVVLHADAIHRGGGQIIPTARRVIYASQLTAKPRLLEPVYLVEIQAPEQALGGIYGVLNQKRGHVFEEMQRPGTPLYNIKAYLPVIESFGFSSTLRAATSGQAFPQCVFDHWDMLSSDPLEPGSQAWQITSDIRKRKGLKDQITPLSEYEDKL

SEQ ID NO: 5403 - protein, 843 aa, Brassica napus
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSGKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEVGSQASTLVADIRKRKGMKEQMTPLSDFEDKL

SEQ ID NO: 5404 - protein, 831 aa, Gossypium raimondii
MDRKHNIRNMSVIAHVDHGKSTLTDSLVAAAGIIAQEVAGDVRMTDTRADEAERGITIKSTGISLYYEMADESVKSFKGDRQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPASKKWTTKSTGTASCKRGFVQFCYEPIKQIINTCMNDQKDKLWPMLQKLGVTMKSDEKDLMGKALMKRVMQTWLPASSALLEMMIFHLPSPTKAQKYRVENLYEGPLDDIYANAIRNCDPEGPLMLYVSKMIPASDKGRFFAFGRVFSGKVATGMKVRIMGPNYVPGEKKDLYVKSVQRTVIWMGKKQETVEDVPCGNTVAMVGLDQFITKNATLTNEKEVEAHPIRAMKFSVSPVVRVAVQCKVASDLPKLVEGLKRLAKSDPMVVCTIEESGEHIVAGAGELHLEICLKDLQEDFMGGAEIVKSDPVVSFRETVLERSCRTVMSKSPNKHNRLYMEARPLEEGLAEAIDDGRIGPRDDPKVRSKILAEEFGWDKDLAKKIWCFGPETTGPNMVVDMCKGVQYLNEIKDSVVAGFQWASKEGALSEENMRGICFEVCDVVLHADAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMPSDPLEPNSQAANHVAEIRKRKGLKEQMTPLSEYEDKL

SEQ ID NO: 5405 - protein, 843 aa, Silene vulgaris
MVKFTAEGLRAIMDKKENIRNMSVIAHVDHGKSTLTDSLVAAAGIIAQEVAGDVRMTDTRADEAERGITIKSTGISLYYEMTDAALEAYKGKRAGNEYLINLIDSPGHVDFSSEVTAALRITDGALVVVDCIEGVCVQTETVLRQALGERIRPVLTVNKMDRCFLELQVDGEEAYTTFQKVIENANVIMATYEDPLLGDVQVYPEKGTVAFSAGLHGWAFTLTNFAKMYASKFGVDETKMMERLWGENYFDPATRKWTTKNSGSATCKRGFVQFCYEPIKQIINICMNDQKEKLWPMLTKLGVQLKSDEKDLMGKALMKRVMQTWLPASSALLEMMIYHLPSPATAQRYRVENLYEGPMDDQYATAIRNCDPDGPLMLYVSKMIPASDKGRFFAFGRVFAGKVSTGVKVRIMGPNYVPGEKKDLYIKNVQRTVIWMGKKQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVIDRSVRTVMSKSPNKHNRLYMEARPLEDGLAEAIDDGRIGPRDDPKIRSKILAEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLMEPVYLVEIQAPEGALGGIYSVLNQKRGHVFEEMQRPGTPLYNIKAYLPVVESFGFSSTLRAATSGQAFPQCVFDHWDTLGSDPLDPTSQSATLVSDIRKRKGMKQQMTPLSDFEDKL

SEQ ID NO: 5406 - protein, 351 aa, Phalaenopsis aphrodite
MVKFTAEELRRIMDLKHNIRNMSVIAHVDHGKSTLTDSLVAAAGIIAQEVAGDVRMTDTRQDEADRGITIKSTGISLYYEMADETLKNYKGERVGNEYLINLIDSPGHVDFSSEVTAALRITDGALVVVDCVEGVCVQTETVLRQALGERIRPVLTVNKMDRCFLELQVEGEEAYQTFQRVIESANVIMATYEDPLLGDVQVYPEKGTVAFSAGLHGWAFTLTNFAKMYASKFGVDESKMMERLWGENFFDPATKKWTTKNTGSPTCKRGFVQFCYEPIKQIIKTCMNDQKDKLWPMLSKLGVSMKAEEKELVGKALMKRVMQTWLPASNALLEMMIFHLPSPAKAPEVSC

SEQ ID NO: 5407 - protein, 852 aa, Aquilegia formosa
MVKFTAEELRRIMDLKHNIRNMSVIAHVDHGKSTLTDSLVAAAGIIAQEVAGDVRMTDTRADEAERGITIKSTGISLYYEMTDESLKSFKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPATKKWTSKNTGSSTCKRGFVQFCYEPIKQIINTCMNDQKDKLWPMLQKLGVTMKGEEKELLGKALMKRVMQTWLPASTALLEMMIFHLPSPSTAQRYRVENLYEGPLDDQYANAIRNCDPEGPLMLYVSKMIPASDKGRFFAFGRVFAGKVSTGMKVRIMGPNYVPGQKKDLYTKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICIKDLVDDFMGGAEIIQSPPVVSFRETVLEKSLRTVMSKSPNKHNRLYMEARPLEEGLAEAIDEGRIGPRDDPKVRSKILSEEFGWDKDLAKKIWCFGPETTGPNMVVDMCKGVQYLNEIKDSVVAGFQWASKEGALCEENMRGICFEVCDVVLHADAIHRGGGQVIPTARRVIYASQLTAKPRLLEPVYLVEIQAPEQALGGIYGVLNQKRGHVFEEMQRPGTPLYNIKAYLPVIESFGFSSQLRAATSGQAFPQCVFDHWDMMSSDPLEAGSQASTLVTEIRKRKGLKDANAPHFPNLRTSFNFRAWLSQ

SEQ ID NO: 5408 - protein, 89 aa, Brassica rapa
MSINFFLIRQRSILGDELIKTNHSNGVTTGNILNSLLPLAHPDDSPLNTLDIKIFLLTRNKVGTHDSDFHTSGHLTREYTTKSKESSLV

SEQ ID NO: 5409 - protein, 276 aa, Brassica rapa
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSGKNTGSATCKPWVCAVLL

SEQ ID NO: 5410 - protein, 406 aa, Brassica napus
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPAQTREDSLLLGVSSLERCLPV

SEQ ID NO: 5411 - protein, 541 aa, Brassica napus
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSGKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPSLLRDLRGWPSLILWLSAQWRSQVSTLLLVLESSILRFA

SEQ ID NO: 5412 - protein, 357 aa, Pinus taeda
MKFSVSPVVRVAVQCKKLVEGLKRLAKSDPMVVCTIEESGEHIIAGAGELHLEICLKDLQDDFMGGAEIVVSDPVVSFRETVLEKSCRTVMSKSPNKHNRLYFEARPLEEGLAEAIDDGRIGPKDDPKARAKILSEEFGWDKDLAKKIWCFGPETTGPNMVVDMCKGVQYLNEIKDSVVAAFQWASKEGALAEENMRGICFEVCDVVLHTDAIHRGGGQVIPTARRVMYASQLTAKPRLLEPVYLVEIQAPENALGGIYGVLNQKRGHVFEEMQRPGTPLYNIKAYLPVVESFGFSSTLRAATSGQAFPQCVFDHWDMMGSDPLEPGSQAGQLVTDIRKRKGLKESMTPLSEFEDKL

SEQ ID NO: 5413 - protein, 843 aa, Amborella trichopoda
MVKFTAEELRRIMDLKHNIRNMSVIAHVDHGKSTLTDSLVAAAGIIAQEVAGDVRMTDTRADEAERGITIKSTGISLYYEMTEESLKSFKGERNGNEYLINLIDSPGHVDFSSEVTAALRITDGALVVVDCIEGVCVQTETVLRQALGERIRPVLTVNKMDRCFLELQVDGEEAYQTFQKVIENANVIMATYEDPLLGDVQVYPEKGTVAFSAGLHGWAFTLTNFAKMYASKFGVDEAKMMERLWGENYFDPATKKWTGKNTGSPTCKRGFVQFCYEPIKQIINTCMNDQKTKLWPMLQKLGVSMKADEKELVGKALMKRVMQTWLPASEALLEMMVFHLPSPAKAQRYRVENLYEGPLDDVYANAIRNCDPEGPLMLYVSKMIPASDKGRFFAFGRVFAGKVSTGLKVRIMGPNYVPGQKKDLYVKSVQRTVIWMGKKQESVEDVPCGNTVALVGLDQFITKNATITNETEVDAHPIRAMKFSVSPVVRVAVQCKVASDLPKLVEGLKRLAKSDPMVICTIEESGEHIIAGAGELHLEICLKDLQEDFMGGAEINVSPPVVSFRETVKDKSCRTVMSKSPNKHNRLYMEARPLEEGLPEAIDEGRVGPRDDPKVRSKILSEEFGWDKDLARKIWCFGPETTGPNMVVDMCKGVQYLNEIKDSVAAGFQWASKEGALAEENMRGICFEVCDVVLHADAIHRGGGQIIPTARRVIYASQLTATPRMLEPIYLVEIQAPEQALGGIYGVLNKNRGHVFEEMQRPGTPLYNIKAYLPVVESFGFSSTLRAATSGQAFPQCVFDHWEMMNSDPFDPTSEAFRIVTEVRKRKGLKEQITPLSDYEDKL

SEQ ID NO: 5414 - protein, 843 aa, Arabidopsis thaliana
MVKFTADELRRIMDYKHNIRNMSVIAHVDHGKSTLTDSLVAAAGIIAQEVAGDVRMTDTRADEAERGITIKSTGISLYYEMTDESLKSFTGARDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVVESKMMERLWGENFFDPATRKWSGKNTGSPTCKRGFVQFCYEPIKQIIATCMNDQKDKLWPMLAKLGVSMKNDEKELMGKPLMKRVMQTWLPASTALLEMMIFHLPSPHTAQRYRVENLYEGPLDDQYANAIRNCDPNGPLMLYVSKMIPASDKGRFFAFGRVFAGKVSTGMKVRIMGPNYIPGEKKDLYTKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVCDRSTRTVMSKSPNKHNRLYMEARPMEEGLAEAIDDGRIGPRDDPKIRSKILAEEFGWDKDLAKKIWAFGPETTGPNMVVDMCKGVQYLNEIKDSVVAGFQWASKEGPLAEENMRGICFEVCDVVLHSDAIHRGGGQVIPTARRVIYASQITAKPRLLEPVYMVEIQAPEGALGGIYSVLNQKRGHVFEEMQRPGTPLYNIKAYLPVVESFGFSSQLRAATSGQAFPQCVFDHWEMMSSDPLEPGTQASVLVADIRKRKGLKEAMTPLSEFEDKL

SEQ ID NO: 5415 - protein, 843 aa, Arnica chamissonis
MVKFTAEELRRIMDLKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPKPKKWTTKSTGSATCKRGFVQFCYEPIKQIINTCMNDKKDQLWPMLTKLGVTMKSEEKELMGKALMKRVMQNWLPAATALLEMMIFHLPSPHTAQRYRVENLYEGPLDDQYANAIRNCDPEGPLMLYVSKMIPASDKGRFFAFGRVFAGRVATGMKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIIAGAGELHLEICLKDLQDDFMGGAEIVVSDPVVSFRETVLEKSSRTVMSKSPNKHNRLYMEARPMEDGLAEAIDEGRIGPRDDPKVRGKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYAAQLTSKPRLLEPVYLVEIQAPEQALGGIYSVLNQRRGHVFEEMQRPGTPLYNIKAYLPVVESFGFSGALRASTSGQAFPQSVFDHWDMMGSDPLEAGSQASTLVTQIRKRKGLKEQMTPLSEFEDKL

SEQ ID NO: 5416 - protein, 843 aa, Brassica rapa
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVSPEKGTVAFSAGLHGWAFTLTNFAKMYASKFGVDETKMMERLWGENFFDPATRKWSGKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGSQASTLVADIRKRKGMKEQMTPLSDFEDKL

SEQ ID NO: 5417 - protein, 843 aa, Flaveria ramosissima
MVKFTAEELRRIMDYKHNIRNMSVIAHVDHGKSTLTDSLVAAAGIIAQEVAGDVRMTDTRADEAERGITIKSTGISLYYEMTADALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPKTKKWTTKSTGSPSCKRGFVQFCYEPIKQIINTCMNDQKDQLWPMLAKLGVTMKSEEKELMGKALMKRVMQNWLPAATALLEMMIFHLPSPHTAQKYRVENLYEGPLDDQYANAIRNCDPDGPLMLYVSKMIPASDKGRFFAFGRVFAGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPLEDGLPEAIDEGRIGPRDDPKIRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYAAQLTAKPRLLEPVYLVEIQAPEQALGGIYSVLNQRRGHVFEEMQRPGTPLYNIKAYLPVVESFGFSGALRAATSGQAFPQCVFDHWDMMGSDPLEAGSQASTLVTQIRKRKGLKEQMTPLSEFEDKL

SEQ ID NO: 5418 - protein, 844 aa, Podocarpus macrophillus
MVKFTAEELRRIMDFKHNIRNMSVIAHVDHGKSTLTDSLVAAAGIIAQEVAGDVRMTDTRQDEAERGITIKSTGISLYYEMSDESLKRYTGERNGNEYLINLIDSPGHVDFSSEVTAALRITDGALVVVDCIEGVCVQTETVLRQALGERIRPVLTVNKMDRCFLELQVEGEEAYQTFLRVIENANVIMATYEDPLLGDCQVYPEKGTVAFSAGLHGWAFTLTNFAKMYASKFGVDEAKMMERLWGENFFDPATKKWTTKNTGSTTCKRGFVQFIYEPIKQIINICMNDQKDKLWPMLQKLGVVMKSEEKDLVGKALMKRVMQTWLPASTALLEMMIFHLPSPSKAQRYRVENLYEGPLDDIYANAIRNCDPEGPLMLYVSKMIPASDKGRFFAFGRVFAGKVSTGMKVRIMGPNYVPGQKEGLVCKKVSRELSFGWGKRQESVEDVPCGNTVAMVGLDQYITKNATLTNEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSIRTVMSKSPNKHNRLYFEARPLEEGLPEAIDEGRIGPRDDPKARAKILSEEFGWDKDLAKKIWCFGPETTGPNMVVDMCKGVQYLNEIKDSVVAAFQWASKEGALAEENMRGICFEVCDVVLHTDAIHRGGGQIIPTARRVMYAAQLTAKPRLLEPVYLVEIQAPEQALGGIYGVLNQKRGHVFEEMQRPGTPLYNIKAYLPVIESFGFSGTLRAATSGQAFPQCVFDHWDMMNSDPMDPGTQAHNLVLDIRKRKGLKEQMTPLSDFEDKL

SEQ ID NO: 5419 - protein, 394 aa, Ambrosia trifida
MDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTRKWTTKSTGAASCKRGFVQFCYEPIKQIINTCMNDQKDQLWPMLTKLGVTMKSEEKELMGKALMKRVMQNWLPAATALLEMMIFHLPSPHTAQRYRVENLYEGPLDDQYANAIRNCDPDGPLMLYVSKMIPASDKGRFFAFGRVSPVGFLLV

SEQ ID NO: 5420 - protein, 443 aa, Flaveria ramosissima
MVKFTAEELRRIMDYKHNIRNMSVIAHVDHGKSTLTDSLVAAAGIIAQEVAGDVRMTDTRADEAERGITIKSTGISLYYEMTADALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPKTKKWTTKSTGSPSCKRGFVQFCYEPIKQIINTCMNDQKDQLWPMLAKLGVTMKSEEKELMGKALMKRVMQNWLPAATALLEMMIFHLPSPHTAQKYRVENLYEGPLDDQYANAIRNCDPDGPLMLYVSKMIPASDKGRFFAFGRVFAGKVSTGLKVRIIGSKLCPWRKERFVRQECSEDCHLDGKEARNC

SEQ ID NO: 5421 - protein, 843 aa, Beta vulgaris
MVKFTADELRAIMDCKHNIRNMSVIAHVDHGKSTLTDSLVAAAGIIAQEVAGDVRMTDTRADEAERGITIKSTGISLYYQMTDEALQSYKGERKGNDYLINLIDSPGHVDFSSEVTAALRITDGALVVVDCIEGVCVQTETVLRQALGERIRPVLTVNKMDRCFLELQVDGEEAYTTFQKVIENANVIMATYEDPLLGDVQVYPEKGTVAFSAGLHGWAFTLSNFAKMYASKFGVDESKMMERLWGENFFDPATKKWTTKNSGNASCKRGFVQFCYEPIKQIIATCMNDQKDKLWPMLTKLGIQMKTEEKDLMGKALMKRVMQTWLPASSALLEMMIHHLPSPATAQRYRVENLYEGPMDDVYATAIRNCDPEGPLMLYVSKMIPASDKGRFFAFGRVFAGKVSTGMKVRIMGPNYVPGEKKDLYVKNVQRTVIWMGKKQETVEDVPCGNTVALVGLDQYITKNATLTNEKESDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLDRSVRTVMSKSPNKHNRLYMEARPMEEGLAEAIDEGRIGPRDDPKNRSKILAEEYGWDKDLAKKIWCFGPETTGPNMVVDMCKGVQYLNEIKDSVVAGFQWASKEGALAEENMRGICFEVCDVVLHTDAIHRGGGQIIPTARRVFYASQLTAKPRLLEPVYLVEIQAPENALGGIYSVLNQKRGHVFEEMQRPGTPLYNIKAYLPVVESFGFSSTLRASTSGQAFPQCVFDHWEMMPSDPLEAGSQASTLVSVIRKRKGLKEQMTPLSEFEDKL

SEQ ID NO: 5422 - protein, 848 aa, Cajanus cajan
ICQCVQVKFTAEELRRIMDYKHNIRNMSVIAHVDHGKSTLTDSLVAAAGIIAQEVAGDVRMTDTRQDEAERGITIKSTGISLYYEMSNDSLKNFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTSKNTGSATCKRGFVQFCYEPIKQIISTCMNDQKDKLWPMLQKLGITMKSEEKDLMGKALMKRVMQTWLPASTALLEMMIFHLPSPSKAQKYRVENLYEGPLDDVYSTAIRNCDPDGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPLEEGLPEAIDDGRIGPRDDPKVRSKILSEEFGWDKDLAKKIWCFGPDTLGPNMVVDMCKGVQYLNEIKDSVVAGFQWASREGALAEENMRAICFEVCDVVLHADAIHRGGGQIIPTARRVFYASMLTAKPRLLEPVYLVEIQAPEQALGGIYSVLNQKRGHVFEEMQRPGTPLYNIKAYLPVIESFGFSSTLRAATSGQAFPQCVFDHWDMMSSDPLESGSQASQLVADIRKRKGLKEQMTPLSEYEDKI

SEQ ID NO: 5423 - protein, 75 aa, Eutrema halophilum
MATVLPQGTSSTVSCLLPIQMTVLWTLLTYKSFFSPGTKLGPMILTFIPVDTLPAKTRPKAKNLPLSEAGIILET

SEQ ID NO: 5424 - protein, 616 aa, Gnetum gnemon
MYASKFGVDEGKMMERLWGENYFDPATRKWTSKNTGSATCKRGFVQFIYEPIKQIINICMNDQKDKLWPMLQKLNVVMKSEEKELVGKALMKRVMQTWLPASNALLEMMIFHLPSPSKAQKYRVENLYEGPLDDIYATAIRNCDPEGPLMLYVSKMIPASDKGRFFAFGRVFSGRVATGMKVRIMGPNYVPGQKKDLYVKSVQRTVIWMGKRQESVEDVPCGNTVAMVGLDQFITKNATLTNEKDVDAHPIRAMKFSVSPVVRVAVQCKVASDLPKLVEGLKRLAKSDPMVVCTIEESGEHIVAGAGELHLEICLKDLQEDFMGGAEIVVSDPVVSFRETVLEKSNHTVMSKSPNKHNRLYFEARPLEDGLPEAIDEGRIGPKDDPKARAKILSEEFGWDKDLAKKIWCFGPETTGPNMVVDMCKGVQYLNEIKDSVVAAFQWASKEGALAEENMRAICFEVCDVVLHTDAIHRGGGQIIPTARRVMYAAQLTAKPRLLEPVYLVEIQAPEQALGGIYGVLNQKRGHVFEELQRPGTPLYNIKAYLPVIESFGFSSTLRAATSGQAFPQCVFDHWDMMSSDPMEAGSQAGNLVADIRKRKGLKEQMTPLSEYEDKL

SEQ ID NO: 5425 - protein, 818 aa, Hordeum vulgare
MSTTAGKSTLTDSLVAAAGIIAQEVAGDVRMTDTRADEAERGITIKSTGISLFYEMTEESLRAYKGERDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDAKLGDVQVYPEKGTVAFSAGLHGWAFTLTNFAKMYASKFGVDETKMMERLWGENFFDPSTKKWTNKSTGSPTCKRGFVQFCYDPIKQIINTCMNDQKDKLWPMLHKLGVTMKTDEKELMGKPLMKRVMQTWLPASTALLEMMIFHLPSPSKAQKYRVENLYEGPLDDVYATAIRNCDPEGPLMLYVSKMIPASDKGRFFAFGRVFSGRIATGMKVRIMGPNYVPGQKKDLYMKSVQRTVIWMGKKQESVEDVPCGNTVAMVGLDQYITKNATLTNEKEVDACPIRAMKFSVSPVVRVAVQCKVASDLPKLVEGLKRLAKSDPMVLCSMEESGEHIIAGAGELHLEICLKDLQEDFMGGAEIIVSPPVVSFRETVLEKSCRTVMSKSPNKHNRLYMEARPMEEGLAEAIDDGRIGPRDDPKVRSKVLSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDMMSADPLEAGSQAAQLVLDIRKRKGLKEQMTPLSEFEDKL

SEQ ID NO: 5426 - protein, 843 aa, Silene vulgaris
MVKFTAEELRAIMDKKENIRNMSVIAHVDHGKSTLTDSLVAAAGIIAQEVAGDVRMTDTRADEAERGITIKSTGISLYYEMTDASLQAYKGKRAGNEYLINLIDSPGHVDFSSEVTAALRITDGALVVVDCIEGVCVQTETVLRQALGERIRPVLTVNKMDRCFLELQVDGEEAYTTFQKVIENANVIMATYEDPLLGDVQVYPEKGTVAFSAGLHGWAFTLTNFAKMYASKFGVDETKMMERLWGENYFDPATKKWTTKNSGSPTCKRGFVQFCYEPIKQIINICMNDQKDKLWPMLTKLGVQLKSEEKDLVGKALMKRVMQIWLPASSALLEMMIYHLPSPATAQKYRVENLYEGPMDDQYATAIRNCDPDGPLMLYVSKMIPASDKGRFFAFGRVFAGKVSTGVKVRIMGPNYVPGEKKDLYVKNVQRTVIWMGKKQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVVDRSIRTVMSKSPNKHNRLYMEARPLEDGLAEAIDDGRIGPRDDPKNRSKILAEEFGWDKDLAKKIWCFGPETTGPNMVVDMCKGVQYLNEIKDSVVAGFQWASKEGALADENMRGICFEVCDVVLHADAIHRGGGQVIPTARRVIFASQLTAKPRLMEPVYLVEIQAPEGALGGIYSVLNQKRGHVFEEMQRPGTPLYNIKAYLPVVESFGFSSTLRAATSGQAFPQCVFDHWDTLGSDPLEAGSQASSLVTDIRKRKGLKEQMTPLSDFEDKL

SEQ ID NO: 5427 - protein, 842 aa, Mimulus guttatus
VKFTADRLRVIMDNKHNIRNMSVIAHVDHGKSTLTDSLVAAAGIIAQEVAGDVRMTDTRADEAERGITIKSTGISLYYEMTDESLKGYAGQRDGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVVESKMMERLWGENFFDPTTKKWTTKNTGTATCKRGFVQFCYEPIKMIINTCMNEQKDKLWPMLQKLGVTMKSDEKELLGKPLMKRVMQTWLPASSALLEMMIFHLPSPATAQKYRVENLYEGPLDDVYASAIRSCDPEGPLMLYVSKMIPASDKGRFFAFGRVFSGKVSTGQKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLSKSDPMVVCTIEESGEHIIAGAGELHLEICLKDLVDDYMGGAEIIKSDPVVSFRETVIDRSCRTVMSKSPNKHNRLYMEARPLEDGLAEAIDEGRIGPRDDPKIRSKILAEEFGWDKELAKKIWAFGPETTGPNMVVDMCKGVQYLNEIKDSVVAGFQWASKEGPLAEENMRGICFEVCDVVLHTDAIHRGGGQVIPTARRVIYASQITAKPRLLEPVYLVEIQAPEQALGGIYSVLNQKRGHVFEEMQRPGTPLYNIKAYLPVVESFGFSATLRAATSGQAFPQCVFDHWDTMSSDPLEAGSQAATLVADIRKRKGLKEQMTPLSDFEDKL

SEQ ID NO: 5428 - protein, 843 aa, Amsonia hubrichtii
MVKFTAEELRRIMDYKHNIRNMSVIAHVDHGKSTLTDSLVAAAGIIAQEVAGDVRMTDTRQDEAERGITIKSTGISLYYEMSDASLKNYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDALLGDVQVYPEKGTVAFSAGLHGWAFTLTNFANMYASKFGVDESKMMERLWGENFFDPATKKWTSKHTGAPSCKRGFVQFCYEPIKQIISTCMNDQKDKLWPMLQKLGVTIKGEEKELTGKALMKRVMQTWLPASTALLEMMIFHLPSPSTAQRYRVENLYEGPLDDQYANAIRNCDPDGPLMLYVSKMIPASDKGRFFAFGRVFSGKVATGSKVRIMGPNYVPGEKKDLYVKNVQRTVIWMGKKQETVEDVPCGNTVAMVGLDQFITKNATLTNEKEVDAHPIKAMKFSVSPVVRVAVKCKIASDLPKLVEGLKRLAKSDPMVQCTIEESGEHIIAGAGELHLEICLKDLQEDFMGGALLDISDPVVSFRETVIDKSCRVVMSKSPNKHNRLYMEARPLEEGLAEAIDEGRIGPRDDPKVRSKILSEEFGWDKDLAKKIWCFGPETMGPNMVVDMCKGVQYLSEIKDSVVAGFQWASKEGALAEENMRGICFEVCDVVLHADAIHRGGGQVIPTARRVIYASQLTAKPRLLEPIYLVEIQAPEQALGGIYSVLNQKRGHVFEEIQRPGTPLYNIKAYLPVAESMKFSETLRANTSGQAFPQCVFDHWDIMPSDPLEPGTQASSLVANIRKRKGLKEQITPLSDFEDRL

SEQ ID NO: 5429 - protein, 832 aa, Eschscholzia californica
MVKFTAEELRRIMDLKHNIRNMSVIAHVDHGKSTLTDSLVAAAGIIAQEVAGDVRMTDTRADEAERGITIKSTGISLYYEMTDASLKAFKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFANMYASKFGVDVTKMMERLWGENFFDPATKKWTSKNTGSPTCKRGFVQFCYEPIKQIINTCMNDQKDKLWPMLQKLGVTMKSEEKDLLGKPLMKRVMQTWLPASTALLEMMIFHLPSPSTAQRYRVENLYEGPLDDQYANAIRNCDPEGPLMLYVSKMIPAPDKGRFFAFGRVFSGKVATGMKVRIMGPNFVPGQKKDLYTKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLDKSCRTVMSKSPNKHNRLYMEARPLEDGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRAIYASQITAKPRLLEPVYLVEIQAPEQALGGIYGVLNQKRGHVFEEMQRPGTPLYNIKAYLPVVESFGFSSQLRAATSGQAFPQCVFDHWDVMSSDPYEAGSQAAVLVADVRKRKGFKDR

SEQ ID NO: 5430 - protein, 332 aa, Helianthus annuus
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDEAKMMERLWGENFFDPKTKKWTTKNTGSASCQRGFVQFCYEPIKMIINTCMNDQKDKLWPMLTKLGVTMKSEEKELMGKALMKRVMQNWLPAACFT

SEQ ID NO: 5431 - protein, 686 aa, Eschscholzia californica
MVKFTAEELRRIMDLKHNIRNMSVIAHVDHGKSTLTDSLVAAAGIIAQEVAGDVRMTDTRADEAERGITIKSTGISLYYEMTDASLKAFKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFANMYASKFGVDVTKMMERLWGENFFDPATKKWTSKNTGSPTCKRGFVQFCYEPIKQIINTCMNDQKDKLWPMLQKLGVTMKSEEKDLLGKPLMKRVMQTWLPASTALLEMMIFHLPSPSTAQRYRVENLYEGPLDDQYANAIRNCDPEGPLMLYVSKMIPAPDKGRFFAFGRVFSGKVATGMKVRIMGPNFVPGQKKDLYTKSVQRTVIWMGKRQESVEDVPCGNTVAMVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLDKSCRTVMSKSPNKHNRLYMEARPLEDGLAEAIDDGRIGPRDDPKVRSKILSEEFGWDKDLAKKIWCFGPETTGPNMVVDMCKGVQYLNEIKDSVVAGFQWASKEEHWLKKHEGNMF

SEQ ID NO: 5432 - protein, 831 aa, Lactuca sativa
MDYKHNIRNMSVIAHVDHGKSTLTDSLVAAAGIIAQEVAGDVRMTDTRADEAERGITIKSTGISLYYEMTDAALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKKWTTKSTGSPSCKRGFVQFCYEPIKQIINTCMNDQKDQLWPMLTKLGVTMKSDEKELMGKALMKRVMQTWLPAATALLEMMIFHLPSPHTAQRYRVENLYEGPLDDMYANAIRNCDPDGPLMLYVSKMIPASDKGRFFAFGRVFAGKVSTGLKVRIMGPNYVPGEKKDLYVKSVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEDGLAEAIDEGRVGPRDDPKVRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRPGTPLYNIKAYLPVVESFGFSGALRASTSGQAFPQCVFDHWDMMGSDPLEVGSQANTLVLQIRKRKGLKEQMTPLSDFEDKL

SEQ ID NO: 5433 - protein, 831 aa, Eutrema parvulum
MDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEEGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEVGSQASTLVADIRKRKGMKEQMTPLSDFEDKL

SEQ ID NO: 5434 - protein, 761 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTTKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQR

SEQ ID NO: 5435 - protein, 843 aa, Adiantum capillus-veneris
MVKFTTEELRRIMDKKNNIRNMSVIAHVDHGKSTLTDSLVAAAGIIAQEVAGDVRLTDTRQDEAERGITIKSTGISLYYEMSEKSLKDYKGEKDGNDYLINLIDSPGHVDFSSEVTAALRITDGALVVVDCVEGVCVQTETVLRQALGERIRPVLTVNKMDRCFLELQVEGEEAYQTFQRVIENANVIMATYEDPLLGDVQVYPEKGTVAFSAGLHGWAFTLTNFAKMYAAKFGVDEAKMMERLWGENYFDPATKKWTTKNTGTSTCQRGFVQFIYNPIKQLINICMNDQKDKLWPMLSKLGIGLKGDEKELRGKALMKRVMQTWLPASDALLEMMVFHLPSPAKAQRYRVENLYEGPLDDQYANAIRNCDPEGPLMLYVSKMIPASDKGRFFAFGRVFAGKVSTGSKVRIMGPNYIPGQKKDLYVKSVQRTVIWMGRRQESVEDVPCGNTVAMVGLDQYITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSHHTVMSKSPNKHNRLYFEARPLEEGLAEAIDDGRIGPRDDPKARSKILSEEFGWDKDLAKKIWCFGPETTGPNLVVDMCKGVQYLNEIKDSVVAAFQWATKEGALAEENMRGIAFEVCDVVLHADAIHRGGGQVIPTARRVMYASQLTAKPRLLEPVYLVEIQAPEQALGGIYGVLNQKRGHVFEEIQRPGTPLYNIKAYLPVIESFGFSGTLRAATSGQAFPQCVFDHWDMMNSDPMEVGSQAAQLVVDIRKRKGLKEQITALSEYEDKL

SEQ ID NO: 5436 - protein, 684 aa, Pteridium aquilinum
MDRCFLELQVEGEEAYQTFQRVIENANVIMATYEDPLLGDVQVYPEKGTVAFSAGLHGWAFTLTNFAKMYAAKFGVDESKMMERLWGENYFDPATKKWTSKNTGSSTCSRGFVQFIYNPIKQLINICMNDQKDKLWPMLTKLGASLKGDEKELRGKALMKRVMQTWLPASDALLEMMVFHLPSPATAQRYRVENLYEGPLDDQYANAIRNCDPEGPLMLYVSKMIPASDKGRFFAFGRVFAGKVSTGSKVRIMGPNYVPGQKKDLYVKSVQRTVIWMGRRQESVEDVPCGNTVAMVGLDQYITKNATLTNEKEVDAHPIRAMKFSVSPVVRVAVQCKVASDLPKLVEGLKRLAKSDPMVVCSIEESGEHIIAGAGELHLEICLKDLQDDFMGGAEIVVSDPVVSFRETVLEKSHHTVMSKSPNKHNRLYFEARPLEEGLAEAIDDGRIGPRDDPKVRSKILSEEFGWDKDLAKKIWCFGPETTGPNLVVDMCKGVQYLNEIKDSVVAAFQWATKEGALAEENMRGIAFEVCDVVLHADAIHRGGGQVIPTARRVMYASQLTAKPRLLEPVYLVEIQAPEQALGGIYGVLNQKRGHVFEEIQRPGTPLYNIKAYLPVIESFGFSGTLRAATSGQAFPQCVFDHWDMMNSDPLEAGSPAAQLVMDIRKRKGLKDQITPLSEYEDKL

SEQ ID NO: 5437 - protein, 843 aa, Ceratodon purpureus
MVKFSADELRAIMDKKHNIRNMSVIAHVDHGKSTLTDSLVAAAGIIAQETAGDVRLTDTRTDEAERGITIKSTGISLYYEMSQESLKDYHGEKDGHDYLINLIDSPGHVDFSSEVTAALRITDGALVVVDCIEGVCVQTETVLRQALGERIRPVLTVNKMDRCFLELQVDGEEAYQTFQRVIESANVIMATYEDALLGDVQVYPEKGTVAFSAGLHGWAFTLTNFAKMYAGKFGVDEKKMMERLWGENFFDPATKKWTSKNTGSATCQRGFVQFVYNPIKQVINICMNDQKDKLWPMLAKLNCGLKADEKDLVGKALMKRTMQAWLPAASALLEMMIFHLPSPATAQRYRVENLYEGPLDDQYANAIRNCDPNGPLMLYVSKMIPASDKGRFFAFGRVFAGKVATGMKVRIMGPNYVPGQKKDLYTKSVQRTVIWMGRRQESVEDVPCGNTVAMVGLDQFITKNATLTGEKEVDAHPIRAMKFSVSPVVRVAVQCKHASDLPKLVEGLKRLAKSDPMVLCMIEESGEHIIAGAGELHLEICLKDLQDDFMGGAEIVVSDPVVSFRETVLDKSVRTVMSKSPNKHNRLYFEARPLEEGLPEAIDEGRIGPRDDPKVRSVILSQEFGWDKDLAKKIWCFGPETTGPNMVVDMCKGVQYLNEIKDSVVAAFQWATKEGALAEENMRGIAFEVCDVVLHTDAIHRGGGQIIPTARRVMYAAQLTAKPRLLEPVYLVEIQAPEGALGGIYGVLNQKRGHVFEEVQRPGTPLYNIKAYLPVIESFGFSGTLRAATSGQAFPQCVFDHWEMLNSDPLEAATQSANIVTDIRKRKGLKEQMTPLSEFEDKL

SEQ ID NO: 5438 - protein, 427 aa, Phalaenopsis aphrodite
MFQARRRIYMSRASNELLSGWEKQESVEDVPCGNTVAMVGLDQFITKNATLTNEKEVDAHPIRAMKFSVSPVVRVAVSCKVASDLPKLVEGLKRLSKSDPMVVCAIEESGEHIVAGAGELHLEICLKDLQEDFMGGAEIVVSDPVVSFRETVIDKSSRTVMSKSPNKHNRLYMEARPLEEGLAEAIDDGRIGPRDDPKVRAKVLSEEFGWDKDLAKKIWCFGPETTGPNLVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYGVLNQKRGHVFEEMQRPGTPLYNIKAYLPVVESFGFSTALRASTSGQAFPQCVFDHWDIMSSDPLEANSQAGQLVTDIRKRKGLKEQMTPLSEFEDKL

SEQ ID NO: 5439 - protein, 809 aa, Malus domestica
LTDSLVAAAGIIAQEVAGDVRMTDTRADEAERGITIKSTGISLYYEMTDESLQRYKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENFFDPATKKWTSKSTGTATCKRGFVQFCYEPIKQIINTCMNDQKDKLWPMLTKLGVTMKSDEKDLMGKALMKRVMQTWLPASTALLEMMIFHLPSPSTAQKYRVENLYEGPLDDQYANAIRNCDPDGPLMLYVSKMIPASDKGRFFAFGRVFAGRVQTGLKVRIMGPNFVPGEKKDLYVKNVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIIKSDPVVSFRETVLDKSCRTVMSKSPNKHNRLYMEARPLEEGLPEAIDEGRIGPRDDPKIRSKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEGALGGIYSVLNQKRGHVFEEMQRPGTPLYNIKAYLPVVESFGFSGQLRAATSGQAFPQCVFDHWEMMSSDPLEAGSQAATLVTDIRKRKGLKEQMTPLSEFEDKL

SEQ ID NO: 5440 - protein, 760 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQ

SEQ ID NO: 5441 - protein, 289 aa, Setaria italica
MVKFTAEELRGIMDKKNNIRNMSVIAHVDHGKSTLTDSLVAAAGIIAQEVAGDVRMTDTHADEAERGITIKSTGISLYYEMTEESLKSYKGERDGNEYLINLIDSPGHVDFSSEVTAALRITDGALVVVDCIEGVSVQTETVLRQALGKRIRPVLTVNKMDRCFLELQVEGEEAYQPFSCVIENANVIMATYEDKLFGDIQVYPEKGTVAFSAGLHGWAFTLTSFAKMYASKFGVDETKMMERLWGENFFDPATKKWTTKNTGSPTCKRGFVQLISYAMSQSSKSSTPA

SEQ ID NO: 5442 - protein, 835 aa, Nicotiana benthamiana
MVKFTAEELRNIMDYKHNIRNMSVIAHVDHGKSTLTDSLVAAAGIIAQEVAGDVRMTDTRADEAERGITIKSTGISLYYQMTDESLKNFKGERNGNEYLINLIDSPGHVDFSSEVTAALRITDGALVVVDCVEGVCVQTETVLRQALGERIRPVLTVNKMDRCFLELQVDGEEAYQTFSRVIENANVIMATYEDPLLGDVQVYPEKGTVAFSAGLHGWAFTLTNFAKMYASKFGVDESKMMERLWGENFFDPATKKWTTKNSGSATCKRGFVQFCYEPIKQIINTCMNDQKDKLWPMLQKLGVTMKSEEKELMGKALMKRVMQTWLPASTALLEMMIFHLPSPSTAQRYRVENLYEGPLDDQYANAIRNCDPDGPLMLYVSKMIPASDKGRFFAFGRVFAGKVCTGMKVRIMGPNYVPGEKKDLYVKNVQRTVIWMGKKQETVEDVPCGNTVAMVGLDQFITKNATLTNEKEVEAHPIRAMKFSVSPVVRVAVQCKLASDLPKLVEGLKRLAKSDPMVLCSIEESGEHIIAGAGELHLEICLKDLQDDFMGGAEIIVSDPVVSFRETVLEKSCRTVMSKSPNKHNRLYMEARPLEKGQRGCFQSILGSLKERKNKNKRALVGPAEIACFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYGVLNQKRGHVFEEMQRPGTPLYNIKAYLPVIESFGFSGTLRAATSGQAFPQCVFDHWDMMSSDPLDAGTQAHQLVLDIRKRKGLKQAVTPLSEFEDKL

SEQ ID NO: 5443 - protein, 853 aa, Mesembryanthemum crystallinum
  misc_feature (434)..(434): Xaa can be any naturally occurring amino acid
DPPGAESPVGDGEVTADELRRIMDLKHNIRNMSVIAHVDHGKSTLTDSLVAAAGIIAQEVAGDVRMTDTRADEAERGITIKSTGISLYYEMTDEALAAYKGEKMGNDYLINLIDSPGHVDFSSEVTAALRITDGALVVVDCIEGVCVQTETVLRQALGERIRPVLTVNKMDRCFLELQVDGEEAYTTFQKVIENANVIMATYEDPLLGDVMVYPDKGTVAFSAGLHGWAFTLSNFAKMYASKFGVDESKMMERLWGENFFDPATKKWTTKNTGNATCKRGFVQFCYEPIKQIISTCMNDQKDKLWPMLTKLGIQLKGEEKDLMGKPLMKRVMQTWLPASTALLEMMIFHLPSPATAQRYRVENLYEGPMDDIYATAIRNCDPEGPLMLYVSKMIPASDKGRFFAFGRVFAGKVSTGMKVRIMGPNFVPGEKKDXYVKNVQRTVIWMGKRQETVEDVPCGNTVALVGLDQFITKNATLTNEKEVDAHPIRAMKFSVSPVVRVAVQCKVASDLPKLVEGLKRLAKSDPMVVCSIEESGEHIIAGAGELHLEICLKDLQDDFMGGAEIVKSDPVVSFRETVLERSIRTVMSKSPNKHNRLYMEARPMEEGLAEAIDDGRIGPRDDPKIRSKILAEEFGWDKDLAKKIWCFGPETMGPNMVVDMCKGVQYLNEIKDSVVAGFQWASKEGALAEENMRGICFEVCDVVLHTDAIHRGGGQIIPTARRVFYASQLTAKPRLLEPVYMVEIQAPEGALGGIYSVLNQKRGHVFEEMQRPGTPLYNIKAYLPVIESFGFSSTLRAATSGQAFPQCVFDHWDMMSSDPLEPGSQAANHVTEIRKRKGLKETMTPLSEFEDKL

SEQ ID NO: 5444 - protein, 843 aa, Physcomitrella patens
MVKFSADELRAIMDKKHNIRNMSVIAHVDHGKSTLTDSLVAAAGIIAQETAGDVRLTDTRQDEADRGITIKSTGISLYYEMTEESLKDYKGEKDGHDYLINLIDSPGHVDFSSEVTAALRITDGALVVVDCVEGVCVQTETVLRQALGERIRPVLTVNKMDRCFLELQVEGEEAYQTFQRVIESANVIMATYEDALLGDVQVYPEKGTVAFSAGLHGWAFTLTNFAKMYAGKFGVDEKKMMERLWGENFFDPATKKWTSKNTGSATCQRGFVQFVYNPIKQVINICMNDQKEKLWPMLAKLNCGLKADEKDLVGKALMKRTMQAWLPAASALLEMMIHHLPSPATAQRYRVENLYEGPLDDQYANAIRNCDPNGPLMLYVSKMIPASDKGRFFAFGRVFAGKVSTGMKVRIMGPNYVPGGKKDLYTKSVQRTVIWMGRRQESVEDVPCGNTVAMVGLDQFITKNATLTGEKETDAHPIRAMKFSVSPVVRVAVQCKHASDLPKLVEGLKRLAKSDPMVLCMIEESGEHIIAGAGELHLEICLKDLQDDFMGGAEIVVSDPVVSFRETVLDKSVRTVMSKSPNKHNRLYFEARPLEEGLSEAIDDGRIGPRDDPKVRSQILAQEFGWDKDLAKKIWCFGPETTGPNMVVDMCKGVQYLNEIKDSVVAAFQWATKEGAMAEENMRGIAFEVCDVVLHTDAIHRGGGQIIPTARRVMYAAQLTAKPRLLEPVYLVEIQAPEGALGGIYGVLNQKRGHVFEEVQRPGTPLYNIKAYLPVIESFGFSGTLRAATSGQAFPQCVFDHWEMMNSDPLEAGTQAATLVSDIRKRKGLKEQMTPLSDFEDKL

SEQ ID NO: 5445 - protein, 827 aa, Cirsium arvense
MVKFTAEELRRIMDFKHNIRNMSVIAHVDHGKSTLTDSLVAAAGIIAQEVAGDVRMTDTRADEAERGITIKSTGISLYYEMTDAALKSFTGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKKWTTKNSGSPSCKRGFVQFCYEPIKQIINTCMNDQKDQLWPMLTKLGVTMKSDEKELMGKALMKRVMQTWLPAATALLEMMIFHLPSPHTAQRYRVENLYEGPLDDVYANAIRNCDPNGPLMLYVSKMIPASDKGRFFAFGRVFAGKVSTGLKVRIMGPNYIPGEKKDLYVKSVQRTVIWMGKKQETVEDVPCGNTVALVGLDQFITKNATLTNEKESDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEDGLAEAIDDGRIGPRDDPKIRGKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQRRGHVFEEMQRPGTPLYNIKAYLPVVESFGFSGALRASTSGQAFPQCVFDHWDMMGSDPLEAGSQASTLVTQIRKRK

SEQ ID NO: 5446 - protein, 817 aa, Euonymus alatus
MVKFTADGLRRIMDLKHNIRNMSVIAHVDHGKSTLTDSLVAAAGIIAQEVAGDVRMTDTRADEAERGITIKSTGISLYYEMSDESLMSYKGERMGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENYFDPATRKWTTKNTGASSCKRGFVQFCYEPIKQIINTCMNDQKDKLWPMLQKLGVTMKSDEKELMGKPLMKRVMQTWLPASRALLEMMIFHLPSPSMAQRYRVENLYEGPMDDQYATAIRNCDPEGPLMLYVSKMIPASDKGRFFAFGRVFSGKVATGAKVRIMGPNYVPGEKKDLYVKNVQRTVIWMGKKQEAVEDVPCGNTVALVGLDQFITKNATLTNEKEVDAHPIRAMKFSVSPVVRVAVQCKVASDLPKLVEGLKRLSKSDPMVVCSIEESGEHIIAGAGELHLEICLKDLQDDFMGGAEIIKSDPVVSFRETVLEKSSRTVMSKSPNKHNRLYMEARPLEEGLPEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYMVEIQAPEQALGGIYSVLNQKRGHVFEEMQRPGTPLYNIKAYLPVVESFGFSGNLRAATSGQAFPQCVFDHWDMMMSDPLDPTSQAG

SEQ ID NO: 5447 - protein, 546 aa, Papaver somniferum
VIAHVDHGKSTLTDSLVAAAGIIAQETAGDVRMTDTRADEAERGITIKSTGISLYYEMSDASLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTSSPTCKRGFVQFCYEPIKQIIATCMNDQKDKLWPMLQKLGVTMKNDEKELIGKPLMKRVMQTWLPAATALLEMMIYHLPSPHTAQKYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEILFVRTCRMISWVVLKLLSLTLWCHFVRLS

SEQ ID NO: 5448 - protein, 843 aa, Physcomitrella patens
MVKFSAEELRAIMDKKHNIRNMSVIAHVDHGKSTLTDSLVAAAGIIAQETAGDVRLTDTRQDEADRGITIKSTGISLYYEMTSESLKDYHGEKDGCDYLINLIDSPGHVDFSSEVTAALRITDGALVVVDCVEGVCVQTETVLRQALGERIRPVLTVNKMDRCFLELQVDGEEAYQTFQRVIESANVIMATYEDALLGDVQVYPEKGTVAFSAGLHGWAFTLTNFAKMYAGKFGVDEKKMMERLWGENFFDPATKKWTSKNTGSATCQRGFVQFVYNPIKQVINICMNDQKDKLWPMLAKLNCGLKSEEKELVGKALMKRTMQAWLPAASALLEMMIFHLPSPATAQKYRVENLYEGPLDDQYANAIRNCDPNGPLMLYVSKMIPASDKGRFFAFGRVFAGKVATGMKVRIMGPNYVPGGKKDLYTKSVQRTVIWMGRRQESVEDVPCGNTVAMVGLDQFITKNATLTGEKETDAHPIRAMKFSVSPVVRVAVQCKHASDLPKLVEGLKRLAKSDPMVLCMIEESGEHIIAGAGELHLEICLKDLQEDFMGGAEIVVSDPVVSFRETVLDKSVRTVMSKSPNKHNRLYFEARPLEEGLPEAIDDGRIGPRDDPKVRSQILAQEFGWDKDLAKKIWCFGPETTGPNMVVDMCKGVQYLNEIKDSVVAAFQWATKEGALAEENMRGIAFEVCDVVLHTDAIHRGGGQVIPTARRVMYAAQLTAKPRLLEPVYLVEIQAPEGALGGIYGVLNQKRGHVFEEVQRPGTPLYNIKAYLPVIESFGFSGTLRAATSGQAFPQCVFDHWEMMTSDPLEAGTQSAQIVADVRKRKGLKEQITPLSEYEDKL

SEQ ID NO: 5449 - protein, 843 aa, Marchantia polymorpha
MVKFTADELRRIMDKKHNIRNMSVIAHVDHGKSTLTDSLVAAAGIIAQADAGDVRLTDTRADEAERGITIKSTGISLYYEMSDLSLKDFTGEKDGSDYLINLIDSPGHVDFSSEVTAALRITDGALVVVDCVEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDEKKMMERLWGENFFDRATKKWTTKNTGSPTCSRGFVQFVYNPIKQIINICMNDQKDKLWPMLAQLGCGLKGEEKELMGKHLMKRVMQTWLPASAALLEMMIFHLPSPATAQRYRVENLYEGPLDDMYANAIRNCDPEGPLMLYVSKMIPASDKGRFFAFGRVFAGKVSTGLKVRIMGPNYVPGQKKDLYTKSVQRTVIWMGRRQESVEDVPCGNTVALVGLDQFITKNATLTNEKEVDAHPIRAMKFSVSPVVRVAVQCKVASDLPKLVEGLKRLAKSDPMVICTIEESGEHIIAGAGELHLEICLKDLQDDFMGGAEIVVSDPVVSFRETVLEKSNHTVMSKSPNKHNRLYFEARPLEDGLAEAIDDGRIGPRDDPKVRSKILAEEFGWDKDLAKKIWCFGPDTTGPNMVVDMCKGVQYLNEIKDSVVAAFQWATKEGVLGDENMRGIAFEVCDVVLHADAIHRGGGQIIPTARRAMYAAMLTAKPRLLEPVYLVEIQAPEQALGGIYGVLNQKRGHVFEEIQRPGTPLYNIKAYLPVIESFGFSSTLRAATSGQAFPQAVFDHWEMMSSDPTDNSTQSGQIVSDIRKRKGLKEQITALSEYEDRL

SEQ ID NO: 5450 - protein, 822 aa, Triphysaria pusilla
MSVIAHVDHGKSTLTDSLVAAAGIIAQETAGDVRMTDTRADEAERGITIKSTGISLYYEMTDESLKSYKGLRTGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPATKKWTTKNTGSPSCKRGFVQFCYEPIKQIINTCMNDQKDKLWPMLTKLGVQMKSDEKDLMGKALMKRVMQTWLPASSALLEMMIFHLPSPSIAQRYRVENLYEGPLDDQYANAIRNCDPDGPLMLYVSKMIPASDKGRFFAFGRVFAGKVSTGMKVRIMGPNYVPGEKKDLYTKSVQRTVIWMGKKQETVEDVPCGNTVAMVGLDQYITKNATLTSEKEVDAHPIKAMKFSVSPVVRIAVQCKVASDLPKLVEGLKRLAKSDPMVVCTMEESGEHIVAGAGELHLEICLKDLVDDFMGGAEIIKSDPVVSFRETVLDRSSRIVMSKSPNKHNRLYMEARPLEEGLAEAIDDGRIGPRDDPKIRSKILSEEFGWDKELAKKIWAFGPETMGPNMVVDMCKGVQYLNEIKDSVVAGFQWASKEGPLAEENMRGVCFEVCDVVLHTDAIHRGGGQVIPTARRVIYASHLTAKPRLLEPVYLVEIQAPEQALGGIYSVLNQKRGHVFEEMQRPGTPLYNIKAYLPVVESFGFSAQLRAATSGQAFPQCVFDHWDMMMSDPMETGSQASALVADIRKRKGLKEQMTPLSDFEDKL

SEQ ID NO: 5451 - protein, 820 aa, Aristolochia fimbriata
MVKFTAEELRRIMDLKHNIRNMSVIAHVDHGKSTLTDSLVAAAGIIAQEVAGDVRMTDTRQDEAERGITIKSTGISLYYEMDDDALKAYKGERSGNEYLINLIDSPGHVDFSSEVTAALRITDGALVVVDCIEGVCVQTETVLRQALGERIKPVLTVNKMDRCFLELKVEGEEAFQTFSRVIENANVIMATYEDPLLGDCQVYPEKGTVAFSAGLHGWAFTLTNFAKMYASKFGVDEAKMMERLWGENYFDPATKKWTSKSTGSATCKRGFVQFCYEPIKQIINTCMNDQKDRLWPMLTKLGVNMKSDEKELMGKPLMKRVMQTWLPASSALLEMMIFHLPSPSRAQRYRVENLYEGPLDDQYANAIRNCDPDGPLMLYVSKMIPASDKGRFFAFGRVFSGKVCTGMKVRIMGPNYIPGQKKDLYVKNVQRTVIWMGKKQESVEDVPCGNTVAMVGLDQFITKNATLTAEKEVDAHPIRAMKFSVSPVVRVAVQCKVASDLPKLVEGLKRLAKSDPMVVCTIEESGEHIVAGAGELHLEICLKDLQEDFMGGAEIIVSDPVVSFRETVLEKSCRTVMSKSPNKHNRLYMEARPMEEGLAEAIDEGRIGPRDDPKNRAKILSEEFGWDKDLARKIWCFGPETMGPNMVVDVCKGVQYLNEIKDSVVAGFQWASKEGALAEENMRAICFEVCDVVLHADAIHRGGGQVIPTARRVIYASQLTAKPRLLEPVYLVEIQAPEQALGGIYGVLNQKRGHVFEELQRPGTPLYNIKAYLPVIESFGFSTSLRAATSGQAFPQCVFDHWDMMSSDPMDTNISVWAIS

SEQ ID NO: 5452 - protein, 839 aa, Eutrema parvulum
MSFVGLWTTNTTSVICLLLPMSTMVQGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEEGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEVGSQASTLVADIRKRKGMKEQMTPLSDFEDKL

SEQ ID NO: 5453 - protein, 631 aa, Secale cereale
GDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDESKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICLEVCDVVLHTDAIHRGGGQVIPTARRVSLCFSAHC

SEQ ID NO: 5454 - protein, 826 aa, Oryza sativa
MVKFTVEEMRRIMDKKHNIRNMSVVAHVDHGKSTLTDSLVAAAGIIAQDVAGDVRMTDSRSDEAERGITIKSTGISLYYEMSDESLKSYKGDRDGNEYLINLIDSPGHVDFSSEVTAALRITDGALVVVDCIEGVCVQTETVLRQALGERIRPVLTVNKMDRCFLELQVGGEEAYQTFSRVIENANVIMATYEDALLGDVQVYPEKGTVAFSAGLHGWAFTLSNFAKMYASKFGVDESKMMERLWGENYFDPTTKKWTIKHTGSDTCKRGFIQFCYEPIRQIINTCMNDQKDKLLPMLQKLGVTMKDLTGKALMKRVMQTWLPASNALLEMMIYHLPSPAKAQRYRVENLYEGPLDDIYASAIRNCDPEGPLMLYVSKMIPASDKGRFYAFGRVFSGRVATGMKVRIMGPNYAPGQKKDLYVKNVQRTVIWMGKKQESVEGVPCGNTVAMVGLDQFITKNATLTNEKEVDACPIKAMKFSVSPVVRVAVQCKVASDLPKLVEGLKRLAKSDPMVLCTVEESGEHIIAGAGELHLEICLKDLQEDFMGGAEITVSPPVVSFRETVLEKSCRTVMSKSPNKHNRLYMEARPMEEGLPEAIDEGRIGPRDDPKVRSKILSEEFGWDKDLAKKIWCFGPETTGPNIVVDMCKGVQYLNEIKDSVVAGFQWASKEGALAEENMRGRGICFEVCDVILHSDAIHRGGGQIIPTARRVIYAAQLTAKPRLLEPVYLVEIQAPENALGGIYSVLNQKRGHVFEEMQRPGTPLYNIKAYLPVIESFGFTSTLRAATSGQAFPLFVFDHWEMLSVDPLEPGTRQLTLSWISARGRV

SEQ ID NO: 5455 - protein, 186 aa, Brassica rapa
METGREGDSSLLRVNLNITKERILIRRHDHISVLNNPLERLVSLLTVNLKLKETPVHLVHSQHGPNPLTKSLTQHSLRLNTDTLDTVDDNKGTISDTERSSDLRGEVNVARRVDEVDKVLVSISGTSEALQGSISHLVVERDTRGLDGDTTFSLIGTCISHTDITSNFLSNDTSSSNQGVSEGGFT

SEQ ID NO: 5456 - protein, 467 aa, Papaver somniferum
MLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEQGTQASDLVTEIRRRKGLKAQMTPLSDFEDKL

SEQ ID NO: 5457 - protein, 254 aa, Arabidopsis thaliana
MSVIAHVDHGKSTLTDSLVAAAGIIAQETAGDVRMTDTRADEAERGITIKSTGISLYYEMTDASLKSFTGARDGNEYLINLIDSPGHVDFSSEVTAALRITDGALVVVDCIEGVCVQTETVLRQSLGERIRPVLTVNKMDRCFLELKVDGEEAYQNFQRVIENANVIMATHEDPLLGDVQVYPEKGTVAFSAGLHGWAFTLTNFAKMYASKFGVSESKMMERLWGENFFDSATRKWTTKNWLPDLQAWVCSVLL

SEQ ID NO: 5458 - protein, 176 aa, Brassica napus
MKFSVSPVVRVAVQCKVASDLPKLVEGLKRLAKSDPMVVCTMEESGEHIVAGAGELHLEICLKNLQDDFMGGAEIVKSDPVVSFRETVLERSVRTVMSKSPNKHNRLYMEARPLEDGLAEAIDEGRIGPRDDPRYVPRSWLRSLAGTRISQRRYGRLDLKPQGPTWLLTCVREFNT

SEQ ID NO: 5459 - protein, 832 aa, Arabidopsis lyrata
QVKFTVEEQRKIMDRKHNIRNMSVIAHVDHGKSTLTDSLVAAAGIIAQESAGDVRMTDTRADEAERGITIKSTGISLYYEMTDESLKSFTGARDGNEYLINLIDSPGHVDFSSEVTAALRITDGALVVVDCIEGVCVQTETVLRQSLGERIRPVLTVNKMDRCFLELKVDGEEAYQNFQRVIENANVIMATYEDPLLGDVQVYPEKGTVAFSAGLHGWAFTLTNFAKMHASKFGVSESKMMERLWGENFFDPATRKWTTKNTGSATCKRGMMINTCMNDQKDKLWPMLEKLGIQMKPDEKELMGKPLMKRVMQAWLPASTALLEMMIFHLPSPYTAQRYRVENLYEGPLDDKYAAAIRNCDPEGPLMLYVSKMIPASDKGRFFALGRVFSGTVSTGMKVRIMGPNYVPGEKKDLYVKSVQRTVIWMGKKQETVEDVPCGNTVAMVGLDQFITKNATLTNEKEVDAHPLRAMKFSVSPVVRVAVKCKLASDLPKLVEGLKRLAKSDPMVLCTMEESGEHIGAGAGELHIEICVKDLQDFMGGAEIIVSDPVVSLRETVFERSCRTVMSKSPNKHNRLYMEARPMEDGLAEAINEGRIGPSDDPKIRSKILAEEFGWDKDLAKKIWAFGPDTTGPNMVVDMCKGVQYLNEIKDSVVAGFQWASKEGPLAEENMRGVCYEVCDVVLHVDAIHRGGGQMISTARRAIYASQLTAKPRLLEPVYMVEIQAPEGALGGIYSVLNQKRGHVFEEMQRPGTPLYNIKAYLPVVESFNFSGQLRAATSGQAFPQCVFDHWDMMSSDPLEAGSQAATLVADIRKRKGLKLQMTPLSDFEDKL

SEQ ID NO: 5460 - protein, 808 aa, Flaveria ramosissima
TDSLVAAAGIIAQEVAGDVRMTDTRADEAERGITIKSTGISLYYEMTADALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENYFDPKTKKWTTKSTGSPSCKRGFVQFCYEPIKQIINTCMNDQKDQLWPMLAKLGVTMKSEEKELMGKALMKRVMQNWLPAATALLEMMIFHLPSPHTAQKYRVENLYEGPLDDQYANAIRNCDPDGPLMLYVSKMIPASDKGRFFAFGRVFAGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPLEDGLPEAIDEGRIGPRDDPKIRGKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYAAQLTAKPRLLEPVYLVEIQAPEQALGGIYSVLNQRRGHVFEEMQRPGTPLYNIKAYLPVVESFGFSGALRAATSGQAFPQCVFDHWDMMGSDPLEAGSQASTLVTQIRKRKGLKEQMTPLSEFEDKL

SEQ ID NO: 5461 - protein, 684 aa, Secale cereale
MDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 5462 - protein, 774 aa, Pennisetum glaucum
IKSTGISLYYEMTDESLKNYKGQRDGNEYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKSTGSATCKRGFVQFCYEPIKQIIKTCMNDQKDKLWPMLQKLNVTMKSDEKELIGKALMKRVMQTWLPASTALLEMMIFHLPSPATAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAATLVLDIRKRKGLKEQMTPLSEFEDKL

SEQ ID NO: 5463 - protein, 731 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDESKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYL

SEQ ID NO: 5464 - protein, 221 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDESLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGQSPSLLVCTVGLSL

SEQ ID NO: 5465 - protein, 676 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSRSCLRSWLDKDLAKKIWYFGPETTGPNMVVDMCKGVQYLNEIKDSVVAGSMALNRGALG

SEQ ID NO: 5466 - protein, 788 aa, Pinus taeda
NSARGADEAERGITIKSTGISLYYEMEDAAVKNFKGDREGHEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDCQVYPEKGTVAFSAGLHGWAFTLTNFAKMYASKFGVDEAKMMERLWGENFFDPATKKWTTKNTGSATCKRGFVQFIYEPIKQIINICMNDQKDKLWPMLQKLGVVMKSDEKELVAKALMKRVMQTWLPASSALLEMMIFHLPSPAKAQRYRVENLYEGPLDDIYATAIRNCDPEGPLMLYVSKMIPASDKGRFFAFGRVFAGRVATGMKVRIMGPNYVPGQKKDLYTKSVQRTVIWMGKKQESVEDVPCGNTVALVGLDQFITKNATLTSEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSCRTVMSKSPNKHNRLYFEARPLEEGLAEAIDDGRIGPKDDPKARAKILSEEFGWDKDLAKKIWCFGPETTGPNMVVDMCKGVQYLNEIKDSVVAAFQWASKEGALAEENMRGICFEVCDVVLHTDAIHRGGGQVIPTARRVMYASQLTAKPRLLEPVYLVEIQAPENALGGIYGVLNQKRGHVFEEMQRPGTPLYNIKAYLPVVESFGFSSTLRAATSGQAFPQCVFDHWDMMGSDPLESGSQAGQLVIDIRKRKGLKESMTPLSEYEDKL

SEQ ID NO: 5467 - protein, 376 aa, Pennisetum glaucum
MLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYPGPRKCTGWYLWCSEPEERSRV

SEQ ID NO: 5468 - protein, 788 aa, Papaver somniferum
MTDTRADEAERGITIKSTGISLYYEMSDESLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTASPTCKRGFVQFCYEPIKRIIATCMNDQKDELWPMLQKLGVTMKNDEKELIGKPLMKRVMQTWLPAATALLEMMIYHLPSPHTAQKYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEQGTQASDLVTEIRRRKGLKAQMTPLSDFEDKL

SEQ ID NO: 5469 - protein, 779 aa, Brassica napus
MVKFTSDELRRIMDYKHNIRNMSVIAHVDHGKSTLTDSLVAAAGIIAQEVAGDVRMTDTRADEAERGITIKSTGISLYYEMTDASLKSFTGARDGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATRKWSSKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDDGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESF

SEQ ID NO: 5470 - protein, 656 aa, Cirsium arvense
MVKFTAEELRRIMDYKHNIRNMSVIAHVDHGKSTLTDSLVAAAGIIAQEVAGDVRMTDTRADEAERGITIKSTGISLYYEMTDAALKSFKGERNGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVMVYPEKGTVAFSAGLHGWAFTLTNFAKMYASKFGVDESKMMERLWGENFFDPKTKKWTTKNSGSPTCKRGFVQFCYEPIKQIINTCMNDQKDLLWPMLTKLGVTMKSDEKELMGKALMKRVMQTWLPAATALLEMMIFHLPSPHTAQRYRVENLYEGPLDDAYANAIRNCDPDGPLMLYVSKMIPASDKGRFFAFGRVFAGKVSTGLKVRIMGPNYVPGEKKDLYVKSVQRTVIWMGKKQETVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQDDFMGGAEIVVSDPVVSFRETVLEKSSRTVMSKSPNKHNRLYMEARPMEEGLAELLMKGELGLGMTLRYVVRSWLRSLDGTRILQRKSGVLVLRLLGPTWWLICVRECST

SEQ ID NO: 5471 - protein, 778 aa, Platanus occidentalis
RGITIKSTGISLYYEMADDAVKNFKGDRQGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDESKMMERLWGENYFDPATKKWTSKNTGSPTCKRGFVQFCYEPIKQIINTCMNDQKDKLWPMLQKLGVVMKSDEKDLVGKALMKRVMQTWLPASSALLEMMIFHLPSPAKAQRYRVENLYEGPMDDIYATAIRNCDPEGPLMLYVSKMIPASDKGRFFAFGRVFAGKVSTGLKVRIMGPNYVPGQKKDLYVKSVQRTVIWMGKKQESVEDVPCGNTVALVGLDQFITKNATLTNEKEVDAHPIRAMKFSVSPVVRVAVQCKVASDLPKLVEGLKRLAKSDPMVVCTIEESGEHIIAGAGELHLEICLKDLQEDFMGGAEIVQSDPVVSFRETVMEKSIRTVMSKSPNKHNRLYMEARPMEEGLAEAIDEGRIGPRDDPKIRAKILAEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYGVLNQKRGHVFEEMQRPGTPLYNIKAYLPVVESFGFSSTLRAATSGQAFPQCVFDHWDMMSSDPLESGSQAATLVADIRKRKGLKEQMTPLSEFEDKL

SEQ ID NO: 5472 - protein, 673 aa, Secale cereale
MDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQ

SEQ ID NO: 5473 - protein, 831 aa, Eutrema parvulum
MDRKNNIRNMSVIAHVDHGKSTLTDSLVAAAGIIEQEVAGDVRMTDPREDEAERGMTIKSTGISLYYQMEDESLENYKGERDGNEYLINLIDTPGHVDFSSEVTAALRITDGALVVVDCIEGVCVQTETVLRQALGERIRPVLTVNKMDRCFLELQVEGEEAYQTLQRVVENANVIMATYEDPLLGDVQVYPEKGTVAFSAGLHGWAFTLTNFANMYASKFGVDESKMMERLWGENFFDPATGKWTSKSTGSSTCKRGFVQFCYEPIKKIINTCMNDDKSKLWPMLQKLGVTMKSDENELMGKHLMKRVMQNWLPASGALLEMMIFHLPSPSIAQRYRVENLYEGSLDDKYATAIRNCDPEGPLMLYVSKMIPSSDKGRFFAFGRVFSGKVETGMKVRIMGPNFVSGEKKELHVESVQRTVIWMGKRQETVEDVPCGNTVALVGLDQFITKNATLTNEKEVDAHTIRAMKFSVSPVVRVAVQCKVASDLPKLVDGLERLAKSDPMVVCTMEESGEHIIAGAGELHLEMCLKDLQDDFMGGAEIIKSDPVVSFRETVLERSCRRVMIKSPNKHNRLYMEARPLEEGLAESIDDGIIGPRDDPKARAKIFSEQFGWDKDLAKKIWAFGPETTGPNIVVDMCKGVQYLNTIKESVVSGFQWASKEGILCEENMRGICFEVCDVVLHSHPIRRPGGQVIAMARRGCYASQITAKPRLVEPVYLVEIQAPEQALGGIYSLLNQKRGHVFEELQRQGTPLYNIKAYLPVSESFGFSRQLRAATSEQAFSQAIFDHWDVLTLDPMENGSQASAIVADIRKRKGLKLQITPVSELEDKL

SEQ ID NO: 5474 - protein, 755 aa, Saccharum officinarum
MVKFTAEELRAIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDEAKMMERLWGENFFDPATKKWTTKSTGSPTCKRGFVQFCYEPIKQIIKTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLAEAIDEGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHV

SEQ ID NO: 5475 - protein, 843 aa, Medicago truncatula
MVKFTVDELRRIMDLKHNIRNMSVIAHVDHGKSTLTDSLVAAAGIIAQEVAGDVRMTDTRQDEAERGITIKSTGISLYYEMSDGDLKNFKGEREGNKYLINLIDSPGHVDFSSEVTAALRITDGALVVVDCVEGVCVQTETVLRQALGERIKPVLTVNKMDRCFLELHLDAEEAYSTIQRVIESVNVVMATYEDALLGDVQVYPEKGTVSFSAGLHGWSFTLTNFAKMYASKFGVDEEKMMNRLWGENFFDSSTKKWTNKHTSTPTCKRGFVQFCYEPIKQIIELCMNDQKDKLWPMLQKLGVNLKSEEKELSGKALMKRVMQSWLPASSALLEMMIFHLPSPTKAQKYRVENLYEGPLDDPYASAIRNCDPEGPLMLYVSKMIPASDKGRFYAFGRVFSGKVSTGMKVRIMGPNYIPGEKKDLYVKSVQRTVIWMGKKQETVEDVPCGNTVAMVGLDQFITKNATLTNEKEVDAHPIRAMKFSVSPVVSVAVTCKVASDLPKLVEGLKRLAKSDPMVVCTISETGEHIIAAAGELHLEICLKDLQDDFMNGAEITKSDPIVSFRETVLEKSSHTVMSKSPNKHNRLYMEARPMEEGLAEAIDDGRIGPRDEPKNHLKILSDEFGWDKDLAKKVWCFGPETTGPNMLVDTCKGVQYLNEIKDSVVAGFQIASKEGPMADENLRGVCFEVCDVVLHTDAIHRGGGQIIPTARRVFYAAMLTAKPRLLEPVYLVEIQAPEHALGGIYSVLNQKRGHVFDEIQRPNTPLYNVKAYLPVIESFQFNESLRAQTGGQAFPQLVFDHWDMVPSDPLEPGTPAAARVVEIRKKKGLKEQLIPLSEFEDRL

SEQ ID NO: 5476 - protein, 842 aa, Secale cereale
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTTKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGVVRLSQRRGGSFTLLSSLPSQGCWSQSTWLRSRPRRTHLVVSMVFSIRREGTCSRRCRGKVPHSTTSRPTCLSSSPSVLEHPEGGDVRPGLPPVRVRPLGHHGFRPSGPRHPVGDAGDGDPQEEGSQGADDPPIRFRGQA

SEQ ID NO: 5477 - protein, 782 aa, Aristolochia fimbriata
DEAERGITIKSTGISLYYEMDDASLKSYKGERSGNEYLINLIDSPGHVDFSSEVTAALRITDGALVVVDCIEGVCVQTETVLRQALGERIKPVLTVNKMDRCFLELKVKGEKAYQTFSRVIENANVIMATYEDPLLGDCQVYPEKGTVAFSAGLHGWAFTLTNFAKMYASKFGVDESKMMERLWGENYFDPSTKKWTTRNTGTPTCKRGFVQFCYEPIKQIINTCMNDQKDKLWPMLTKLGVTMKSDEKELIGKPLMKRVMQTWLPASSALLEMMIFHLPSPSKAQKYRVENLYEGPLDDQYANAIRNCDPEGPLMLYVSKMIPASDKGRFFAFGRVFSGKVSTGMKVRIMGPNYVPGQKKDLYVKNVQRTVIWMGKKQESVEDVPCGNTVAMVGLDQFITKNATLTGEKEVDAHPIRAMKFSVSPVVRVAVQCKVASDLPKLVEGLKRLAKSDPMVVCSIEESGEHIVAGAGELHLEICLKDLQDDFMGGAEIIVSPPVVSFRETVLEKSCRTVMSKSPNKHNRLYMEARPMEEGLAEAIDEGRIGPRDDPKSRSKILSEEFGWDKDLARKIWCFGPETTGPNMVVDVCKGVQYLNEIKDSVVAGFQWASKEGALAEENMRAICFEVCDVVLHADAIHRGGGQVIPTARRVIYASQLTAKPRLLEPVYLVEIQAPEQALGGIYGVLNQKRGHVFEELQRPGTPLYNIKAYLPVIESFGFSTDLRAATSGQAFPQCVFDHWDMMSSDPMEATSQAGLLVAEIRKRKGLKEQMTPLSEFEDKL

SEQ ID NO: 5478 - protein, 600 aa, Pinus taeda
MDRCFLELQVDGEEAYQTFSRVIENANVIMATYEDPLLGDCQVYPEKGTVAFSAGLHGWAFTLTNFAKMYASKFGVDEAKMMERLWGENFFDPATKKWTTKNTGSATCKRGFVQFIYEPIKQIINICMNDQKDKLWPMLQKLGVVMKSDEKELVAKALMKRVMQTWLPASSALLEMMIFHLPSPAKAQRYRVENLYEGPLDDIYATAIRNCDPDGPLMLYVSKMIPASDKGRFFAFGRVFAGRVATGMKVRIMGPNYVPGQKKDLYTKSVQRTVIWMGKKQESVEDVPCGNTVALVGLDQFITKNATLTSEKEVDAHPIRAMKFSVSPVVRVAVQCKVASDLPKLVEGLKRLAKSDPMVVCTIEESGEHIIAGAGELHLEICLKDLQEDFMGGAEIVVSDPVVSFRETVLEKSCRTVMSKSPNKHNRLYFEARPLEEGLAEAIDDGRIGPKDDPKARAKILSEEFGWDKDLAKKIWCFGPETTGPNMVVDMCKGVQYLNEIKDSVVAAFQWASKEGALAEENMRGICFEVCDVVLHTDAIHRGGGQVIPTARRVMYASQLTAKPRLLEPVYLVEIQAPENALGGIYGVLNQKRGHVFEEM

SEQ ID NO: 5479 - protein, 379 aa, Triticum aestivum
LVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPAC

SEQ ID NO: 5480 - protein, 763 aa, Gossypium hirsutum
MSDDSLKSYKGERQGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTTKNTGSGTCKRGFVQFCYEPIKQIINTCMNDQKDKLWPMLQKLGVTMKSDEKDLMGKSLMKRVMQTWLPASSALLEMMIFHLPSPSKAQKYRVENLYEGPLDDVYANAIRNCDPEGPLMLYVSKMIPASDKGRFYAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQEDFMGGAEIIKSDPVVSFRETVLERSCRTVMSKSPNKHNRLYMEARPLEEGLAEAIDEGRIGPRDDPKVRSKILAEEYGWDKDLAKKIWCFGPETTGPNMVVDMCKGVQYLNEIKDSVVAGFQWASKEGAMAEENMRGICFEVCDVVLHTDAIHRGGGQIIPTARRVFYASQLTAKPRLLEPVYLVEIQAPEQALGGIYSVLNQKRGHVFEEMQRPGTPLYNIKAYLPVIESFGFSSTLRAATSGQAFPQCVFDHWDMMSSDPLEPGSQAANHVAEIRKRKGLKEQMTPLSDYEDKL

SEQ ID NO: 5481 - protein, 764 aa, Trigonella foenum-graecum
MVKFTADELRRIMDYKHNIRNMSVIAHVDHGKSTLTDSLVAAAGIIAQEVAGDVRMTDTRADEAERGITIKSTGISLYYEMTDESLSRYKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDETKMMERLWGENFFDPATKKWTTKNTGAASCKRGFVQFCYEPIKQIINTCMNDQKDKLWPMLTKLGVTMKSDEKDLMGKPLMKRVMQTWLPASTALLEMMIFHLPSPSTAQRYRVENLYEGPLDDQYANAIRNCDPEGPLMLYVSKMIPASDKGRFFAFGRVFAGKVSTGMKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLVDDFMGGAEIIVSDPVVSFRETVLERSCRTVMSKSPNKHNRLYMEARPLEDGLAEAIDDGKIGPRDDPKNRSKILSEDYGWDKDLAKKIWCFGPETTGPNMVVDMCKGVQYLNEIKDSVVAGFQWASKEGALSEENMRAICFEVCDVVLHTDAIHRGGGQIIPTARRVFYASQLTAKPRLLEPVYMVEIQAPEQALGGIYSVLNQKRGHVFVRNSRGLV

SEQ ID NO: 5482 - protein, 515 aa, Secale cereale
MKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQASPSACSTTGTSWLPTLWTPAPSRRRW

SEQ ID NO: 5483 - protein, 764 aa, Cucumis sativus
FNFLCVQVKFTAEELRRIMDYKHNIRNMSVIAHVDHGKSTLTDSLVAAAGIIAQEVAGDVRMTDTRQDEAERGITIKSTGISLYYEMSDESLKSYKGERHGNEYLINLIDSPGHVDFSSEVTAALRITDGALVVVDCIEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEAKMMERLWGENFFDPATKKWTSKNTGTATCKRGFVQFCYEPIKQIIATCMNDRKDKLWPMLQKLGVVMKSDEKDLMGKPLMKRVMQTWLPASTALLEMMIFHLPSPAKAQKYRVENLYEGPQDDVYASAIRNCDPEGPLMLYVSKMIPASDKGRFFAFGRVFSGKVSTGLKVRIMGPNYVPGEKKDLYVKSVQRTVIWMGKKQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIIKSDPVVSFRETVLERSCRTVMSKSPNKHNRLYMEARPMEDGLAEAIDDGRIGPRDDPKVRSKILSEEFAWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPEQALGGIYSVLNQKRGHVFEE

SEQ ID NO: 5484 - protein, 703 aa, Secale cereale
EHVGYCSCRPRQVYAYGFPCGSCWELLPTEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDESKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAK

SEQ ID NO: 5485 - protein, 684 aa, Brassica napus
MDRCFLELQVDGEEAYQTFQRVIENANVIMATYEDPLLGDVQVYPEKGTVAFSAGLHGWAFTLTNFAKMYASKFGVDETKMMERLWGENFFDPATRKWSGKNTGSATCKRGFVQFCYEPIKQIIATCMNDQKDKLWPMLQKLGVQMKSDEKELMGKPLMKRVMQTWLPASTALLEMMIFHLPSPHTAQRYRVENLYEGPLDDQYATAIRNCDPNGPLMLYVSKMIPASDKGRFFAFGRVFSGKVSTGMKVRIMGPNFVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTMEESGEHIVAGAGELHLEICLKDLQDDFMGGAEIVKSDPVVSFRETVLERSVRTVMSKSPNKHNRLYMEARPLEDGLAEAIDEGRIGPRDDPKIRSKILAEEFGWDKDLAKKIWAFGPETTGPNMVVDMCKGVQYLNEIKDSVVAGFQWASKEGPLCDENMRGICFEVCDVVLHSDAIHRGGGQVIPTARRVIYASQLTAKPRLLEPVYMVEIQAPEGALGGIYSVLNQKRGHVFEEMQRPGTPLYNIKAYLPVVESFGFSSQLRAATSGQAFPQCVFDHWEMMSSDPLEAGSQASTLVTDIRKRKGMKEQMTPLSDFEDKL

SEQ ID NO: 5486 - protein, 750 aa, Papaver somniferum
MGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTNSPTCKRGFVQFCYEPIKQIIATCMNDQKDKLWPMLQKLGVTMKNDEKELIGKPLMKRVMQTWLPAATALLEMMIYHLPSPHTAQKYRVENLYEGPLDDQYANAIRNCDPEGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYLVEIQAPEGALGGIYGVLNQKRGHVFEEMQRPGTPLYNIKAYLPVVESFGFSAQLRAATSGQAFPQSVFDHWDMMMADPLEAGTQAAELVTDIRKRKGLKAQMTPLSDFEDKL

SEQ ID NO: 5487 - protein, 557 aa, Papaver somniferum
MNDQKDKLWPMLQKLGVTMKNDEKELIGKPLMKRVMQTWLPAATALLEMMIYHLPSPHTAQKYRVENLYEGPLDDQYANAIRNCDPDGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLEPVYMVEIQAPEGALGGIYGVLNQKRGHVFEEMQRPGTPLYNIKAYLPVVESFGFSAQLRAATSGQAFPQSVFDHWDMMMADPLEPGTQAAELVADIRKRKGLKIQMTPLSDFEDKL

SEQ ID NO: 5488 - protein, 848 aa, Cajanus cajan
VVYHEQVNFTVDELRRIMDRKHNIRNMSVIAHVDHGKSTLTDSLVAAAGIIAQEVAGDVRMTDTRQDEAERGITIKSTGISLYYEMTEGDLKNFKGEREGNEFLINLIDSPGHVDFSSEVTAALRITDGALVVVDCVEGVCVQTETVLRQALGERVKPVLAVNKMDRCFLELNLDAEEAYLTFQRVVESANVIMATYEDALLGDVQVYPEKGTVAFSAGLHGWGFTITNFAKVYASKFGVDEAKMMSRLWGENFFDSATKKWTKKHTGTSTCKRGFVMFCYEPIKQIIQLCMNDQKDKLWPKLQQLGLKLKSEEKELTGKALMKRVMQSWLPANRALLEMMIFHLPSPASAQKYRVDNLYEGPLDDPYAHAIRNCDPDGPLMLYVSKMIPASDRGRFYAFGRVFSGKVSTGLKVRIMGPNYVPGKQKDLYVKSVQRTVIWMGKKQETVEDVPCGNTVAMVGLDHFITKNATLTNEKEVDAHPIRAMKFSVSPVVSVAVTSKVTSDLPKLIEGLKRLAKSDPMVVCTMSETGEHIISAAGELHLEICLKDLKDDFMNGAEISISDPIVSFRETVFERSCRTVMSKSPNKHNRLYVEARPMEDGLAEAIDDEKIGPGVDPRNRSKILSEEFGWDKDLARKIWCFGPEGKGPNMVIDTCKGVQYLNEIKDSVVAGFETASKSGPMAEENMRGVCFEICDVVLHADAIHRGGGQIIPTARRVFCAAMLTAKPRLLEPVYLVEIQAPEQALGDIYSVVNQKRGHVFEEIQRPGTPLYNIKAYLPVIESFRFNESLRAQTGGQAFPQLVFDHWDMVPSDPLEPGTPAAARVAEIRRKKGLKEQMMPLSEFEDRL

SEQ ID NO: 5489 - protein, 684 aa, Secale cereale
MDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTTKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 5490 - protein, 842 aa, Phaseolus vulgaris
VKFTVDQIRRIMDRKHNIRNMSVIAHVDHGKSTLTDSLVAAAGIIAQEVAGDVRMTDTRQDEVERGITIKSTGISLYYEMAEGDLKNFKGEREGNEFLINLIDSPGHVDFSSEVTAALRITDGALVVVDCVEGVCVQTETVLRQALGERVKPILAVNKMDRCFLELNLDPEEAYLTFQRVVESANVIMATYEDALLGDIQVYPEKGTVVFSAGLHGWGFTLTNFAKMYASKFGVDEAKMMSRLWGANFFDSATKKWTNKHTGTSTCKRGFVMLCYEPIKHIIELCMSDQRAELWPKLQKLGVNMKSEEKDLTGKALMKRVMQSWLPASSALLEMMIYHLPSPASAQQYRVQNLYNGPLDDPYASAIRSCDPEGPLMLYVSKMIPASDSGRFYAFGRVFSGRVSTGLKVRIMGPNYVPGDKKDLYVKSVQRTVIWMGKKQETVEDVPCGNTVAMVGLDQFITKNATLTNEKEVDAHPIRAMKFSVSPVVSVAVTSRVPSDLPKLQEGLKRLAKSDPMVVCTMSETGEHIISAAGELHLEICLKDLQVDFMNGAEVSISDPIVSFRETVVERSCRTVMSKSPNKHNRLYMEAGPMEDGLAKAIDDEKIGPGIDPKNRSKILSEEFGWDKDLAKKIWCFGPEGKGPNMLVDTCKGVHYLSEIKDSVVAGFELASKGGPMADENMRGVCFEICDVVLHADAIHRGGGQIIPTARRVFYAATLTAKPRLLEPVYLVEIQAPEQVLGGIYSVLNQKRGHVFEEIQRSGTPLYNVKAYLPVIESFKFNESLRAQTGGQAFPQLVFDHWDLVSSDPLEPGTPAAARVAEIRRKKGLKEQITPLSEFEDRL

SEQ ID NO: 5491 - protein, 734 aa, Papaver somniferum
MVKFTAEELRRIMDLKHNIRNMSVIAHVDHGKSTLTDSLVAAAGIIAQETAGDVRMTDTRADEAERGITIKSTGISLYYEMSDESLKAYKGDRMGNEYLINLIDSPGHVDFSSEVTAALRITDGALVVVDCIEGVCVQTETVLRQALGERIRPVLTVNKMDRCFLELQVDGEEAYQTFSRVIENANVIMATYEDPLLGDVQVYPEKGTVAFSAGLHGWAFTLTNFANMYASKFGVEHSKMMERLWGENFFDPATKKWTNKRTASPTCKRGFVQFCYEPIKQIIATCMNDQKDKLWPMLQKLGVVMKNDEKELIGKPLMKRVMQTWLPAATALLEMMIYHLPSPHTAQKYRVENLYEGPLDDQYANAIRNCDPDGPLMLYVSKMIPASDKGRFFAFGRVFAGKVATGAKVRIMGPNYVPGGKKDLYTKSVQRTVIWMGKKQESVEDVPCGNTVALVGLDQFITKNATLTNEKEVDAHPIRAMKFSVSPVVRVAVQCKVASDLPKLVEGLKRLSKSDPMVVCTIEESGEHIIAGAGELHLEICLKDLQDDFMGGAEIVKSDPVVSFRETVLEKSSRTVMSKSPNKHNRLYMEARPLEDGLAEAIDDGRIGPRDDPKVRSKILSEEFGWDKDLAKKIWCFGPDTTGPNMVVDMCKGVQYLNEIKDSVVAGFQWASKEGVLAEENMRGICFEVCDVVLHSDAIHRGGGQVIPTARRVMYASQLTAKPRLLRTCVPSRN

SEQ ID NO: 5492 - protein, 848 aa, Phaseolus vulgaris
LDYHVQVKFTVDQIRRIMDRKHNIRNMSVIAHVDHGKSTLTDSLVAAAGIIAQEVAGDVRMTDTRQDEVERGITIKSTGISLYYEMAEGDLKNFKGEREGNEFLINLIDSPGHVDFSSEVTAALRITDGALVVVDCVEGVCVQTETVLRQALGERVKPILAVNKMDRCFLELNLDPEEAYLTFQRVVESANVIMATYEDALLGDIQVYPEKGTVVFSAGLHGWGFTLTNFAKMYASKFGVDEAKMMSRLWGANFFDSATKKWTNKHTGTSTCKRGFVMLCYEPIKHIIELCMSDQRAELWPKLQKLGVNMKSEEKDLTGKALMKRVMQSWLPASSALLEMMIYHLPSPASAQQYRVQNLYNGPLDDPYASAIRSCDPEGPLMLYVSKMIPASDSGRFYAFGRVFSGRVSTGLKVRIMGPNYVPGDKKDLYVKSVQRTVIWMGKKQETVEDVPCGNTVAMVGLDQFITKNATLTNEKEVDAHPIRAMKFSVSPVVSVAVTSRVPSDLPKLQEGLKRLAKSDPMVVCTMSETGEHIISAAGELHLEICLKDLQVDFMNGAEVSISDPIVSFRETVVERSCRTVMSKSPNKHNRLYMEAGPMEDGLAKAIDDEKIGPGIDPKNRSKILSEEFGWDKDLAKKIWCFGPEGKGPNMLVDTCKGVHYLSEIKDSVVAGFELASKGGPMADENMRGVCFEICDVVLHADAIHRGGGQIIPTARRVFYAATLTAKPRLLEPVYLVEIQAPEQVLGGIYSVLNQKRGHVFEEIQRSGTPLYNVKAYLPVIESFKFNESLRAQTGGQAFPQLVFDHWDLVSSDPLEPGTPAAARVAEIRRKKGLKEQITPLSEFEDRL

SEQ ID NO: 5493 - protein, 508 aa, Pteridium aquilinum
MVFHLPSPAKAQRYRVENLYEGPLDDQYANAIRNCDPEGPLMLYVSKMIPASDKGRFFAFGRVFAGKVSTGSKVRIMGPNYVPGQKKDLYVKSVQRTVIWMGRRQESVEDVPCGNTVAMVGLDQYITKNATLTNEKEVDAHPIRAMKFSVSPVVRVAVQCKVASDLPKLVEGLKRLAKSDPMVICSIEESGEHIIAGAGELHLEICLKDLQDDFMGGAEIVVSDPVVSFRETVLEKSHHTVMSKSPNKHNRLYFEARPLEEGLAEAIDEGRIGPRDDPKVRSKILSEEFGWDKDLAKKIWCFGPETTGPNLVVDMCKGVQYLNEIKDSVVAAFQWATKEGALAEENMRGIAFEVCDVVLHADAIHRGGGQVIPTARRVMYASQLTAKPRLLEPVYLVEIQAPEQALGGIYGVLNQKRGHVFEEIQRPGTPLYNIKAYLPVIESFGFSGALRAATSGQAFPQCVFDHWDMMNSDPLEVGSPAAQHVIDIRKRKGLKEQLTPLSEYEDKL

SEQ ID NO: 5494 - protein, 469 aa, Triticum aestivum
MECKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEQFSISDADYCVFHSPYNKLVQKSFARLYFNDFMRNCSSVDNDAKEKLQPFANLTSEESYQSRDLEKGSQQLAKHLYDIKVQPSTLLPKQIGNMYTASLYAALASVIYNKHASLSGQRIVMFSYGSGLTSTMFSFKLNEGQHPFSLTNIASVLDVTAKLESRHVTSPEKFIDTLKLMEHRYGAKDFETSKDISLLPPGTFYLTKVDSMYRRFYEKKTDGIVDGKIKCSNGIANGH

SEQ ID NO: 5495 - protein, 469 aa, Secale cereale
MECKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEQFSISDADYCVFHSPYNKLVQKSFARLYFNDFMRNCSSVDNDAKEKLQPFANLTSEESYQSRDLEKGSQQLAKHLYDIKVQPSTLLPKQIGNMYTASLYAALASVIYNKHASLNGQRIVMFSYGSGLTSTMFSFKLNEGQHPFSLTNIASVLDVTAKLESRYVTSPEKFIDTLKLMEHRYGAKDFETSKDTSLLPPGTFYLTKVDSMYRRFYEKKTDGVVDGKIKCSNGIANGH

SEQ ID NO: 5496 - protein, 469 aa, Triticum aestivum
MECKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEKFSISDADYCVFHSPYNKLVQKSFARLYFNDFMRNCSSVDNDAKEKLQPFANLTSEESYQSRDLEKGSQQLAKHLYDIKVQPSTLLPKQIGNMYTASLYAALASVIYNKHASLSGQRIVMFSYGSGLTSTMFSFKLNEGQHPFSLTNIASVLDVTAKLESRHVTSPEKFIDTLKLMEHRYGAKDFETSKDISLLPPGTFYLTKVDSMYRRFYEKKTDSIVDGKIKCSNGIANGH

SEQ ID NO: 5497 - protein, 469 aa, Triticum aestivum
MECKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQNFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEQFSISDADYCVFHSPYNKLVQKSFARLYFNDFMRNCSSVDNDAKEKLQPFANLTSEESYQSRDLEKGSQQLAKHLYDIKVQPSTLLPKQIGNMYTASLYAALASVIYNKHASLTGQRIVMFSYGSGLTSTMFSFKLNEGQHPFNLANIASVLDVTAKLESRHVTSPEKFIDTLKLMEHRYGAKDFETSKDISLLPPGTFYLTKVDSMYRRFYEKKTDGIVDGKIKCSNGIANGH

SEQ ID NO: 5498 - protein, 469 aa, Triticum aestivum
MECKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEKFSISDADYCVFHSPYNKLVQKSFARLYFNDFMRNCSSVDNDAKEKLQPFANLTSEESYQSRDLEKGSQQLAKHLYDIKVQPSTLLPKQIGNMYTASLYAALASVIYNKHASLTGQRIVMFSYGSGLTSTMFSFKLNEGQHPFNLANIASVLDVTAKLESRHVTSPEKFIDTLKLMEHRYGAKDFETSKDISLLPPGTFYLTKVDSMYRRFYEKKTDGIVDGKIKCSNGIANGH

SEQ ID NO: 5499 - protein, 467 aa, Brachypodium distachyon
MECKDVGILAMDIYFPPTCVQQEALEAHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESKCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEQFSLSDADYCVFHSPYNKLVQKSFARLYFNDFMRNCSSVDNDAKEKLQPFANLTSEESYQNRDLEKGSQQLAKHLYDIKVQPSTLLPKQIGNMYTASLYAALASVLYNKHASLSGQRIVMFSYGSGLTSTMFSFRLNEGQHPFSLTNIASVLDVTAKLESRHVTSPEKFIATLKLMEHRYGAKDFETNKDTALLPPGTFYLTKVDSMYRRFYEKKAAADDKTKCSNGIANGH

SEQ ID NO: 5500 - protein, 469 aa, Avena sativa
MECKDVGILAMDMYFPPTCVQQEALEAHDGVSKGKYTIGLGQDCMAFCSEVEDVISMSLTVVKSLLEKYNIDPKLIGRLEVGSETVIDKSKSIKTWLMQIFEESGNTDIEGVDSSNACYGGTAALLNCVNWVESKCWDGRYGLVVCTDSAVYADGPARPTGGAAAIAMLVGPNAPISFESKYRASHMAHVYDFYKPDLASEYPVVDGKLSQTCYLMALDSCYNQYCAKYEKLVGEQFSISDADYCVFHSPYNKLVQKSFARLYFNDFMRNCSSVDNDAKEKLQPFVNLTSEESYQSRDLEKGSQQLAKHLYDIKVQPSTLLPKQIGNMYTASLYAALASVIYNKHASLSGQRILMFSYGSGLTSTMFSFRLNEGQHPFSLAKIASVLDVTAKLESRHETSPQKFIETLKLMEHRYGAKDFETNKDTSLLPPGTFYLTKVDSMYRRFYEEKTADGTADGNKCSNGIANGH

SEQ ID NO: 5501 - protein, 467 aa, Oryza sativa
MEQPNDVGILAMDIYFPPACVHQEALEAHDGASKGKYTIGLGQDCMAYCSEVEDVISMSLTVVASLLKKYNIDPKQIGRLEVGSETVIDKSKSIKTWLMHIFEESGNTDIEGVDSSNACYGGTAALLNCVNWVESKSWDGRYGLVVCTDSAVYAEGPARPTGGAAAIAMLIGPNAPISFESKYRASHMAHVYDFYKPDLASEYPVVDGKLSQTCYLMALDSCYRQYCTKYEKIVGEQFSISDAEYCVFHSPYNKLVQKSFARLYFNDFMRNCSTVDNDAKEKLQPFANLTSEESYQSRDLEKASQQVAKHLYDIKVQPSTLLPKQIGNMYTASLYAALASVIYNKHDSLDGQRILMFSYGSGLTSTMFSLRLHDGQHPFSLMNIASVLDVTTKLESRHVTSPEKFIETLKLMEHRYGAKDFETSKDTSLLPPGTFYLTKVDSMYRRFYDKKAAEGKIKGCNGIANGH

SEQ ID NO: 5502 - protein, 471 aa, Sorghum bicolor
MEEGKDVGILAMDIYFPPTCVQQEALEAHDGASKGKYTIGLGQDCMAFCSEVEDVVSMSLTVVASLLQKYNIDPKLIGRLEVGSETVIDKSKSIKTWLMQIFEESGNTDIEGVDSSNACYGGTAALLNCVNWVESKSWDGRYGLVVCTDSAVYAEGPARPTGGAAAIAMLIGPNAPISFERKYKASHMAHAYDFYKPDLASEYPVVDGKLSQTCYLMALDSCYKQFCTKYEKLVGEQFSISDADYCVFHSPYNKLVQKSFARLFFNDFMRNCSSVDNDAKEKLLPFANLNSEESYQSRDLEKASQQVAKHLYDIKVQPSTLLPKQIGNMYTASLYAALASVVYNKHNSLAGQRIIMFSYGSGLTSTLFSLRLHEGQHPFSLANIASMLDVTAKLNSRHVTPPEKFVETLKLMEHRYGAKDFETSQDTSLLPPGTFYLTKVDSMYRRFYDKKASDDIVWGKTKVSNALANSQ

SEQ ID NO: 5503 - protein, 470 aa, Sorghum bicolor
MDRKDVGILAMDIYFPPSCVQQEALEAHDGASKGKYTIGLGQDCMAFCSEVEDVISMSLTVVNSLLKKYKIDPKLIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIAGKQFSISDAEYFVFHSPYNKLVQKSFARLYYNDFMRNCSSVDDDAKEKLQSFSNLTGEESYQSRDLEKASQQVAKHLYDIKVQPSTLLPKQIGNMYTASLYAALASVLYNKHDSLNGHRIVMFSYGSGLTSTMFSLRLNNGQHPFSLSNIASVLDVTEKLQSRHETLPEKFVETLKLMEHRYGAKDFETSRDTSLLQPGTFYLTKVDSMYRRFYSQKLAEETGGGKTKCCNGFANGH

SEQ ID NO: 5504 - protein, 470 aa, Saccharum officinarum
MDRKDVGILAMDIYFPPSCVQQEALEVHDGASKGKYTIGLGQDCMAFCSEVEDVISMSLTVVNSLLKNYKIDPKLIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIAGKQFSISDAEYFVFHSPYNKLVQKSFARLYYNDFMRNCSFVDDDAKEKLQSFSNLTGEESYRSRDLEKASQQVAKHLYDIKVQPSTLLPKQIGNMYTASLYAALASVLYNKHDSLNGQRIVMFSYGSGLTSTMFSLRLNNGQHPFSLSNIASVLDVTEKLQSRHETLPEKFIETLKLMEHRYGAKDFETSRDTSLLQPGTFYLTKVDSMYRRFYSQKLAEETGGCKTKCCNGFANGH

SEQ ID NO: 5505 - protein, 470 aa, Setaria italica
MDRKDVGILAMDIYFPPSCVQQEALEAHDGASKGKYTIGLGQDCMAFCSEVEDVISMSLTVVNSLLKKYKVDPKLIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIVGKQFSISDAEYFVFHSPYNKLVQKSFARLCYNDFMRNCSSIDDDAKEKLQPFSNLTGEESYQSRDLEKASQQVAKHLYDIKVQPSTLLPKQIGNMYTASLYAALASVLYNKHDSLDGQRIVMFSYGSGLTSTMFSLRLNNGQHPFSLSNIASVLGVTEKLQSRHETLPEKFIETLKLMEHRYGAKDFETNKDTSLLPPGTFYLTHVDSMYRRFYDQKPVEETAGGKAKCCNGFANGH

SEQ ID NO: 5506 - protein, 468 aa, Panicum virgatum
MAGRNDVGILAMDIYFPPTCVQQEALEAHDGVSKGKYTIGLGQDCMAFCSEVEDVISMSLTVVNSLLKKYNIDPKLIGRLEVGSETVIDKSKSIKTWLMQIFEKSGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIVGKQFSISDAEYFVFHSPYNKLVQKSFARLYYNDFMRNCSSIDDDAKEKLQPFSNLTGEESYQSRDLEKASQQVAKHLYDIKVQPSTLLPKQIGNMYTASLYAALASVLYNKHDSLDGQRIVMFSYGSGLTSTMFSLRLNNGQHPFSLSNIASVLGVTEKLQSRHETLPEKFIDTLKLMEHRYGAKDFETSRDTSLLPPGTFYLTHVDSMYRRFYDQKPVEGGKAKCCNGFANGH

SEQ ID NO: 5507 - protein, 470 aa, Zea mays
MDRKDVGILAMDIYFPPSCVQQEALEAHDGASKGKYTIGLGQDCMAFCSEVEDVISMSLTVVNSLLKKYKIDPKLIGRLEVGSETVIDKSKSIKTWLMQIFEESDNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIAGKQFSISDAEYFVFHSPYNKLVQKSFARLYYNDFMRNCSYVDDDAKEKLQSFSNLTGEESYQSRDLEKASQQVAKHLYGIKVQPTTLLPKQIGNMYTASLYAALASVLYNKHDSLNGQRIVMFSYGSGLTSTMFSLRLNNGQHPFSLSNIASVLDVTEKLQSRHETLPEKFVETLKLMEHRYGAKDFETSRDTSLLQPGTFYLTKVDSMYRRFYSQKLSEETGGGKTKCCNGLANGH

SEQ ID NO: 5508 - protein, 471 aa, Saccharum officinarum
MEERKDVGILAMDIYFPPTCVQQEALEAHDGASKGKYTIGLGQDCMAFCSEVEDVVSMSLTVVASLLRKYNVDPKLIGRLEVGSETVIDKSKSIKTWLMQIFEESGNTDIEGVDSSNACYGGTAALLNCVNWVESKSWDGRYGLIVCTDSAVYAEGPARPTGGAAAMAMLIGPDAPISFERKYKALHMAHVYDFYKPDLASEYPVVDGKLSQTCYLMALDSCYRQFCTKYEKLVGEQFSISDADYCVFHSPYNKLVQKSFARLFFNDFMRNCSSVDNDAKEKLLPFANLTSEESYQSRDLEKASQQVAKHLYDIKVQPSTLLPKQIGNMYTASLYAALASVIYNKHNSLAGQRIIMFSYGSGLTSTLFSLRLHEGQHPFSLGNIASMLDVTAKLNSRHVMSPEKFVETLKLMEHRYGAKDFKTSQDTSLLPPGTFYLTKVDSMYRRFYDKKASDDIDWRKTKVSNAVANGQ

SEQ ID NO: 5509 - protein, 471 aa, Panicum virgatum
MAGRNDVGILAMDIYFPPTCVQQEALEAHDGASKGKYTIGLGQDCMAFCSEVEDVISMSLTVVNSLLKKYNIDPKLIGRLEVGSETVIDKSKSIKTWLMQIFEKSGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIVGKQFSISDAEYFVFHSPYNKLVQKSFARLYYNDFMRNCSSIDDDAKEKLQPFSNLTGEESYQSRDLEKTSQQVAKHLYDIKVQPSTLLPKQIGNMYTASLYAALASVLYNKHDSLDGQRIVMFSYGSGLTSTMFSLRLNNGQHPFSLSNIASVLGVTEKLQSRHETLPEKFVDTLKLMEHRYGAKDFETSRDTSLLPPGTFYLTHVDSMYRRFYDQKPAEETTGGKAKCCNGFANGH

SEQ ID NO: 5510 - protein, 471 aa, Panicum virgatum
MAGRKDVGILAMDIYFPPTCVQQEALEAHDGASKGKYTIGLGQDCMAFCSEVEDVISMSLTVVNSLLKKYNVDPKLIGRLEVGSETVIDKSKSIKTWLMQIFEKSGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIVGKPFSISDAEYFVFHSPYNKLVQKSFARLYYNDFMRNCSSIDDDAKEKLQPFSNLTGEESYQSRDLEKTSQQVAKHLYDIKVQPSTLLPKQIGNMYTASLYAALASVLYNKHDSLDGQRIVMFSYGSGLTSTMFSLRLNNGQHPFSLSNITSVLGVTEKLQSRHETLPEKFVDTLKLMEHRYGAKDFETSRDTSLLPPGTFYLTHVDSMYRRFYDQKPAEETTGGKAKCCNGFANGH

SEQ ID NO: 5511 - protein, 470 aa, Pennisetum glaucum
MDRKDVGILAMDIYFPPTCVQQEALEAHDGASKGKYTIGLGQDCMAFCSEVEDVISMSLTVVNSLLKKYMVDPKLIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKITGKQFSISDAEYFVFHSPYNKLVQKSFARLYYNDFMRNCSSIDDDAKAKLQPFSNLTGEESYQSRDLEKTSQQVAKHLYDIKVQPSTVLPKQIGNMYTASLYAALASVLYNKNDSLDGQRIVMFSYGSGLTSTMFSLRLNNGQHPFSLSNIASVLGVTEKLQSRHETLPEKFVETLKLMEHRYGGKDFETNKDTSLLPPGTFYLTHVDSMYRRFYDQKPVEEMVGSKAKCCNGFANGH

SEQ ID NO: 5512 - protein, 520 aa, Cenchrus ciliaris
  misc_feature (49)..(49): Xaa can be any naturally occurring amino acid
  misc_feature (51)..(51): Xaa can be any naturally occurring amino acid
SQSRAESTKTEPSSATAGPRVDALPPSVRSALPPAARERGDRERLGRVXEXDRKDVGILAMDIYFPPTCVQQEALEAHDGASKGKYTIGLGQDCMAFCSEVEDVISMSLTVVNSLLKKYKVDPKRIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRLFCNKYEKIAGKQFSISDAEYFVFHSPYNKLVQKSFARLYYNDFMRNCSSIDDDAKAKLQPFSNLTGEESYQSRDLEKTSQQVAKHLYDIKVQPSTVLPKQIGNMYTASLYAALASVLYNKHDSLDGQRIVMFSYGSGLTSTMFSLRLNNGQHPFSLSNIASVLGVTEKLQSRHETLPEKFVETLKLMEHRYGGKDFETNKDTSLLPPGTFYLTHVDSMYRRFYDQKPVEEMAGSKAKCCNGFANGH

SEQ ID NO: 5513 - protein, 476 aa, Oryza sativa
MDGRKDVGILAMDIYFPPTCVLQESLEAHDGASKGKYTIGLGQDCMAFCSEVEDVISMSMTVVTSLLKKYKVDPKLIGRLEVGSETVIDKSKSIKTWLMQIFEECGNTDIEGVDSSNACYGGTAALLNCVNWVESNSWDGRYGLVVCTDSAVYAEGPARPTGGAAAIAMLIGPNAPIAFESKYKASHMAHVYDFYKPDLASEYPVVDGKLSQTCYLMALDSCYRQFCKKYEKLAGKQFSISDADYFVFHSPYNKLVQKSFARLYYNDFTRDCSSVDNDAKEKLQPFSNLTGEESYQSRDLEKASQQVAKPLYDIKVQPSTLLPKQIGNMYTASLYAALASVLYNKHASLDDQRIVMFSYGSGLTSTMFSLKLNNGQDPFSLSNIASVLNATEKLESRHMTLPEKFVETLKLMEHRYGAKDFETCKDTSLLPPGTFYLTRVDSMYRRFYERKADEEIAAAKAKYSNGHATNGYANGH

SEQ ID NO: 5514 - protein, 464 aa, Panicum virgatum
MAAEAKDVGILAMDIYFPPTCVLQEELETHDGVSKGKYTIGLGQDSMAFCTEVEDVISMSLTVVKSLLKNYNIDPKCIGRLEVGSETVIDKSKSIKTWLMQIFEECGNTDIEGVDSSNACYGGTAALFNCVNWVESNSWDGRYGLVVCTDSAVYAEGPARPTGGAAAIAMLIGPNAPISFESKYRGSHMAHAYDFYKPDLASEYPVVDGKLSQTCYLMALDSCYNVFCKKYEKHEGKQFSIFDADYVVFHSPYNKLVQKSFARLCYNDFLRNCSTVDEESREKLAPYAGLSSEESYQSRDLEKASQQVAKKLYESKVQPTTLIPKQVGNMYTASLYAAFASVIYNRHETLAGQRIVMFSYGSGLTSTMFSFKINEGQHPFSLLNIANILDISKKLEARHVVPPKKFIETLKLMEHRYGAKDFVTSQDTSLLPAGTYYLTHVDSMYRRFYAVKDDAVTTAVSNGH

SEQ ID NO: 5515 - protein, 464 aa, Panicum virgatum
MAAEAKDVGILAMDIYFPPTCVLQEELETHDGVSKGKYTIGLGQDSMAFCTEVEDVISMSLTVVKSLLKNYNIDPKCIGRLEVGSETVIDKSKSIKTWLMQIFEEYGNTDIEGVDSSNACYGGTAALFNCVNWVESNSWDGRYGLVVCTDSAVYAEGPARPTGGAAAIAMLIGPNAPISFESKYRGSHMAHAYDFYKPDLASEYPVVDGKLSQTCYLMALDSCYNVFCKKYEKHEGKQFSIFDADYVVFHSPYNKLVQKSFARLCYNDFLRNCSTVDEESREKLAPYAGLSSEESYQSRDLEKASQQVAKKLYESKVQPTTLIPKQVGNMYTASLYAAFASVIYNRHETLAGQRIVMFSYGSGLTSTMFSFKINEGQHPFSLLNIANILDISKKLEARHVVPPKKFVETLKLMEHRYGAKDFVTSQDTSLLPAGTYYLTHVDSMYRRFYAMKDEGVTTAVSNGH

SEQ ID NO: 5516 - protein, 463 aa, Brachypodium distachyon
MAAERIKDVGILAMDIYFPPNCVLQEELETHDGVSKGKYTIGLGQDSMAFCTEVEDVISMSLTAVKSLLENYKIDPKTIGRLEVGSETVIDKSKSIKTWLMQIFEECGNTDIEGVDSSNACYGGTAALLNCVNWVESNSWDGRYGLVVCTDSAVYAEGPARPTGGAAAIAMLIGPNAPISFESKYRGSHMAHVYDFYKPDLASEYPVVDGKLSQTCYLMALDSCYNTFCKKYEKLEGKQFSIVDADSFVFHSPYNKLVQKSFARLYYNDFLRNCSIVDKDSREKLEPYSGLSSEESYQSRDLEKVCQQVAKHLYDTKVQPTTLIPKQLGNMYTASLYAAFASVLHNKHDTLAGQRIVMFSYGSGLTSTMFSFKINKGQHPFSLSNISNVLDISNKLESRHVVPPKKFVEALKLMEHRYGAKDFVTSQDISLLVPGTYYLTHVDSMYRRYYAVKGDAVPVSNGH

SEQ ID NO: 5517 - protein, 464 aa, Setaria italica
MASEAKDVGILAMDIYFPPTCVLQEELETHDGVSKGKYTIGLGQDSMAFCTDVEDVISMSLTVVKSLLKNYNIDPKCIGRLEVGSETVIDKSKSIKTWLMQIFEEYGNTDIEGVDSSNACYGGTAALFNCVNWVESNSWDGRYGLVVCTDSAVYAEGPARPTGGAAAIAMLIGPNAPISFESKYRGSHMAHAYDFYKPDLASEYPVVDGKLSQTCYLMALDSCYNVFCKKYEKHEGKQFSIFDADYVVFHSPYNKLVQKSFARLCYNDFLRNCSTVDEESREKLAPYAGLSSEESYQSRDLEKASQQVAKNLYESKVQPTTLIPKQVGNMYTASLYAAFASVIYNRHETLAGQRIVMFSYGSGLTSTMFSFKINEGEHPFSLLNIANVLDVSKKLEARHVVPPKKFVEALKLMEHRYGAKDFVTSQDTSLLPAGTYYLTHVDSMYRRFYAAKDDGVTTAVSNGH

SEQ ID NO: 5518 - protein, 463 aa, Oryza sativa
MAAERKDVGILAMDIYFPPTCVLQDELENHDGVSKGKYTIGLGQDSMAFCTEVEDVISMSLTVVKSLLENYKIDPKCIGRLEVGSETVIDKSKSIKTWLMQIFEECGNTDIEGVDSSNACYGGTAALFNCVNWVESNSWDGRYGLVVCTDSAVYAEGPARPTGGAAAIAMLIGPNAPVSFESKYRGSHMAHVYDFYKPDLASEYPVVDGKLSQTCYLMALDSCYNVFCKKYEKLEGKQFSIHDADYFVFHSPYNKLVQKSFARLYYNDFLRKCSTVEDGSREKLEPYSGLSSEESYQSRELEKASQQVAKHLYDSKVQPTTLIPKQVGNMYTASLYAALASVMHNKNETLAGQRIVMFSYGSGLTSTMFSFKINEGQHPFILSNIAGILDVSKKLESRHVVAPEKFVAALKLMEHRYGAKDFTTSQDTSLLAPGTYYLTHVDSMYRRFYAVKGQAVTEVSNGH

SEQ ID NO: 5519 - protein, 464 aa, Sorghum bicolor
MASEAKNVGILAMDIYFPPNCVLQEELETHDGVSKGKYTIGLGQESMAFCTEVEDVISMSLTVVKSLLKNYNIDPKCIGRLEVGSETVIDKSKSIKTWLMQIFEESGNTDIEGVDSSNACYGGTAALFNCVNWVESNSWDGRYGLVVCTDSAVYAEGPARPTGGAAAIAMLIGPNAPISFESKYRGSHMAHVYDFYKPDLASEYPVVDGKLSQTCYLMALDSCYNVFCKKYEKNEGKQFSIFDADYVVFHSPYNKLVQKSFARLYYNDFLRNCSTVDEESREKLAPYAGLSSEESYQSRDLEKASQQVAKNLYDSKVQPTTLIPKQVGNMYTASLYAALASIIHNRHETLAGQRIVMFSYGSGLTSTMFSFKINEGQHPFSLLNIANIMDVSKKLKARHVVPPKKFVETLKLMEHRYGAKDFVTSQDTSLLSAGTYYLTHVDSMYRRFYDVKGDSVTTAISNGH

SEQ ID NO: 5520 - protein, 474 aa, Elaeis guineensis
MEERKDVGILAMDIYFPPTCVEQEALEAYDGASKGKYTIGLGQDCMAFCTELEDVISMSLTVVTSLLEKYQIDPKQIGRLEVGSETVIDKSKSIKTWLMQIFEEYGNTDVEGVDSTNACYGGTAALFNCVNWVESSSWDGRYGLVVCTDSAVYAEGPARPTGGAAAMAMLIGPNAPISFESKFRGTHMTHVYDFYKPNLASEYPVVDGKLSQTCYLMALDSCYKHFCSKYEKFEGKQFSIFDADYFVFHSPYNKLVQKSFARLYYNDFLHNPSSVEKDSREKLEPFSTLTGDESYQSRELEKTSQQVAKCLYDKKVQPSTLLPKQIGNMYTASIYAAFASVLHNKHSTLGGQRIVMFSYGSGLSSTMFSLKLRDGQHPFSLSNIATMLNVSEKLEARHVFLPEKFVETLKLMEHRYGAKDFVTGKETSLLSPGTFYLTKVDSMYRRYYAKKVAEGITNGKAAECNNKPLANGHS

SEQ ID NO: 5521 - protein, 465 aa, Zea mays
MASEAKDVGILAMDIYFPPSCVLQEELETHDGVSKGKYTIGLGQENMAFCTEVEDVISMSLTVVKSLLKNYNIDPKCIGRLEVGSETVIDKSKSIKTWLMQIFEESGNTDIEGVDSSNACYGGTAALFNCVNWVESNSWDGRYGLVVCTDSAVYAEGPARPTGGAAAIAMLIGPNAPISFESKYRGSHMAHVYDFYKPDLASEYPVVDGKLSQTCYLMALDSCYNVFCKKYEKHEGKQFSIFDADYVVFHSPYNKLVQKSFARLYYNDFLRNCSTVDEESREKLAPYAGLSSEESYQSRDLEKASQQVAKNLYESKVQPTTLIPKQVGNMYTASLYAALASVIHNRHETLAGQRIVMFSYGSGLTSTMFSFKINEGHHPFSLLNIANIMDVSKKLKARHVVPPKKFIEVLKLMEHRYGAKDFVTSQDTSLLSVGTYYLTHVDSKYRRFYDVKGDGVTTTAMSNGH

SEQ ID NO: 5522 - protein, 415 aa, Secale cereale
MSWLARSIAATLSSAPSDDEDDHSEAASGDKSPDHAANADDEEDEQPDTPGRGVKGDISELTESLTRRFWGVASFLAPPPPAGAEAAETSTAAAEAEAEGEHGPQSPRVAGIRNDLAEIGGRVRSGISMLSNANAVAEISKIASSFLPFVPEEEEEEEVDAVGVTEEVVVFVRHISTSPETWRDFPLFVNDRHADDFELSDTQYEHALAIERIVPSLSYLRTELCSTNMSEACFWKIYFVLLHSKLNKEDAELLSTTQILEAREELLQSSPRMKNVASEGLGGSSESSNVRSTQAEDIELSPSSIQDKSGMAEATSFQEPTPDPLPGAEADKHPISASEPEIVDKSVIEEELVVKTEIKNQGGKPNLYTPEDDDDKEVEDWLEDVDHADNKTGNITSIGQDEDVSFSDLEDDDDD

SEQ ID NO: 5523 - protein, 400 aa, Avena sativa
MSWFARSIAATLSSAPSDDDDDDHSGSNSGDKSPDHAADADVEEDEQPDTPSRGVKGDISELTESLTRRFWGVATFLAPPPAEADAAEDGAQSPRVAGIRSDLAEIGGRVRSGISMLSNANAVAEISKIASSFLPFVPEEEEDEVEAVGVTEEVVVFVRHISTHPETWRDFPLFVDDRHADDFELSDTQYEHALAIERIVPSLSYLRTELCSTNMNEACFWKIYFVLLHSKLNKQDAELLSTTQILEAREELLQSSPRMKKLGSEGPGGSSENKDTPSTEAEDREFSPSSIQYKSGVSEATSFQEPTPDPLPGVEAIKHPISTSEPEVVDKSVIEEELVVKNETNNIPAEKPNLYTPEDDEDKEVEEWLEDMDDVSSKTGNITSVGNDEDVSFSDLEDDD

SEQ ID NO: 5524 - protein, 401 aa, Hordeum vulgare
MQSAAAIGLIRPCAARPILKSPSPGAARLPASRVALRLSAAAPRAGLVAAAGLGRIGLVPASPEQEKRSGGLVAAAAAGKAAPGEEAGEESGAALAKTLQLGVFFGLWYLFNIYFNIYNKQVLKVFPYPINITTVQFAVGTTISLFMWATGILKRPKISGAQLLAILPLAIVHTMGNLFTNMSLGKVAVSFTHTIKAMEPFFSVLLSAMFLGELPTPWVVLSLLPIVGGVALASISEASFNWAGFLSAMASNVTFQSRNVLSKKLMLKKEASLDNINLFSIITVMSFFLLAPVTLLTEGVKVTPTFLQSAGLNLQQVYTRSLIAAFCFHAYQQVSYMILARVSPVTHSVGNCVKRVVVIVTSVLFFKTPVSPINSIGTAIALAGVFLYSQLKRLQPKPKAA

SEQ ID NO: 5525 - protein, 401 aa, Secale cereale
MQSAAAIGLLRPCAARPILKSPTPGAARLPASRVALRLSAAAPRAGLVAAAGLGRIGLVPASPEQEKRSDCLVAAAASGKAVGGEEAAEESGAALAKTLQLGVFFGLWYLFNIYFNIYNKQVLKVFPYPINITTVQFAVGTTISLFMWATGILKRPKISGAQLLAILPLAIVHTMGNLFTNMSLGKVAVSFTHTIKAMEPFFSVLLSAMFLGELPTPWVVLSLLPIVGGVALASISEASFNWAGFLSAMASNVTFQSRNVLSKKLMLKKEASLDNINLFSIITVMSFFLLAPVTLLTEGVKVTPTFLQSAGLNLQQVYTRSLIAAFCFHAYQQVSYMILARVSPVTHSVGNCVKRVVVIVTSVLFFKTPVSPINSIGTAIALAGVFLYSQLKRLQPKPKAA

SEQ ID NO: 5526 - protein, 129 aa, Triticum aestivum
MQSAAAIGLLRPCAARPILKSPSPGAARLPASRAALRLSAAAPRAGLVAAAGLGRIGLVPALPEQEKRSDCLVAAAASGKAAAGEEAGEESGAALAKTLQLGVFFGLWYLFNIYFNIYNKQVLKVFPFP

SEQ ID NO: 5527 - protein, 401 aa, Pseudoroegneria spicata
  misc_feature (45)..(45): Xaa can be any naturally occurring amino acid
MQSAAAIGLLRPCAARPILKSPSPGAARLPASRTALRLSPAAPRXGLVAAAGLGRIGLVPASPEQEKRSDCLVAAAASGKAAAGEEAGEEGGAALAKTLQLGVFFGLWYLFNIYFNIYNKQVLKVFPYPINITTVQFAVGTTISLFMWATGILKRPKISGAQLLAILPLAIVHTMGNLFTNMSLGKVAVSFTHTIKAMEPFFSVLLSAMFLGELPTPWVVLSLLPIVGGVALASISEASFNWAGFLSAMASNVTFQSRNVLSKKLMLKKEASLDNINLFSIITVMSFFLLAPVTLLTEGVKVTPTFLQSAGLNLQQVYTRSLIAAFCFHAYQQVSYMILARVSPVTHSVGNCVKRVVVIVTSVLFFKTPVSPINSIGTAIALAGVFLYSQLKRLQPKPKAA

SEQ ID NO: 5528 - protein, 405 aa, Brachypodium distachyon
MQSAAAIGLLRPCAARPFLKNPSPGGARLPASRSALRLSAVAPRAGIAAAAGLGRIRLVPLSPEQEERSGRCSRDVAAAAASGKAAAGEESGEEGGAALAKTLQLGVFFGLWYLFNIYFNIYNKQVLKVFPYPINITTVQFAVGTVISLFLWITGILKRPKISGAQLVAILPLAIVHTMGNLFTNMSLGKVAVSFTHTIKAMEPFFSVLLSAMFLGELPTPWVVLSLLPIVGGVALASISEASFNWAGFLSAMASNVTFQSRNVLSKKLMLKKEASLDNINLFSIITVMSFFLLAPVTLLTEGVKVTPTFLQSAGLNLQQVYTRSLIAAFCFHAYQQVSYMILARVSPVTHSVGNCVKRVVVIVTSVLFFKTPVSPINSIGTAIALAGVFLYSQLKRLQPKPKAA

SEQ ID NO: 5529 - protein, 401 aa, Avena sativa
MQSAAAIGLLRPCAARPILKNPSPSGARLPAARAALRLSAAAPRAGLVPAAAGLGRIGLVPASPEQEKRGDLVVVAAAAASGKAEEAGEEGGTALAKTLQLGVFFGLWYLFNIYFNIYNKQVLKVFPYPINITTVQFAVGTGISLFLWLTGILKKPKISGAQLLAILPLAIVHTMGNLFTNMSLGKVAVSFTHTIKAMEPFFSVLLSAMFLGELPTPWVVLSLLPIVGGVALASISEASFNWAGFLAAMASNVTFQSRNVLSKKLMLKKEASLDNITLFSIITVMSFFLLAPVALLTEGVKVTPAFLQSSGLNLQQVYTRSLIAAFCFHAYQQVSYMILARVSPVTHSVGNCVKRVVVIVTSVLFFKTPVSPINSIGTAIALAGVFLYSQLKRLQPKPKAA

SEQ ID NO: 5530 - protein, 393 aa, Sorghum bicolor
MQSAAAVGLVRPCAARPLPTYPSPRRGAGACSPPLLTTPRGLRLSARAGLVPASPLEEENRRCRHVAAAAGKVAAADTAGEEAGGGLAKTLQLGALFGLWYLFNIYFNIYNKQVLKVLPYPINITTVQFAVGSAIALFMWITGILKRPKISGAQLFAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFFLLAPVTLLTEGVKVSPAVLQSAGLNLKQVYTRSLIAAFCFHAYQQVSYMILARVSPVTHSVGNCVKRVVVIVTSVLFFRTPVSPINSLGTGIALAGVFLYSQLKRLKPKPKAA

SEQ ID NO: 5531 - protein, 401 aa, Saccharum officinarum
MQSAAAVGLVRPCAARPLPTYPSPRRGAGACIGGTTQPPLLTPRGLRLSARAGLLPASPLEEEESRRCRAGRHVAAAAGKVAAAEGAGEEAGGGLVKTLQLGALFGLWYLFNIYFNIYNKQVLKVLPYPINITTVQFTVGSAIALFMWITGILKRPKISGAQLLAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFFLLAPVTLLTEGVKVSPAVLQSAGLNLKQIYTRSLIAAFCFHAYQQVSYMILARVSPVTHSVGNCVKRVVVIVTSVLFFRTPVSPINSLGTGIALAGVFLYSQLKRLKPKPKAA

SEQ ID NO: 5532 - protein, 408 aa, Oryza sativa
MQSAAAVGLLRPCGATTAAAPLQLRNPSPRGFGVGVGQPLLPPRGLRLSAVAPRAGISARRIGLVPASPEQEDERRRGARDVAVAATAAAAGEAGAEEGGGLAKTLQLGALFGLWYLFNIYFNIYNKQVLKVFPYPINITNVQFAVGTVIALFMWITGILKRPKISGAQLAAILPLAMVHTMGNLFTNMSLGKVAVSFTHTIKAMEPFFSVLLSALFLGEMPTPFVVLSLVPIVGGVALASLTEASFNWAGFWSAMASNVTFQSRNVLSKKLMVKKEESLDNITLFSIITVMSFFLLAPVTLLTEGVKVTPTVLQSAGLNLKQIYTRSLIAAFCFHAYQQVSYMILARVSPVTHSVGNCVKRVVVIVTSVLFFRTPVSPINSLGTGVALAGVFLYSQLKRLKPKPKTA

SEQ ID NO: 5533 - protein, 394 aa, Panicum virgatum
MQSAAAIGLVRPCAARPLAACPSHRRYGAGAGHNPVLPARALRLSARAGLVPASPLEEEEKRRCRDVAASASAAAAAQGGGEEAGGGLMKTLQLGALFGLWYLFNIYFNIYNKQVLKVLPYPINITTVQFTVGTAIALFMWITGILKRPKISGAQLLAILPLAIVHTMGNLFTNMSLGKVAVSFTHTIKAMEPFFSVLLSAIFLGELPTPWVVLSLVPIVGGVALASLTEASFNWAGFWSAMASNVTFQSRNVLSKKLMVKKEESLDNINLFSIITVMSFFLLAPVTLLTEGVKVSPAVLQSAGLNLKQVYTRSLIAAFCFHAYQQVSYMILARVSPVTHSVGNCVKRVVVIVTSVLFFRTPVSPVNSLGTGVALAGVFLYSQLKRLKPKPKAA

SEQ ID NO: 5534 - protein, 390 aa, Zea mays
MQSAAAIGLLRPCAARPLAAYTSPRRGAGACSGGTQPLITPRGIRLSARPGLVPASPLEEKENRRCRASMHAAASAGEEAGGGLAKTLQLGALFGLWYLFNIYFNIYNKQVLKVLPYPINITTVQFAVGSAIALFMWITGIHKRPKISGAQLFAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFFLLAPVTLLTEGVKVSPAVLQSAGLNLKQVYTRSLIAAFCFHAYQQVSYMILARVSPVTHSVGNCVKRVVVIVTSVLFFRTPVSPINSLGTGIALAGVFLYSQLKRLKPKPKTA

SEQ ID NO: 5535 - protein, 396 aa, Panicum virgatum
MQSSAAIGLVRPCAARPLAACPSYRRGGAGAGAGLRPVLPASGLRLSARAGLVPASPLEEEEKRRCRDVAASASAAAAAQGGGEEAGGGLMKTLQLGALFGLWYLFNIYFNIYNKQVLKVLPYPINITTVQFTVGTAIALFMWITGILKRPKISGAQLLAILPLAIVHTMGNLFTNMSLGKVAVSFTHTIKAMEPFFSVLLSAIFLGELPTPWVVLSLVPIVGGVALASLTEASFNWAGFWSAMASNVTFQSRNVLSKKLMVKKEESLDNINLFSIITVMSFFLLAPVTLLTEGVKVSPAVLQSAGLNLKQIYTRSLIAAFCFHAYQQVSYMILARVSPVTHSVGNCVKRVVVIVTSVLFFRTPVSPVNSLGTGVALAGVFLYSQLKRLKPKAKAA

SEQ ID NO: 5536 - protein, 397 aa, Zea mays
MQSTAAIGLVRPCAARPLPTYPSPRRGAGACSGAAQPILAPRGLCLSARASLLPDSPLEEEYRRCRAGRHVAAAGKVAAADGAVEEAGGGLVKTLQLGSLFGLWYLFNIYFNIYNKQVLKVLPYPINITTVQFAVGSAIALFMWITGILKRPKISGAQLFAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFFLLAPVTLLTEGVKVSPAVLQSAGLNLKQIYTRSLIAACCFHAYQQVSYMILARVSPVTHSVGNCVKRVVVIVTSVLFFRTPVSPINSLGTGIALAGVFLYSQLKRLKPKPKAA

SEQ ID NO: 5537 - protein, 399 aa, Pennisetum glaucum
MQSAAAIGLVRPCAARPLVAYPSHRRGGAVSGGGIRPDLPQRGIRLSARAGLVPASPLEEEEKKRRCRAERDVSAAATAAAAQGAGEEAGGGLVKTLQLGALFGLWYLFNIYFNIYNKQVLKVLPYPINITTVQFAVGTAIAIFMWITGILKRPKISGTQLLAILPLAIVHTMGNLFTNMSLGKVAVSFTHTIKAMEPFFSVLLSAIFLGELPTPWVVLSLLPIVGGVALASLTEASFNWVGFWSAMASNVTFQSRNVLSKKLMVKKEESLDNINLFSIITVMSFCILAPVTLLTEGVKVSPAVLQSAGLNLKQIYTRSLIAAFCFHAYQQVSYMILARVSPVTHSVGNCVKRVVVIVTSVLFFRTPVSPVNSIGTGVALAGVFLYSQLKRLKPKPKAA

SEQ ID NO: 5538 - protein, 396 aa, Setaria italica
MQSAAAIGLVRPCAARPLVACPSHRRGGAVAGEGIRPVLPQRGIRLSARAGLVPASPLEEEEKRRCRAERDVSAAAAAAQEAGEEAGGGFAKTLQLGALFGLWYLFNIYFNIYNKQVLKVLPYPINITTVQFAVGTAIAMFMWITGILKRPKISGAQLLAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFCLLAPVTLLTEGVKVSPAVLQSAGLNLKQIYTRSLIAAFCFHAYQQVSYMILARVSPVTHSVGNCVKRVVVIVTSVLFFRTPVSPVNSLGTGVALAGVFLYSQLKRLKPKAKAA

SEQ ID NO: 5539 - protein, 112 aa, Secale cereale
MVKGRTGQRVRLYVRGTILGYKRSKSNQYETTSLVQIEGVNTREDVAWYGGKRMAYVYKAKTKSNGTHYRCIWGKVSRPHGNTGVVRAKFTSNLPAEAMGKKVRVFMYPSSI

SEQ ID NO: 5540 - protein, 112 aa, Avena sativa
MVKGRTGQRVRLYVRGTILGYKRSKSNQYESASLVQIEGVNTREDVAWYGGKRMAYVYKAKTKSNGTHYRCIWGKVSRPHGNSGVVRAKFTSNLPAEAMGRKVRVFMYPSSI

SEQ ID NO: 5541 - protein, 112 aa, Avena sativa
MVKGRTGQRVRLYVRGTILGYKRSKSNQYESASLVQIEGVNTREDVAWYGGKRMAYVYKAKTKSNGTHYRCIWGKVSRPHGNTGVVRAKFTSNLPAEAMGRKVRIFMYPSSI

SEQ ID NO: 5542 - protein, 112 aa, Lolium multiflorum
  misc_feature (43)..(43): Xaa can be any naturally occurring amino acid
MVKGRSGQRVRLYVRGTILGYKRSKSNQYESASLVQIEGVNTXEDVAWYGGKRMAYVYKAKTKSNGTHYRCIWGKVSRPHGNTGVVRAKFTSNLPAEAMGRKVRVFMYPSSI

SEQ ID NO: 5543 - protein, 112 aa, Avena sativa
MVKGRTGQRVRLYVRGTILGYKRSKSNQYESASLVQIEGVNTREDVAWYGGKRMAYVYKAKTKSNGTHYRCIWGKVSRPHGNSGVVRAKFTSNLPAEAMGRKVRIFMYPSSI

SEQ ID NO: 5544 - protein, 112 aa, Brachypodium distachyon
MVKGRTGQRVRLYVRGTILGYKRSKSNQYETTSLVQIEGVNTKEDVAWYGGKRMAYVYKAKTKSDGTHYRCIWGKVSRPHGNSGVVRAKFKSNLPAEAMGRKVRVFMYPSSI

SEQ ID NO: 5545 - protein, 112 aa, Cynodon dactylon
MVKGRTGQRVRLYVRGTILGYKRSKSNQYETTSLVQIEGVNTKEDVAWYAGKRMAYIYKAKTKSNGTHYRCIWGKVTRPHGNSGVVRAKFKHNLPAESMGRKVRVFMYPSSI

SEQ ID NO: 5546 - protein, 112 aa, Unknown
  Sequence found in Organisms: Pennisetum glaucum, Cenchrus ciliaris, Setaria italica
MVKGRTGQRVRLYVRGTILGYKRSKSNQYETTSLVQIEGVNTKEDVAWYAGKRMAYIYKAKTKSNDTHYRCIWGKVTRPHGNSGVVRAKFKSNLPPESMGRKVRVFMYPSSI

SEQ ID NO: 5547 - protein, 112 aa, Panicum virgatum
MVKGRTGQRVRLYVRGTILGYKRSKSNQYENTSLVQIEGVNTKEDVAWYCGKRMAYIYKAKTKSSGTHYRCIWGKVTRPHGNSGVVRAKFKSNLPPESMGRKVRVFMYPSSI

SEQ ID NO: 5548 - protein, 112 aa, Eragrostis curvula
MVKGRTGQRVRLYVRGTILGYKRSKSNQYENTSLVQIEGVNTKEDVAWYSGKRLAYIYKAKTKSSGTHYRCIWGKVSRPHGNSGVVRAKFKSNLPPESMGRKVRVFMYPSSI

SEQ ID NO: 5549 - protein, 112 aa, Zea mays
MVKGRTGQRVRLYVRGTVLGYKRSKSNQYETTSLVQIEGVNTKEDVAWYCGKRMAYIYKAKTKSSGTHYRCIWGKVARPHGNSGVVRAKFRSNLPPESMGRKVRVFMYPSSI

SEQ ID NO: 5550 - protein, 112 aa, Zea mays
MVKGRTGQRVRLYVRGTILGYKRSKSNQYETTSLVQIEGVNTKEDVAWYAGKRMAYIYKAKTKSNETRYRCIWGKVTRPHGNSGVVRAKFKSNLPPESMGRKVRVFMYPSSI

SEQ ID NO: 5551 - protein, 112 aa, Unknown
  Sequence found in Organisms: Sorghum bicolor, Saccharum officinarum
MVKGRTGQRVRLYVRGTVLGYKRSKSNQYETTSLVQIEGVNTKEDVAWYCGKRMAYIYKAKTKSSGTHYRCIWGKVTRPHGNSGVVRAKFRSNLPPESMGRKVRVFMYPSSI

SEQ ID NO: 5552 - protein, 112 aa, Panicum virgatum
MVKGRTGQRVRLYVRGTILGYKRSKSNQYETTSLVQIEGVNTKEDVSWYCGKRMAYIYKAKTKSSGTHYRCIWGKVTRPHGNSGVVRAKFKSNLPPESMGRKVRVFMYPSSI

SEQ ID NO: 5553 - protein, 125 aa, Panicum virgatum
MVKGRTGQRVRLYVRGTILGYKRSKSNQYETTSLVQIEGVNTKEDVSWYCGKRMAYIYKAKTKSSGTHYRCIWGKVTRPHGNSGVVRAKFKSNLPRSLWGARSESSCTPAASKDNFKMWRIVLIC

SEQ ID NO: 5554 - protein, 112 aa, Hordeum vulgare
MVKGRTGQRVRLYVRGTILGFKRSKSNQYENTSLVQIEGVNTKEDVAWYGGKRLAYVYKAKTKSNGTHYRCLWGKITRPHGNSGVVRAQFKSNLPAESMGRKVRVFMYPSSI

SEQ ID NO: 5555 - protein, 112 aa, Unknown
  Sequence found in Organisms: Zea mays, Sorghum bicolor, Setaria italica, Saccharum officinarum, Panicum virgatum
MVKGRTGQRVRLYVRGTILGYKRSKSNQYETTSLVQIEGVNTKEDVAWYAGKRMAYIYKAKTKSSETRYRCIWGKVTRPHGNSGVVRAKFKSNLPPESMGRKVRVFMYPSSI

SEQ ID NO: 5556 - protein, 112 aa, Avena sativa
MVKGRTGQRVRLYVRGTILGFKRSKSNQYENTSLVQIEGVNTKEDVAWYAGKRLAYVYKAKTKSNGTHYRCLWGKVIRPHGNSGVVRAQFKSNLPAESMGRKVRVFMYPSSI

SEQ ID NO: 5557 - protein, 112 aa, Triticum aestivum
MVKGRTGQRVRLYVRGTILGYKRSKSNQYETTSLVQIEGVNTKEDVAWYAGKRMAYIYKAKTKSNETRYRCIWGKVTRPHGNSGVVRAKFKSNLPPESMGRKVRVFMYPSNI

SEQ ID NO: 5558 - protein, 112 aa, Panicum virgatum
MVKGRTGQRVRLYVRGTILGYKRSKSNQYETTSLVQIEGVNTKEDVAWYAGKRMAYIYKAKIKSSETRYRCIWGKVTRPHGNSGVVRAKFKSNLPPESMGRKVRVFMYPSSI

SEQ ID NO: 5559 - protein, 112 aa, Brachypodium distachyon
MVKGRTGQRVRLYVRGTILGFKRSKSNQYESTSLVQIEGLNTKEDVSWYAGKRMAYVYKAKTKSSGTHYRCIWGKVTRPHGNSGVVRAQFKSNLPAESMGRKVRVFMYPSSI

SEQ ID NO: 5560 - protein, 112 aa, Zea mays
MVKGRTGQRVRLYVRGTILGYKRSKSNQYETTSLIQIEGVNTKEDVAWYAGKRMAYIYKAKTKSSETRYRCIWGKVTRPHGNSGVVRAKFKSNLPPESMGRKVRVFMYPSSI

SEQ ID NO: 5561 - protein, 112 aa, Avena sativa
MVKGRTGQRVRLYVRGTILGFKRSKSNQYENTSLVQIEGVNTKEDVAWYAGKRLAYVYKAKTKSNGTHYRCLWGKVIRPHGNSGVVRTQFKSNLPAESMGRKVRVFMYPSSI

SEQ ID NO: 5562 - protein, 112 aa, Pseudoroegneria spicata
MVKGRTGQRVRLYVRGTILGFKRSKSNQYENTSLVQIEGVNTKEDVAWYAGKRLAYVYKAKTKSNGTHYRCLWGKITRPHGNSGVVRAQFKSNLPAESMGRKVRVFMYPSSI

SEQ ID NO: 5563 - protein, 112 aa, Oryza sativa
MVKGRTGQRVRLYVRGTILGYKRSKSNQYENTSLVQIEGVNTKEEVAWYCGKRMAYVYKAKTKSGGTNYRCIWGKVTRPHGNSGVVRAKFKSNLPPASMGRKVRVFMYPSSI

SEQ ID NO: 5564 - protein, 112 aa, Triticum aestivum
MVKGRTGQRVRLYVRGTILGYKRSKSNQYETTSLMQIEGVNTKEDVAWYAGKRMAYIYKAKTKSSETRYRCIWGKVTRPHGNSGVVRAKFKSNLPPESMGRKVRVFMYPSSI

SEQ ID NO: 5565 - protein, 112 aa, Panicum virgatum
MVKGRTGQRVRLYVRGTILGYKRSKSNQYENTSLVQIEGVNTKEDVAWYAGKRLAYIYKAKTKSSETRYRCIWGKVTRPHGNSGVVRAKFKSNLPPESMGRKVRVFMYPSSI

SEQ ID NO: 5566 - protein, 112 aa, Brachypodium distachyon
MVKGRTGQRVRLYVRGTILGFKRSKSNQYESTSLVQIEGLNTKEDVSWYAGKRMAYVYKAKTKSSGTHYRCIWGKITRPHGNSGVVRAQFKSNLPAESMGRKVRVFMYPSSI

SEQ ID NO: 5567 - protein, 112 aa, Secale cereale
MVKGRTGQRVRLYVRGTILGFKRSKSNQYENTSLVQIEGVNTKEDVAWYAGKRLAYVYKAKTKSNGTHYRCLWGKITRSHGNSGVVRAQFKSNLPAESMGRKVRVFMYPSSI

SEQ ID NO: 5568 - protein, 112 aa, Triticum aestivum
MVKGRTGQRVRLYVRGTILGFKRSKSNQYESTSLVQVEGVNTKEDVAWYAGKRLAYVYKAKTKSNGTHYRCLWGKITRPHGNSGVVRAQFKSNLPAESMGRKVRVFMYPSSI

SEQ ID NO: 5569 - protein, 112 aa, Unknown
  Sequence found in Organisms: Pennisetum glaucum, Panicum virgatum
MVKGRQGQRVRMYVRGTILGYKRSKSNQYENTSLLQIEGVSTKEDVAWYGGKRIAYVYKAKTKSDGTSIRCIWGKVTRPHGNSGVVRAKFRSNLPPSSMGKKVRVFMYPSSI

SEQ ID NO: 5570 - protein, 112 aa, Panicum virgatum
MVKGRQGQRVRMYVRGTILGYKRSKSNQYENTSLLQIEGVSTKEDVAWYGGKRIAYVYKAKTKSDGTSIRCIWGKVTRPHGNSGVVRAKFRSNLPPNSMGKKVRVFMYPSSI

SEQ ID NO: 5571 - protein, 1400 aa, Eutrema parvulum
MDLVFNRNLECFFSLYRGSNRQTTLLQRSSTSQLWGSVRFGTSQRLSLNRAKAASLRCSTGSVVSVVEQPSLVEKPASEVIHFYRVPLIQESANAELLKAVQTKIGNQIVSFTTEQCFNIGLESELADEKLSVLKWILQETFEPENLGADSFLERKKQEGLHATIVEVGPRLSFTTAWSTNAVSICRACGLNEVTRLERSRRYLLFSNEPLLENQIKEFAAMVHDRMTECVYPQKLISFETNVVPEEVMYVPVMEKGRKALEEINQKMGLAFDEQDLQYYTRLFKDDIKRNPTNVELFDIAQSNSEHSRHWFFAGNIVIDGKPMDRSLMQIVKSTWEANRNNSVIGFKDNSSAIRGFMVNQLRPLLPGSTCLLDVSARDLDILFTAETHNFPCAVAPYPGAETGAGGRIRDTHATGKGSFVVASTSGYCVGNLNMEGSYAPWEDSSFQYPSNLASPLQILIDASNGASDYGNKFGEPMIQGYTRTFGMRLPSGDRREWLKPIMFSAGIGQIDHTHITKGEPEVGMLVVKIGGPAYRIGMGGGAASSMVSGQNDAELDFNAVQRGDAEMSQKLYRVVRACIEMGEKNPIISIHDQGAGGNCNVVKEIIYPKGAEIDIRAVVVGDHTMSVLEIWGAEYQEQDAILVKAESREILQSICKRERLSMAVLGTINGEGRCTLIDSTAAAKCKKEGLPPPPPAVDLELEKVLGDMPKKTFEFNRVAYAREPLDVAPGITLMDSLKRVLRLPSVSSKRFLTTKVDRCVTGLVAQQQTVGPLQITLADVAVIAQTFTDLTGGACAIGEQPIKGLLDPKAMARLAVGEALTNLVWAKVTALSNVKASGNWMYAAKLEGEGSAMYDAAIALSEAMIELGIAIDGGKDSLSMAAHADGEVVKAPGNLVISAYVTCPDITKTVTPDLKLGDGDGVLLHVDLAKGKRRLGGSALAQVFGQIGNDCPDIDDVPYLKNVFEGVQALISENLVSAGHDISDGGLIVAALEMAFAGNKGINLNLVSNGISLFETLFSEELGLVMEISNKNLDAVLEKLRGYDVTAEIIGKVTDSPLIEVKVDGITHLSEKTSFLRDMWEDTSFQLEKLQRLASCVEMEKEGLKLRHEPNWKLSFTPSWTNDNYMSKDVKPKVAVIREEGSNGDREMSAAFYAAGFEPWDVTVSDLLAGAITLDQFRGIVFVGGFSYADVLDSAKGWAASIRFNEPLLSQFQEFYKRPDTFSLGICNGCQLMALLGWVPGPQVGGSLDTSQPRFVHNESGRFECRFTSVTIKDSPSIMLKGMEGSTLGVWAAHGEGRAYFPDEGVLDHMLHSDLAPLRYCDDDGSVTEAYPFNLNGSPLGIAAICSPDGRHLAMMPHPERCFLMWQFPWYPTSWDVEKAGPSPWLKMFQNARDWCSQL

SEQ ID NO: 5572 - protein, 112 aa, Setaria italica
MVKGRQGQRVRMYVRGTILGYKRSKSNQYENTSLLQIEGVSTKQDVAWYGGKRIAYVYKAKTKSDGTSIRCIWGKVTRPHGNSGVVRAKFRSNLPPSSMGKKVRVFMYPSSI

SEQ ID NO: 5573 - protein, 112 aa, Saccharum officinarum
MVKGRQGQRVRTYVRGTILGYKRSKSNQYEHTSLLQIEGVSTKEDVAWYGGKRIAYVYKAKTKSDGTAVRCIWGKVTRPHGNSGVVRAKFRSNLPPSSMGKKVRVFMYPSSV

SEQ ID NO: 5574 - protein, 103 aa, Elaeis guineensis
MVKGRQGERVRLYVRGTILGYKRSKSNQYENTSLIQIEGVNTKEEVAWYCGKRMAYIYKAKTKSDGDPLPVHLGQGHPPSRQQRRRPRQVQVQPPTQIHGRES

SEQ ID NO: 5575 - protein, 112 aa, Cenchrus ciliaris
  misc_feature (42)..(42): Xaa can be any naturally occurring amino acid
MVRGRQGQRVRMYVRGTILGYKRSKSNQYENTSLLQIEGVSXKEDVAWYGGKRIAYVYKAKTKSDGTSIRCIWGKVTRPHGNSGVVRAKFRSNLPPSSMGKKVRVFMYPSSI

SEQ ID NO: 5576 - protein, 112 aa, Elaeis guineensis
MVKGRQGERVRLYVRGTILGYKRSKSNQYENTSLIQIEGVNTKEEVAWYCGKRMAYIYKAKTKSDGTRYRCIWGKVTRPHGNSGVVRAKFKSNLPPKSMGGKVRVFMYPSNI

SEQ ID NO: 5577 - protein, 112 aa, Phalaenopsis aphrodite
MVKGRQGERVRLYVRGTILGYKRSKSNQYENTSLVQIEGVNTKEEVGWYAGKRMAYIYKAKTKKNGTHYRCIWGKVTRPHGNSGVVRAKFKTNLPPQSMGRKVRVFMYPSNI

SEQ ID NO: 5578 - protein, 112 aa, Ananas comosus
MVKGRQGERVRLYVRGTILGYKRSKSNQYENTSLLQIEGVTTKEDVAWYCGKRMAYIYKAKTKSKGTHYRCIWGKVTRPHGNSDVVRAKFKSNLPPKSMGAKVRVFMYPSNI

SEQ ID NO: 5579 - protein, 112 aa, Sorghum bicolor
MVKGRQGQRVRTYVRGTILGYKRSKSNQYEHTSLLQIEGVSTKEDVAWYGGKRIAYVYKAKTKSDGTAVRCIWGKVTRPHGNSGVVRAKFRSHLPPSSMGKKVRVFMYPSSV

SEQ ID NO: 5580 - protein, 112 aa, Tripterygium wilfordii
MVKGRQGERVRLYVRGTILGYKRSKSNQYPNTSLVQIEGVNTKEEVAWYAGKRMAYIYKAKVKKNGTHYRCIWGKVSRPHGNSGVVRAKFKSNLPPKSMGTRVRVFMYPSNI

SEQ ID NO: 5581 - protein, 67 aa, Allium cepa
LLPSVCRRRVSEEVVYTQRGGAPIKAATSNLRFNNGEGATRPARQTYVRGTVLGYKRSKSNQYETLH

SEQ ID NO: 5582 - protein, 112 aa, Ambrosia trifida
MVKGRQGERVRLYTRGTILGYKRSKSNQYPNTSLVQIEGVNTKEEVAWYQGKRMAYVYKAKVKKNGSHYRCIWGKVTRPHGNTGVVRAKFKSNLPPKSMGSRVRVFMYPSNI

SEQ ID NO: 5583 - protein, 112 aa, Amorphophallus konjac
MVKGRQGERVRLYVRGTILGYKRSKSNQYENTSLIQIEGVNTKEEVAWYCGKRMAYVYKAKVKKNGSQYRCIWGKVTRPHGNSGVVRAKFKSNLPPRSMGAKVRVFMYPSNI

SEQ ID NO: 5584 - protein, 112 aa, Unknown
  Sequence found in Organisms: Arabidopsis thaliana, Arabidopsis lyrata
MVKGRQGERVRLYVRGTILGYKRSKSNQYPNTSLVQIEGVNTQEEVNWYKGKRMAYIYKAKTKKNGSHYRCIWGKVTRPHGNSGVVRAKFTSNLPPKSMGSRVRVFMYPSNI

SEQ ID NO: 5585 - protein, 112 aa, Arnica chamissonis
MVKGRQGERVRLYTRGTILGYKRSKSNQYPNTSLVQIEGVNTKEEVSWYQGKRMAYVYKAKVKKNGSHYRCIWGKVTRPHGNTGVVRAKFTSNLPPKSMGSRVRVFMYPSNI

SEQ ID NO: 5586 - protein, 112 aa, Musa acuminata
MVKGRQGERVRLYVRGTILGYKRSKSNQYENTSLVQIEGVNTKEEVAWYCGKRMAYIYKAKTKTKGTRYRCIWGKVCRPHGNSGVIRAKFKSNLPPKSMGGKVRVFMYPSNI

SEQ ID NO: 5587 - protein, 112 aa, Musa acuminata
MVKGRQGERVRLYVRGTILGYKRSKSNQYENTSLVQIEGVNTKEEVAWYCGKRMAYIYKAKTKTKGTRYRCIWGKVTRPHGNSGVIRAKFKSNLPPKSMGGKVRVFMYPSNI

SEQ ID NO: 5588 - protein, 112 aa, Musa acuminata
MVKGRQGERVRLYVRGTILGYKRSKSNQYENTSLVQIEGVNTKEEVAWYCGKRMAYIYKAKTKNKGTQYRCIWGKVARPHGNSGVVRAKFKSNLPPKSMGGRVRVFMYPSNI

SEQ ID NO: 5589 - protein, 112 aa, Brachypodium distachyon
MVKGRQGQRVRLYVRGTILGYKRSKSNQYESTSLLQIEGLSTKEDVSWYAGKRIAYVYKAKTRSSGTTVRCIWGKVTRPHGNSGVVRAQFRSNLPATSMGKKVRVFMYPSSI

SEQ ID NO: 5590 - protein, 112 aa, Epimedium sagittatum
MVKGRQGERVRLYVRGTVLGYKRSKSNQYPNTSLVQIEGVNTKEEVAWYAGKRMAYIYKAKVKKNGSHYRCIWGKVTRPHGNTGVVRAKFTSNLPPKSMGARVRVFMYPSNI

SEQ ID NO: 5591 - protein, 112 aa, Fagopyrum esculentum
MVKGRQGERVRLYVRGSILGYKRSKSNQYPSTSLVQIEGVNTKEEVSWYQGKRMAYIYKAKTKKKGSHYRCIWGKVTRPHGNTGVVRAKFTSNLPPKSMGDKVRVFMYPSNI

SEQ ID NO: 5592 - protein, 112 aa, Flaveria ramosissima
MVKGRQGERVRLYTRGTILGYKRSKSNQYPNTSLVQIEGVNTKEEVAWYEGKRMAYVYKAKVKKNGSHYRCIWGKVTRPHGNTGVVRAKFKSNLPPKSMGSRVRVFMYPSNI

SEQ ID NO: 5593 - protein, 112 aa, Elaeis guineensis
MVKGRQGERVRLYVRGTILGYKRSKSNQYENTSLIQIEGVNTKEEVAWYCGKRMAYIYKAKTKSDGSRYRCIWGKVTRPHGNSGVVRAKFKSNLPPKSMGGKVRVFMYPSNI

SEQ ID NO: 5594 - protein, 112 aa, Allium cepa
MAKERQGQRVRLYVRGTVLGYKRSKSNQYENTSLMQIEGVNTKEDVAWYCGKRLAYIYKAKVKKNGTHFRCIWGKVTRPHGNSGVVRAKFRSNLPPKAMGAKVRVFMYPSSI

SEQ ID NO: 5595 - protein, 112 aa, Primula obconica
MVKGRQGERVRLYVRGTILGYKRSKSNQYPNTSLVQIEGVNTKEDVTWYQGKRMAYIYKAKVKQNGSHYRCIWGKVSRPHGNSGVVRAKFTSNLPPKSMGARVRVMMYPSNI

SEQ ID NO: 5596 - protein, 112 aa, Eutrema halophilum
MVKGRQGERVRLYVRGTILGYKRSKSNQYPNTSLVQVEGVNTTEEVAWYKGKRMAYIYKAKTKKNGSHYRCIWGKVTRPHGNSGVVRAKFTSNLPPKSMGARVRVFMYPSNI

SEQ ID NO: 5597 - protein, 112 aa, Eutrema parvulum
MVKGRQGERVRLYVRGTILGYKRSKSNQYPNTSLVQVEGVNTTEEVAWYKGKRMAYIYKAKTKKNGSHYRCIWGKVTRPHGNSGVVRAKFTSNLPPKSMGSRVRVFMYPSNI

SEQ ID NO: 5598 - protein, 1447 aa, Brassica rapa
MKNSINFELAVVLSTSSLFCILILKAFSFLCFKCFGDYLNDFKIMKLVFDPKLKSLPSFFHLIGSNRQTTLLQRSSTNQLWGSVRFQTSKPRSLNLNRTKAAGLRCSTPRASLSVVEQPSLVEKPASEVIHYYRVPLIQESANAELLKAVQTKISNQVVGLSTEQCFNIGLETELAEEKVSVLKWILQETFEPENLGTDSFLERKKREGLHATIIEVGPRLSFTTAWSTNAVSICRACGLNEVTRLERSRRYLLFSNEPLSENQTNEFAAMVHDRMTECVYLQKLTSFETNVVPEEVKYVPVMEKGREALEEINQKMGLAFDEQDLQYYTRLFRDDIKRNPTNVELFDIAQSNSEHSRHWFFAGNIVIDGKPMDRSLMQIVKSTWEANRNNSVIGFKDNSSAIRGFMVNQLRPLLPGSTCLLDLSARDLDILFTAETHNFPCAVAPYPGAETGAGGRIRDTHATGRGSFVVASTSGYCVGNLNMEGSYAPWEDSSFQYPSNLASPLQILVDASNGASDYGNKFGEPMIQGYTRTFGMRLPSGERREWLKPIMFSAGIGQIDHSHITKGEPEVGMLVVKIGGPAYRIGMGGGAASSMVSGTNDADLDFNAVQRGDAEMSQKLYRVVRACIEMGEKNPIVSIHDQGAGGNCNVVKEIIYPKGAEIDIRAVVVGDHTMSVLEIWGAEYQEQDAILVRAESREVLESICKRERLSMAVLGTINGEGRCTLIDSTAKAKCEKEGLPPPPPAVDLELEKVLGDMPKKTFEFKRVDYAREPLDIAPGITLMDSLKRVLRLPSVSSKRFLTTKVDRCVTGLVAQQQTVGPLQITLADVAVIAQTFTDLTGGACAIGEQPIKGLLYPKAMARLAVGEALTNLVWAKVTALSDVKASGNWMYAAKLEGEGSAMYDAAIALADAMIELGIAIDGGKDSLSMAAHADGEVVKAPGNLVISAYVTCPDITKTVTPDLKLDGGVLLHVDLAKGKRRLGGSALAQVFGQIGNDCPDVDDVPYLKNVFEGVQALISEDLVSAGHDISDGGLIVAALEMAFAGNKGVSLNLDSNGISLFETLFAEELGLVMEISNKNLDAVLEKLRGFNVAAEIIGKVTESPLIEVKVDGITHLSEETSFLRDMWEDTSFQLEKLQRLASCVEMEKEGLKLRHEPNWKLSFTPSWTNDSYMSKDVKPRVAVIREEGSNGDREMSAAFYAAGFEPWDVTVSDLLAGAITLDEFRGIVFVGGFSYADVLDSAKGWAASIRFNEPLLSQFQEFYKRPDTFSLGICNGCQLMALLGWVPGPQVGGSLDTAQPRFVHNESGRFECRFTSVTIKDSPSIMLKGMEGSTLGVWAAHGEGRAYFPDEGVLDRMLHSDLAPLRYCDDDGSVTEAYPFNLNGSPLGIAAICSPDGRHLAMMPHPERCFLMWQYPWYPKGWEVEKAGPSPWLKMFQNARDWCSQL

SEQ ID NO: 5599 - protein, 101 aa, Heritiera littoralis
MVKGRQGERVRLYVRGTILGYKRSKSNQYPNTSLIQIEGVNTKEEVAWYAGKRMAYIYKAKVKKNGSHYRCIWGKVTRPHGNSGVVRAKFKSNPSPQIYGR

SEQ ID NO: 5600 - protein, 81 aa, Primula obconica
MVKGRQGERVRLYVRGTILGYKRSKSNQYPNTSLVQIEGVNTKEDVTWYQGKRMAYIYKAKVKQNGSHYRCIVGESLEASW

SEQ ID NO: 5601 - protein, 90 aa, Primula obconica
MSGEPILGYKRSKSNQYPNTSLVQIEGVNTKEDVTWYQGKRMAYIYKAKVKQNGSSLPLHMGKGTRGLMVTVVWSVPNSRPTYLLNPWVG

SEQ ID NO: 5602 - protein, 89 aa, Secale cereale
SRDGILTQSGPSNPRPRTFKTPCSRVHSSAPPTSPPPSHHHLPRPPAAATMVQGRQGQRVRLYVRGTILGYKRSKSNQYEGTSLLQVRG

SEQ ID NO: 5603 - protein, 1399 aa, Eutrema halophilum
MFSSVIGSNRQTTLLQRSSTSQLWGSVRYQTSQRLSLNRTKAAGLICSAQPNKPGAAVSTGPVVSVEEQPSLVEKPAAEVIHFYRVPLIQESANAELLKSVQTKISNQIVSLATEQCFNIGLESELEDEKLLVLKWILQETFEPENLGTDSFIERKKQEGLHATIVEVGPRLSFTTAWSTNAVSICRACGLNEVTRLERSRRYLLFSKEPLLENQIKEFAAVVHDRMTECVYSQRLISFETNVVPEEVKYVPVMEKGRKALEEINQEMGLAFDEQDLQYYTRLFKDDIQRNPTNVELFDIAQSNSEHSRHWFFAGKIVIDGKPMDRSLMQIVKSTWEANQNNSVIGFKDNSSAIRGFMVNQLRPLLPGSTCLLDISARDLDILFTAETHNFPCAVAPYPGAETGAGGRIRDTHATGRGSFVVASTSGYCVGNLNMEGSYAPWEDSSFQYPSNLASPLQILIDASNGASDYGNKFGEPMIQGYTRTFGMRLPSGDRREWLKPIMFSAGIGQIDHTHITKGEPEVGMLVVKIGGPAYRIGMGGGAASSMVSGQNDAELDFNAVQRGDAEMAQKLYRVVRACIEMGEKNPIISIHDQGAGGNCNVVKEIIYPQGAEIDIRAVVVGDHTMSVLEIWGAEYQEQDAILVKAESREILQSICKRERLSMAVIGTINGEGRCTLIDSTAAAKCSKEGLPPPPPAVDFELEKVLGDMPKKTFEFNRVAYVREPLDIAPGITLMDSLKRVLRLPSVSSKRFLTTKVDRCVTGLVAQQQTVGPLQITLADVAVIAQTFTDLTGGACAIGEQPIKGLLDPKAMARLAVGEALTNLVWAKVTALSDVKASGNWMYAAKLEGEGSAMYDAAIALSEAMIELGIAIDGGKDSLSMAANADGEVVKAPGNLVISAYVTCPDITKTVTPDLKLGDDGVLLHVDLAKGKRRLGGSALAQVFGQIGNDCPDVDDVPYLKNVFEGIQALISENLVSAGHDISDGGLVVAAMEMAFAGNKGINLNLASNGISLFETLFSEELGLVMEISNKNLDAVMEKLRGFDVTAEIIGKVTDAPLIEVKVDGITHLSEKTSFLRDMWEDTSFQLEKLQRLASCVEMEKEGLKLRHEPNWKLSFTPSWTNNSYMSKVVKPKVAVIREEGSNGDREMSAAFYAAGFEPWDVTVSDLLAGAITLDQFRGIVFVGGFSYADVLDSAKGWAASIRFNEPLLTQFQEFYKRPDTFSLGICNGCQLMALLGWVPGPQVGGSLDTSQPRFVHNESGRFECRFTSVTIKDSPSIMLKGMEGSTLGVWAAHGEGRAYFPDEGVLDHMLHSDLAPLRYCDDDGSVTEAYPFNLNGSPLGIAAICSPDGRHLAMMPHPERCFLMWQFPWYPTSWDVEKAGPSPWLKMFQNARDWCSQL

SEQ ID NO: 5604 - protein, 112 aa, Zostera marina
MVKGRQGERVRLYVRGTILGYKRSKSNQYENTSLVQIEGVNTKEEVSWYAGKRMAYIYKAKTKKDGSLYRCIWGKVTRSHGNTGIVRAKFKRNLPAKAMGDKVRVFMYPSNI

SEQ ID NO: 5605 - protein, 111 aa, Amborella trichopoda
MVKAQGERVRLYVRGTILGYKRSKSNQYENTSLVQIEGVNTKEEVAWYLGKRMAYIYKAKVKKNGSHYRCIWGKVNRPHGNSGVVRAKFKSNLPPRSMGAKVRVFMYPSRI

SEQ ID NO: 5606 - protein, 112 aa, Ambrosia trifida
MVKGGQGERVRLYTRGTILGYKRSKSNQYPNTSLVQIEGVNTKEEVAWYQGKRMAYVYKAKVKKNGSHYRCIWGKVTRPHGNTGVVRAKFKSNLPPKSMGSRVRVFMYPSNI

SEQ ID NO: 5607 - protein, 112 aa, Amorphophallus konjac
MVKGRQGERVRLYVRGTILGYKRSKSNQYENTSLIQIEGVNTKEEVAWYCGKRLAYVYKAKVKKNDSHYRCIWGKVARPHGNSGVVRAKFKSNLPPRSMGAKVRVFMYPSNI

SEQ ID NO: 5608 - protein, 112 aa, Amsonia hubrichtii
MVKGRQGERVRLYVRGTVLGYKRSKSNQYPNTSLIQIEGVNTKEDVAWYLGKRMAYIYKAKVKQNGSHYRCIWGKVCRPHGNSGVVRAKFKSNLPPKSMGAKVRVFMYPSNI

SEQ ID NO: 5609 - protein, 112 aa, Antirrhinum majus
MVKGRQGERVRLYVRGTILGYKRSKSNQYPNTSLIQIEGVNTQEEVAWYLGKRMAYIYKAKVKKNGSHYRCIWGKVARPHGNSGVVRAKFTSNLPPKSMGARVRVFMYPSNI

SEQ ID NO: 5610 - protein, 112 aa, Aquilegia formosa
MVKGRQGERVRLYVRGTVLGYKRSKSNQYPSTSLVQIEGVNTKEDVAWYAGKKMAYIYKAKVKKNGSHYRCIWGKVTRPHGNSGVVRAKFKSNLPPKSMGMKVRVFMYPSNI

SEQ ID NO: 5611 - protein, 112 aa, Unknown
  Sequence found in Organisms: Arabidopsis thaliana, Arabidopsis lyrata
MVKGRQGERVRLYVRGTILGYKRSKSNQYPNTSLVQVEGVNTTEEVSWYKGKRMAYIYKAKTKKNGSHYRCIWGKVTRPHGNSGVVRAKFTSNLPPKSMGSRVRVFMYPSNI

SEQ ID NO: 5612 - protein, 112 aa, Unknown
  Sequence found in Organisms: Brassica napus, Brassica juncea, Brassica oleracea, Brassica rapa, Raphanus sativus
MVKGRQGERVRLYVRGTILGYKRSKSNQYPNTSLIQIEGVNTTEEVTWYKGKRMAYIYKAKTKKNGSHYRCIWGKVTRPHGNSGVVRAKFTSNLPPKSMGMRVRVFMYPSNI

SEQ ID NO: 5613 - protein, 112 aa, Brassica juncea
MVKGRQGERVRLYVRGTILGYKRSKSNQYPNTSLIQIEGVNTTEEVNWYKGKRMAYIYKAKTKKNGSHYRCIWGKVTRPHGNSGVVRAKFTSNLPPKSMGMRVRVFMYPSNI

SEQ ID NO: 5614 - protein, 112 aa, Musa acuminata
MVKGRQGERVRLYVRGTILGYKRSKSNQYENTSLVQIEGVNTKEEVAWYCGKRMAYIYKAKTKTKGTRYRCIWGKVARPHGNSGVIRAKFKSNLPPKSMGGTVRVFMYPSNI

SEQ ID NO: 5615 - protein, 112 aa, Fagus grandifolia
MVKGRQGERVRLYVRGTILGYKRSKSNQYPSTSLIQIEGVNTKEEVTWYAGKRMAYIYKAKVKKNGTHYRCIWGKVSRPHGNSGVVRAKFKSNLPPKSMGARVRVFMYPSNI

SEQ ID NO: 5616 - protein, 112 aa, Fagus grandifolia
MVKGRQGERVRLYVRGTILGYKRSKSNQYPNTSLIQIEGVNTKEEVGWYAGKRMAYIYKAKVKKNGTHYRCIWGKVSRPHGNSGVVRAKFKSNLPPKSMGARVRVFMYPSNI

SEQ ID NO: 5617 - protein, 112 aa, Bruguiera gymnorhiza
MVKGRQGERVRLYVRGTVLGYKRSKSNQYPNTSLVQIEGVNTKEEVAWYAGKRMAYIYKAKVKKNGTHYRCIWGKVTRPHGNSGVVRAKFKSNLPPRSMGARVRVFMYPSNI

SEQ ID NO: 5618 - protein, 112 aa, Manihot esculenta
MVKSRQGENVRLYVRGTILGYKRSKSNQYPNTSLIQIEGVNTKEEVAWYCGKRMAYIYKAKVKKNGTHYRCIWGKVSRPHGNSGVVRAKFKSNLPPRSMGDRVRVFMYPSSI

SEQ ID NO: 5619 - protein, 112 aa, Unknown
  Sequence found in Organisms: Chelidonium majus, Papaver somniferum
MVKGREGERVRLYVRGTILGYKRSKSNQYPNTSLIQIEGVNTKEEVAWYAGKRMAYIYKAKVKKNGSHYRCIWGKVTRPHGNSGVVRAKFTSNLPPKSMGNRVRVFMYPSNI

SEQ ID NO: 5620 - protein, 112 aa, Cleome spinosa
MVKGRQGERVRLYVRGTVLGYKRSKSNQYPNTSLVQIEGVNTQEEVAWYLGKRMAYIYKAKTKQNGSHYRCIWGKVTRPHGNSGVVRAKFKSNLPPKSMGARVRVFMYPSNI

SEQ ID NO: 5621 - protein, 112 aa, Fagopyrum esculentum
MVKGREGERVRLYVRGSILGYKRSKSNQYPSTSLIQIEGVNTKEEVSWYQGKRMAYIYKAKTKKKGSHYRCIWGKVTRPHGNTGVVRAKFTSNLPPRSMGDKVRVFMYPSNI

SEQ ID NO: 5622 - protein, 112 aa, Fagopyrum esculentum
MVKGRQGERVRLYVRGSILGYKRSKSNQYPSTSLIQIEGVNTKEEVSWYQGKRMAYIYKAKTKKKGSHYRCIWGKVTRPHGNTGVVRAKFTSNLPPKSMGDKVRVFMYPSNI

SEQ ID NO: 5623 - protein, 112 aa, Flaveria ramosissima
MVKGRQGERVRLYTRGTILGYKRSKSNQYPNTSLIQIEGVNTKEEVAWYEGKRMAYVYKAKVKKNGSHYRCIWGKVTRPHGNTGVVRAKFKSNLPPKSMGSRVRVFMYPSNI

SEQ ID NO: 5624 - protein, 112 aa, Ipomoea nil
MVKGRQGERVRLYVRGTVLGYKRSKSNQYPNTSLIQIEGVNTQEEVAWYLGKRMAYVYKAKTKKGGSHYRCIWGKVCRPHGNSGVVRAKFKSNLPPKSMGNKVRVFMYPSNI

SEQ ID NO: 5625 - protein, 112 aa, Lactuca sativa
MVKGRQGERVRLYTRGTILGYKRSKSNQYPNTSLVQIEGVNTKEEVGWYQGKRMAYVYKAKVKKNGSHYRCIWGKVTRPHGNTGIVRAKFTSNLPPKSMGSRVRVFMYPSNI

SEQ ID NO: 5626 - protein, 112 aa, Allium cepa
MVKERQGQRVRLYVRGTVLGYKRSKSNQYENTSLMQIEGVNTKEDARWYAGKRVAYVYKAKVKKNGTHYRCIWGKVTRPHGNSGVVRSKFRSNLPPKAMGRKVRVFMYPSNI

SEQ ID NO: 5627 - protein, 112 aa, Primula obconica
MVKGRQGERVRLYVRGTILGYKRSKSNQYPNTSLVQIEGVNTKEEVTWYQGKRMAYIYKAKVKQNGSHYRCIWGKVSRPHGNSGVVRAKFTSNLPPKSMGARVRVMMYPSNI

SEQ ID NO: 5628 - protein, 111 aa, Oryza sativa
MKGRQGQRVRLYVRGTILGYKRSKSNQYENTSLLQIEGVNTKEEVGWYAGKRIAYVYKAKTKSNDSTIRCIWGKVTRPHGNSGVVRAKFRSNLPPTSMGKKVRVFMYPSSI

SEQ ID NO: 5629 - protein, 112 aa, Secale cereale
MVQGRQGQRVRLYVRGTILGYKRSKSNQYEGTSLLQVEGVNTKEDVSYYAGKRIAYVYKAKTKSSGTTVRCIWGKVTRPHGNSGVVRAQFRSNLPATSMGKKVRVFMYPSST

SEQ ID NO: 5630 - protein, 112 aa, Secale cereale
MVQGRQGQRVRLYVRGTILGYKRSKSNQYESTSLLQVEGVNTKEDVSYYAGKRIAYVYKAKTKSSGTTVRCIWGKVTRPHGNSGVVRAQFRSNLPATSMGKKVRVFMYPSST

SEQ ID NO: 5631 - protein, 112 aa, Tabernaemontana elegans
MVKGRQGERVRLYVRGTVLGYKRSKSNQYPNTSLIQIEGVNTKEDVSWYLGKRMAYIYKAKVKKNGTHYRCIWGKVCRPHGNSGVVRAKFKSNLPPKSMGAKVRVFMYPSNI

SEQ ID NO: 5632 - protein, 112 aa, Unknown
  Sequence found in Organisms: Fraxinus spp, Olea europaea
MVKGRQGERVRLYVRGTILGYKRSKSNQYPNTSLIQIEGVNSKEEVAWYQGKRMAYIYKAKVKQNGTHYRCIWGKVIRPHGNSGVVRAKFKSNLPPKSMGARVRVFMYPSNI

SEQ ID NO: 5633 - protein, 112 aa, Olea europaea
MVKGRQGERVRLYVRGTILGYKRSKSNQYPNTSLIQIEGVNTNEEVSWYQGKRMAYIYKAKVKTNGSHYRCIWGKVIRPHGNSGVVRAKFKSNLPPKSMGARVRVFMYPSSI

SEQ ID NO: 5634 - protein, 112 aa, Acacia harpophylla
MVKGRQGERVRLYVRGSILGYKRSKSNQYPNTSLIQIEGVNTKEEVAWYCGKRMAYIYKAKVKKNGTHYRCIWGKVIRPHGNSGVVRAKFKSDLPPRSMGAKVRVFMYPSNI

SEQ ID NO: 5635 - protein, 112 aa, Ambrosia trifida
MVKGRQGERVRLYTRGTVLGYKRSKSNQYPNTSLVQIEGVNTKEEVAWYQGKRMAYIYKAKVKKNGSHYRCIWGKVTRPHGNTGVVRAKFKSNLPPKSMGARVRVFMYPSNI

SEQ ID NO: 5636 - protein, 112 aa, Ambrosia trifida
MVKGRQGERVRLYTRGTILGYKRSKSNQYPNTSLVQIEGVNTKEEVAWYQGKRLAYVYKAKVKKNGSHYRCIWGKVTRPHGNTGVVRTKFKSNLPPKSMGSRVRVFMYPSNI

SEQ ID NO: 5637 - protein, 112 aa, Antirrhinum majus
MVKGRQGERVRLYVRGTILGYKRSKSNQYPNTSLIQIEGVNTQEEVAWYLGKRMAYIYKAKVKKNGSHYRCIWGKVARPHGNSGVVRAKFTSNLPPKSMGARVRVMMYPSNI

SEQ ID NO: 5638 - protein, 112 aa, Bruguiera gymnorhiza
MVKGRQGERVRLYVRGTILGYKRSKSNQYPNTSLIQIEGVNTKEEVAWYCGKRMAYIYRAKVKKNGTHYRCIWGKVTRPHGNSGVVRAKFKSNLPPRSMGARVRVFMYPSNI

SEQ ID NO: 5639 - protein, 112 aa, Bupleurum chinense
MVKGRQGERVRLYVRGTVLGYKRSKSNQYPNISLVQIEGVNTKEDVSWYQGKRVAYIYKAKVKVNGSHYRCIWGKVIRPHGNTGIVRAKFTSNLPPKAMGARVRVMMYPSNI

SEQ ID NO: 5640 - protein, 112 aa, Cannabis sativa
MVKGRQGERVRLYVRGTVLGYKRSKSNQYPNTSLVQIEGVNTKEDVSWYCGKRMAYIYKAKVKKDGSHYRCIWGKVIRPHGNSGVVRAKFTSNLPPKSMGARVRVFMYPSNI

SEQ ID NO: 5641 - protein, 112 aa, Brassica napus
MVKGRQGERVRLYVRGTILGYKRSKSNQYPNTSLIQIEGVNTTEEVTWYKGKGMAYIYKAKTKKNGSHYRCIWGKVTRPHGNSGVVRAKFTSNLPPKSMGMRVRVFMYPSNI

SEQ ID NO: 5642 - protein, 112 aa, Unknown
  Sequence found in Organisms: Gossypium hirsutum, Manihot esculenta, Gossypium raimondii, Hevea brasiliensis
MVKGRQGERVRLYVRGTILGYKRSKSNQYPNTSLIQIEGVNTKEEVAWYAGKRMAYIYKAKVKKNGSHYRCIWGKVTRPHGNSGVVRAKFKSNLPPKSMGDRVRVFMYPSNI

SEQ ID NO: 5643 - protein, 112 aa, Unknown
  Sequence found in Organisms: Citrus clementina, Citrus sinensis
MVKGRQGERVRLYVRGTILGYKRSKSNQYPNTSLIQIEGVNTKEDVSWYCGKRMAYIYKAKVKKNGSHYRCIWGKVARPHGNSGVVRAKFKSNLPPKSMGDRVRVFMYPSNI

SEQ ID NO: 5644 - protein, 112 aa, Cleome gynandra
MVKGRQGERVRLYVRGTILGYKRSKSNQYPNTSLIQIEGVNTQEEVSWYKGKRMAYIYKAKTKKNGSHYRCIWGKVTRPHGNSGVVRAKFKSNLPPKSMGARVRVFMYPSNI

SEQ ID NO: 5645 - protein, 112 aa, Cleome spinosa
MVKGRQGERVRLYVRGTVLGYKRSKSNQYPNTSLVQIEGVNTQEEVSWYQGKRMAYIYKAKTKKNGSHYRCIWGKVTRPHGNSGVVRAKFKSNLPPKSMGARVRVFMYPSNI

SEQ ID NO: 5646 - protein, 112 aa, Cleome spinosa
MVKGRQGERVRLYVRGTVLGYKRSKSNQYPNTSLVQIEGVNTQEEVSWYLGKRMAYIYKAKTKQNGSHYRCIWGKVTRPHGNSGVVRAKFKSNLPPKSMGARVRVFMYPSNI

SEQ ID NO: 5647 - protein, 112 aa, Epimedium sagittatum
MVKGRQGERVRLYVRGTVLGYKRSKSNQYPNTSLVQIEGVNTKEEVAWYAGKKMAYIYKAKVKKNGSHYRCIWGKVTRPHGNTGVVRAKFKSNLPPKSMGARVRVFMYPSNI

SEQ ID NO: 5648 - protein, 112 aa, Eucalyptus grandis
MVKGRQGERVRLYVRGTILGYKRSKSNQYPNTSLIQIEGVNTQEEVAWYCGKRMAYIYKAKVKKNGSHYRCIWGKVIRPHGNSGVVRAKFKSNLPPKSMGVRVRVFMYPSNI

SEQ ID NO: 5649 - protein, 112 aa, Euonymus alatus
MVKGRQGERVRLYVRGTVLGYKRSKSNQYPNTSLIQIEGVNTKEEVAWYCGKRMAYIYKAKVKKNGTHYRCIWGKVTRPHGNSGVVRAKFKSNLPPKSMGTRVRVFMYPSNI

SEQ ID NO: 5650 - protein, 112 aa, Euphorbia peplus
MVKSRQGENVRLYVRGTILGYKRSKSNQYPNTSLVQIEGVNTKEEVAWYAGKRMAYIYKAKVKKNGSHYRCIWGKVSRPHGNSGVVRAKFKSNLPPRSMGDRVRVFMYPSNI

SEQ ID NO: 5651 - protein, 112 aa, Unknown
  Sequence found in Organisms: Euphorbia peplus, Euphorbia esula, Citrullus lanatus
MVKGRQGERVRLYVRGTVLGYKRSKSNQYPRTSLIQIEGVNTREEVAWYAGKRLAYIYKAKVKQNGTHYRCIWGKVSRPHGNSGIVRAKFKSNLPPKSMGDKIRVFMYPSNI

SEQ ID NO: 5652 - protein, 112 aa, Fagopyrum esculentum
MVKGRQGERVRLYVRGSILGYKRSKSNQYPSTSLIQIEGVNTKDEVSWYQGKRMAYIYKAKTKKKGSHYRCIWGKVTRPHGNTGVVRAKFTSNLPPRSMGDKVRVFMYPSNI

SEQ ID NO: 5653 - protein, 112 aa, Flaveria ramosissima
MVKGRQGERVRLYTRGTILGYKRSKSNQYPNTSLIQIEGVNTKEEVAWYQGKRMAYIYKAKVKKNGSHYRCIWGKVTRPHGNTGVVRAKFKSNLPPKSMGARVRVFMYPSNI

SEQ ID NO: 5654 - protein, 112 aa, Flaveria ramosissima
MVKDRQGERVRLYTRGTILGYKRSKSNQYPNTSLIQIEGVNTKEEVAWYEGKRMAYVYKAKVKRNGSHYRCIWGKVTRPHGNTGVVRAKFKSNLPPKSMGARVRVFMYPSNI

SEQ ID NO: 5655 - protein, 112 aa, Fraxinus spp
MVKGRQGERVRLYVRGTILGYKRSKSNQYPNTSLIQIEGVNSKEEVAWYHGKRMAYIYKAKVKQNGTHYRCIWGKVIRPHGNSGVVRAKFKSNLPPKSMGARVRVFMYPSNI

SEQ ID NO: 5656 - protein, 112 aa, Heritiera littoralis
MVKGRQGERVRLYVRGTILGYKRSKSNQYPNTSLIQIEGVNTKEEVAWYAGKRMAYIYKAKVKKNGSHYHCIWGKVTRPHGNSGVVRAKFKSNLPPKSMGDKVRVFMYPSNI

SEQ ID NO: 5657 - protein, 112 aa, Carpinus betulus
MVKGRQGERVRLYVRGTILGYKRSKSNQYPNTSLIQIEGVNTKEDVSWYAGKRMAYIYKAKVKNNGTHYRCIWGKVIRPHGNSGIVRAKFKSNLPPKSMGARVRVFMYPSNI

SEQ ID NO: 5658 - protein, 112 aa, Humulus lupulus
MVKGRQGERVRLYVRGTVLGYKRSKSNQYPTTSLVQIEGVNTKEEVAWYCGKKMAYIYKAKVKKDGSHYRCIWGKVIRPHGNSGVVRAKFTSNLPPKSMGARVRVFMYPSNI

SEQ ID NO: 5659 - protein, 112 aa, Humulus lupulus
MVKGRQGERVRLYVRGTVLGYKRSKSNQYPNTSLVQIEGVNTKEEVSWYCGKRMAYIYKAKVKKDGSHYRCIWGKVIRPHGNTGVVRAKFTSNLPPKSMGARVRVFMYPSNI

SEQ ID NO: 5660 - protein, 112 aa, Ipomoea batatas
MVKGSQGERVRLYVRGTVLGYKRSKSNQYPNTSLIQIEGVNTQEEVAWYLGKRMAYVYKAKTKKGGSHYRCIWGKVCRPHGNSGVVRAKFKSNLPPKSMGNKVRVFMYPSNI

SEQ ID NO: 5661 - protein, 112 aa, Ipomoea nil
MVKGRQGERVRLYIRGTILGYKRSKSNQYPNTSLIQIEGVNTKEEVDWYQGKRMAYVYKAKTKKGGSHYRCIWGKVCRPHGNSGVVRAKFKSNLPPKSMGNKVRVFMYPSNI

SEQ ID NO: 5662 - protein, 112 aa, Actinidia deliciosa
MVKGRQGERVRLYVRGTILGYKRSKSNQYPNTSLIQIEGVNTKEEVAWYQGKRMAYIYKAKVKKDGSHYRCIWGKVSRPHGNSGVVRAKFKSNLPPKSMGSRVRVFMYPSNI

SEQ ID NO: 5663 - protein, 112 aa, Actinidia deliciosa
MVKGRQGERVRLYVRGTILGYKRSKSNQYPNTSLIQIEGVNTKEEVAWYQGKRMAYIYKAKVKRDGSHYRCIWGKVSRPHGNSGVVRAKFKSNLPPKSMGARVRVFMYPSNI

SEQ ID NO: 5664 - protein, 112 aa, Lactuca sativa
MVKGRQGERVRLYTRGTILGYKRSKSNQYPNTSLVQIEGVNTKDEVSWYQGKRMAYVYKAKVKKNGSHYRCIWGKVTRPHGNTGIVRAKFTSNLPPKSMGSRVRVFMYPSNI

SEQ ID NO: 5665 - protein, 112 aa, Glycyrrhiza uralensis
MVKGRQGERVRLYVRGTILGYKRSKSNQYPNTSLIQIEGVNTKEEVAWYAGKRMAYIYKAKVKKNGTHYRCIWGKVTRPHGNSGIVRAKFKSNLPPRSMGARVRVFMYPSNI

SEQ ID NO: 5666 - protein, 112 aa, Quercus alba
MVKGRQGERVRLYVRGTILGYKRSKSNQYPNTSLIQIEGVNTKEEVGWYAGKRMAYIYKAKVKKNGSHYRCIWGKVARPHGNSGVVRAKFTSNLPPKSMGARVRVFMYPSNI

SEQ ID NO: 5667 - protein, 112 aa, Olea europaea
MVKGRQGERVRLYVRGTILGYKRSKSNQYPNTSLIQIEGVNSKEEVAWYQGKRMAYIYKAKVKLNGTHYRCIWGKVIRPHGNSGVVRAKFKSNLPPKSMGARVRVFMYPSNI

SEQ ID NO: 5668 - protein, 112 aa, Olea europaea
MVKGRQGERVRLYVRGTILGYKRSKSNQYPNTSLIQIEGVNTKEEVSWYQGKRMAYIYKAKVKTNGSHYRCIWGKVIRPHGNSGVVRAKFKSNLPPKSMGARVRVFMYPSSI

SEQ ID NO: 5669 - protein, 112 aa, Allium cepa
MVMERKGQRVRLYVRGTILGYKRSKSNQYENTSLMQIEGVNTKEDVAYYLGKRLAYIYKAKVKKNGTHYRCIWGKVTRPHGNSGVVRTKFRSNLPPKAMGAKVRVFMYPSNY

SEQ ID NO: 5670 - protein, 111 aa, Allium cepa
GEERQGQRVRLYVRGTVLGYKRSKSNQYENTSLMQIEGVNTKEDVAWYCGKRLAYIYKAKVKKNGTHFRCIWGKVTRPHGNSGVVRAKFRSNLPPKAMGAKVRVFMYPSSI

SEQ ID NO: 5671 - protein, 112 aa, Orobanche aegyptiaca
MVKGRQGERVRLYVRGTVLGYKRSKSNQYPNTSLVQIEGVNTQEEVGWYLGKRMAYVYKAKVKKNGSHYRCIWGKVTRPHGNSGVVRAKFKSNLPPKSMGARVRVFMYPSNI

SEQ ID NO: 5672 - protein, 112 aa, Carica papaya
MVKGRQGERVRLYVRGTILGYKRSKSNQYPNTSLIQIEGVNSKEEVAWYAGKRMAYIYKAKVKKNGTHYRCIWGKVARPHGNSGVVRAKFKSNLPPKSMGDRVRVFMYPSNI

SEQ ID NO: 5673 - protein, 112 aa, Plantago ovata
MVKGRQGERVRLYVRGTILGYKRSKSNQYPNTSLVQIEGVNTQKEVDWYRGKRLAYIYKAKVKKNGSHYRCIWGKVSRPHGNSGVVRAKFTSNLPPKSMGARVRVFMYPSNI

SEQ ID NO: 5674 - protein, 112 aa, Plantago ovata
MVKGRQGERVRLYVRGTILGYKRSKSNQYPNTSLVQIEGVNTQKEVDWYRGKKMAYIYKAKVKKNGSHYRCIWGKVSRPHGNSGVVRAKFTSNLPPKSMGARVRVFMYPSNI

SEQ ID NO: 5675 - protein, 112 aa, Platanus occidentalis
MVKGRQGERVRLYVRGTILGYKRSKSNQYPNTSLIQIEGVNTKEEVAWYCGKRMAYIYKAKIKKNGSHYRCIWGKVTRPHGNSGVVRAKFKSNLPPKSMGSRVRVFMYPSNI

SEQ ID NO: 5676 - protein, 112 aa, Platanus occidentalis
MVKGRQGERVRLYVRGTILGYKRSKSNQYPNTSLIQIEGVNTKEEVAWYCGKRMAYIYKAKVKKNGSHYRCIWGKVARPHGNSGVVRAKFKSNLPPKSMGSRVRVFMYPSNI

SEQ ID NO: 5677 - protein, 112 aa, Populus trichocarpa
MVKGRQGERVRLYVRGTILGYKRSKSNQYPNTSLIQIEGVNTKEEVAWYAGKRMAYIYKAKVKRDGTHYRCIWGKVTRPHGNSGVVRAKFKSNLPPKSMGCRVRVFMYPSNI

SEQ ID NO: 5678 - protein, 112 aa, Populus trichocarpa
MVKGRQGERVRLYVRGTILGYKRSKSNQYPNTSLVQVEGVNTKEEVAWYAGKRMAYIYKAKVKKNGSHYRCIWGKVTRPHGNSGVVRAKFKSNLPPKSMGARVRVFMYPSNI

SEQ ID NO: 5679 - protein, 112 aa, Papaver somniferum
MVKGREGERVRLYVRGTILGYKRSKSNQYPNTSLVQIEGVNTKEEVQWYAGKRVAYIYKAKVKTNGSHYRCIWGKVIRPHGNSGVVRAKFTSNLPPKSMGMRVRVFMYPSNI

SEQ ID NO: 5680 - protein, 112 aa, Unknown
  Sequence found in Organisms: Solanum tuberosum, Solanum phureja
MVKGRQGERVRLYTRGTVLGYKRSKSNQYPNTSLVQIEGVNTKEEVDWYLGKRMAYVYKAKTKKNNSHYRCIWGKVCRPHGNSGVVRAKFKSNLPPKSMGAKVRVFMYPSNI

SEQ ID NO: 5681 - protein, 112 aa, Rosa hybrid cultivar
MVKGRQGERVRLYVRGTVLGYKRSKSNQYPNTSLIQIENVNTKEEVAWYAGKRLAYIYKAKVKKNGSHYRCIWGKVSRPHGNTGVVRAKFTSNLPPKSMGSRVRVFMYPSNI

SEQ ID NO: 5682 - protein, 112 aa, Scabiosa columbaria
MVKGRQGERVRLYVRGTILGYKRSKSNQYPNTSLVQIEGVNTKEEVTWYQGKRMAYIYKAKVKKNGSHYRCIWGKVSRPHGNTGIVRAKFKSNLPPKSMGARVRVMMYPSNI

SEQ ID NO: 5683 - protein, 112 aa, Sesamum indicum
MVKGRQGERVRLYVRGTILGYKRSKSNQYPNTSLIQIEGVNTQEEVAWYRGKRMAYIYKAKVKKNGSHYRCIWGKVTRPHGNSGVVRAKFKSNLPPKSMGARVRVFMYPSNI

SEQ ID NO: 5684 - protein, 112 aa, Fragaria vesca
MVKGRQGERVRLYVRGTVLGYKRSKSNQYPNTSLIQIENVNTKEEVAWYAGKRLAYIYKAKVKKNGSHYRCIWGKVSRPHGNTGVVRAKFTSNLPPKSMGCRVRVFMYPSNI

SEQ ID NO: 5685 - protein, 112 aa, Helianthus annuus
MVKGRQGERVRLYTRGTILGYKRSKSNQYPNTSLIQIEGVNTKEEVCWYQGKRMAYVYKAKVKKNGSHYRCIWGKVTRPHGNTGVVRAKFKSNLPPKSMGSRVRVFMYPSNI

SEQ ID NO: 5686 - protein, 112 aa, Tamarix hispida
MVKGRQGERVRLYVRGSILGYKRSKSNQYPNTSLVQIEGVNTKEEVAWYQGKKMAYIYKAKIKKNGSHYRCIWGKVIRPHGNTGIVRAKFKSNLPPKSMGAKVRVFMYPSNI

SEQ ID NO: 5687 - protein, 111 aa, Eutrema parvulum
MKGRQGERVRLYVRGTVLGYKRSKSNQYPNNSLVQIEGVNTTEEVAWYKGKRMAYIYKAKTKKNGSHYRCIWGKVTRPHGNSGVVRAKFTSNLPPKSMGARVRVFMYPSNI

SEQ ID NO: 5688 - protein, 112 aa, Nicotiana tabacum
MVKGRQGERVRLYVRGTVLGYKRSKSNQYPSTSLIQIEGVNTKEEVDWYLGKRMAYVYKAKTKKNNSHYRCIWGKVCRPHGNSGVVRAKFKSNLPPKSMGAKVRVFMYPSNI

SEQ ID NO: 5689 - protein, 112 aa, Tripterygium wilfordii
MVKGRQGERVRLYVRGTVLGYKRSKSNQYPNTSLIQIEGVNTKEEVAWYCGKRMAYIYKANVKKNGTHYRCIWGKVSRPHGNSGVVRAKFKSNLPPKSMGSRVRVFMYPSNI

SEQ ID NO: 5690 - protein, 112 aa, Valeriana officinalis
MVKGRQGERVRLYVRGTILGYKRSKSNQYPNTSLVQIEGVNTKEDVTWYQGKRMAYIYKAKVKKNGSHYRCIWGKIARPHGNSGVVRAKFKSNLPPKSMGSRVRVFMYPSNI

SEQ ID NO: 5691 - protein, 126 aa, Amborella trichopoda
GGFVVHSPSSATFGENGEGSGGARKIICEGDYPWIQEVQKNQYENTSLVQIEGVNTKEEVAWYLGKRMAYIYKAKVKKNGSHYRCIWGKVNRPHGNSGVVRAKFKSNLPPRSMGAKVRVFMYPSRI

SEQ ID NO: 5692 - protein, 192 aa, Chelidonium majus
MEYYQELSPDGSNSPVSSNSSWKVGGRLRSTAHSTETDNAGTVVIKDFVSRAVVSQFRAHTSPISALCFDPSGTLLVTASVYGNSINIFRIMPSCLQNESGTPSYDWSNSHVHLYKLYRGITTAVIQDIRFSHFSQWIAIISSRGTCHIYVLSPFGGEAGLQTRSSVGDGPTLIPCLTSPWWSTSSCTNQQS

SEQ ID NO: 5693 - protein, 74 aa, Fraxinus spp
MVKGRQGERVRLYVRGTILGYKRSKSNQYPNTSLIQIEGVNSKEEVAWYHGKRMAYIYKAKVKQKWNPLQVHLG

SEQ ID NO: 5694 - protein, 75 aa, Allium cepa
MVKERQGQRVRLYVRGTVLGYKRSKSNQYENTSLMQIEGVNTKEDARWYAGKRVAYVYKAKVKKNGTHYRCIWGK

SEQ ID NO: 5695 - protein, 91 aa, Orobanche aegyptiaca
MVKGRQGERVRLYVRGTVLGYKRSKSNQYPNTSLVQIEGVNTQEEVGWYLGKRMAYVYKAKVKKNGSHYRCIWGKSRASRQQWCRSRKVQV

SEQ ID NO: 5696 - protein, 54 aa, Tamarix hispida
GASRVLGRRLSVQQNPQRQPPTAKMVKGRQGERVRLYVRGSILGLQEVEVKSIP

SEQ ID NO: 5697 - protein, 442 aa, Solanum lycopersicum
MATTSFHHPLLPNVHNDDELAIHIPSSAHQVSNDSWFQVGVVLSTGINSAFALGYAGLIMVPLGWVGGVVGLILSSAISLYASTLIAKLHEYGGRRHIRYRDLAGFMYGQTAYSLVWASQYANLFLINTGYVILGGQALKAFYVLFRDDHQMKLPHFIAVAGLACVLFAIAIPHLSALRIWLGFSTFFSLVYICIVIALSLKDGLEAPPRDYSIPGTKNSKTWATIGAAANLVFAYNTGMLPEIQATVREPVVNNMIKALNFQFTLGVIPMHAVTYIGYWAYGSSASSYLLNNVSGPIWLKGMANIAAFLQSIIALHIFASPTYEFLDTKYGVTGSALACKNLAFRIIVRGGYIAITAFLSALLPFLGDFMNLAGAISTFPLTFILPNHMYIVAKRKKLSFLKKSWHWLNIIFFSCIAVAAFVAALRFITVDSTTYHVFADL

SEQ ID NO: 5698 - protein, 126 aa, Triticum aestivum
MQQGDGTEAQVTWDDQQNINRFGRLNNRLHELADEIRLAKEANENLEDAGNELILSDEDVVRFQIGEVFAHMPVDDVEARLEQMKEDAAKKLEKLEEEKESILAQMAELKKILYGKFGDAINLEED

SEQ ID NO: 5699 - protein, 126 aa, Secale cereale
MQQGGGTEAQVTWDDQQNINRFGRLNNRLHELADEIRLAKEANENLEDAGNELILSDEDVVRFQIGEVFAHMPVDDVEARLEQMKEDAAKKLERLEEEKESILAQMAELKKILYGKFGDAINLEED

SEQ ID NO: 5700 - protein, 126 aa, Triticum aestivum
MQQGDGTEAQVTWDDQQNINRFGRLNNRLHELADEIRLAKEANENLEDAGNELILSDEDVVRFQIGEVFAHMPVDDVEARLEQMKEDAAKKLEKLEEEKESILAQMAELKKILKAKFGDAINLEED

SEQ ID NO: 5701 - protein, 126 aa, Brachypodium distachyon
MQQGDGTEAQVTWDDQQNINRFGRLNNRLHELADEIRLAKEANENLEDAGNELILSDEDVVRFQIGEVFAHMPMDDVETRLEQMKEEAAKKLERLEEEKESILAQMAELKKILYGKFKDAINLEED

SEQ ID NO: 5702 - protein, 126 aa, Triticum aestivum
MQQGDGTEAQVTWDDQQNINRFGRLNNRLHELADEIRLAKEANENLEDAGNELILSDEDVVRFQIGEVFAHMPVDDVEAKLEQMKEDAAKKLERLEEEKESILTHMAELKEILYGKFGKAINLEED

SEQ ID NO: 5703 - protein, 126 aa, Panicum virgatum
MQQGDGTEAQVTWEDQQNINRFGRLNNRLHELQDEIKLAKEANENLDDAGNELILSDEDVVRFQIGEVFAHMPRDDVETRLEQMKEDAAKKLERLEEEKESILAQMAELKKILYGKFKDAINLEED

SEQ ID NO: 5704 - protein, 126 aa, Panicum virgatum
MQQGDGTEAQVTWEDQQNINRFGRLNNRLHELQDEIKLAKEANENLDDAGNELILSDEDVVRFQIGEVFAHMPRDDVETRLEQMKADAAKKLERLEEEKESILAQMAELKKILYGKFKDAINLEED

SEQ ID NO: 5705 - protein, 126 aa, Unknown
  Sequence found in Organisms: Zea mays, Sorghum bicolor, Saccharum officinarum
MQQGDGTEAQVTWEDQQNINRFGRLNNRLHELQDEIKLAKETNENLDDAGNELILSDEDVVRFQIGEVFAHMPRDDVETRLEQMKEDAAKKLERLEEEKESILAQMAELKKILYGKFKDAINLEED

SEQ ID NO: 5706 - protein, 126 aa, Avena sativa
MQQGDGTEAQVTWEDQQNINRFGRLNNRFHELTDEIRLAKEANENLEDAGNELILCDEDVVRFQIGEVFAHMPMDDVEARLEQMKEDAAKKLERLEEEKESILAQMAELKKILYGKFKDAINLEED

SEQ ID NO: 5707 - protein, 126 aa, Cenchrus ciliaris
MQQGDGTEAQVTWEDQQNINRFGRLNNRLHELQDEIKLAKETNENLDDAGNELILSDEDVVRFQIGEVFAHMPRDDVETRLEQMKEDAAKKLERLEEEKESIVAQMAELKKILYGKFKDAINLEED

SEQ ID NO: 5708 - protein, 126 aa, Cynodon dactylon
MQQGDGTEAQVTWEDQQNINRFGRLNNRLHELDDEIKLAKEANENLDDAGNELILSDEDVVRFQIGEVFAHMARDDVETRLEEMKEDAAKKLERLEEEKESIVAQMAELKKILYGKFKDAINLEED

SEQ ID NO: 5709 - protein, 126 aa, Setaria italica
MQQGDGTEAQVTWEDQQNINRFGRLNNRLHELQDEIKLAKETNENLDDAGNELILSDEDVVRFQIGEVFVHMPRDDVETRLEQMKEDAAKKLERLEEEKESIVAQMAELKKILYGKFKDAINLEED

SEQ ID NO: 5710 - protein, 126 aa, Zea mays
MQQGDSTEAQVTWEDQQNINRFGRLNNRLHELQDEIKLAKETNENLDDAGNELILSDEDVVRFQIGEVFAHMPRDDVETRLEQMKEDAAKKLERLEEEKESVLAQMAELKKILYGKFKDAINLEED

SEQ ID NO: 5711 - protein, 126 aa, Pennisetum glaucum
MQQGDGTEAQVTWEDQQNINRFGRLNNRLHELQEEIKLAKETNENLDDAGNELILSDEDVVRFQIGEVFAHMPRDDVETRLEQMKEDAAKKLERLEEEKESIVAQMAELKKILYGKFKDAINLEED

SEQ ID NO: 5712 - protein, 126 aa, Oryza sativa
MQQGDGTEAQVTWEDQQNINRFGRLNNRLHELHDEIKLAKEANENLDDAGNELILSDEDVVRFQIGEVFAHMPRDDVETRLEQMKEDAAKKLERLEQEKESIVSQMAELKKILYGKFKDAINLEED

SEQ ID NO: 5713 - protein, 126 aa, Musa acuminata
MQKGEGSEAQVTWEDQQNINKFGRLNNRFHELEDEIKVAKETNENLEDASNELILSDEDIVRFQIGEVFAHVPREEVENRLEKMKEDASKELEKLEEEKESILAQMAELKKILYGKFKDSINLEED

SEQ ID NO: 5714 - protein, 126 aa, Amorphophallus konjac
MQQGSGSEAEVTWEDQQNINKFSRLNNRFHELDEEIKAAKETNENLEDASNELILSDEDVVRFQIGEVFAHVPREDVENRLETMKEDASKELEKLEEEKESVLAQMAELKKILYGKFKDSINLEED

SEQ ID NO: 5715 - protein, 126 aa, Elaeis guineensis
MQQGEGSETQVTWEDQQNINKFGRLNNRFHELEDEIKVAKEANESLEDASNELILSDEDMVRFQIGEVFAHMPREEVEGRLEKMKEDASKELERLEEEKESVLAQMAELKKILYGKFNDSINLEED

SEQ ID NO: 5716 - protein, 126 aa, Aristolochia fimbriata
MQQGSGSETEVTWEDQQNINKFGRLNNRFHELEDEIKVAKETNDNLEDASNELILSDEDVVRFQIGEVFTHMPREDVEERLEKMKEDTSKLLEKLEEEKESVLAQMAELKKILYGKFKDSINLEED

SEQ ID NO: 5717 - protein, 107 aa, Festuca arundinacea
MQQGDGTEAQVTWEDQQNINRFGRLNNRLHELADEIRLAKEANENLEDAGNELILCDEDVVRFQIGEVFAHMPMDDVETRLEQMKENAAKKLERLEEERESILAQMA

SEQ ID NO: 5718 - protein, 126 aa, Zingiber officinale
MQQGEGSETQVTWEDQQNINKFGRLNNRYHELEEEIKVAKEANENLEDASNELILSDEDVLRFQIGEVFAHVPSEEVESRLEKMKEDAAKELQRLEEEKESVLAQMAELKKILYGKFKDSINLEED

SEQ ID NO: 5719 - protein, 586 aa, Oryza sativa
MERVLKSARESGSLNLSNRSLREVPKEVYNNLDTGAQDEKWWEGVDLQKLILAHNNLEVLREDLRNLSSLVVLNISHNNISSLPAAIGDLPLLKSLDVSSNQINAFPEEIGFATALVKVDCSNNCLTDLPVSLARCLELSELNASNNTISVLPDELAGCSKLFRLNLEGNKLVTLSDKMFMSWTMLTEMNAAKNLLTAIPDGIGALSKLIRLDLHQNKITLIPPSIKDCSSLAEFYMGNNLLTSIPEDIGMLSNLGILDLHSNQLKEYPVGACRLKLSFLDLSNNSLSGLPAELGTMTTLRKLLLTGNPMRTLRSSLVSGPTTALLKYLRSRLSSDEGASGSGSTPTKDDQIAAARRLSLSSKELDLSGLGVTSVPPAAWETNDVMKLDLSKNSIEDLPNELSLCSSLQSLILSNNKIKRWPGTVFSSLASLSLLKLDNNPLAEILATDLEALSKLEVLDLSGSASSLPEPSAVSKLPHLKELYLRRMKLHGFPDSLLGLKLLRILDLSQNYLTSVPEGIKDLTSLIELDLSDNNITTLPPELGLLEPNLQVLKLDGNPLRSIRRTLLERGTKAILKYLKEKLPAE

SEQ ID NO: 5720 - protein, 136 aa, Secale cereale
MGSLGSSDDEKRLAVESVNTEAACALLASEQYGYVDVRMWEDFDRGHVAGARNVPYYLSVNPHGKERNLDFVDQVAALHSKQDRLIIGCRSGVRSRLATADLVAAGFTKVKNLEGGYLSLLKSVSYQQQAALASRH

SEQ ID NO: 5721 - protein, 136 aa, Secale cereale
MGSLGSSDDEKRPAVESVNTEAACALLASEQYGYVDVRMWEDFDRGHVAGARNVPYYLSVNPHGKERNLDFVDQVAALHSKQDRLIVGCRSGVRSRLATADLVAAGFTKVKDLEGGYLSLLKSVSYQQQAALASRQ

SEQ ID NO: 5722 - protein, 136 aa, Triticum aestivum
MGSLGSSDGEKRLPVESVNTEAACALLASEQYGYVDVRMWEDFDRGHVAGARNVPYYLSVNPHGKERNLDFVDQVAALHSTHDRLIVGCRSGVRSRLATADLVAAGFTKVKNLEGGYLSLLKSVSYKQQAALANLH

SEQ ID NO: 5723 - protein, 137 aa, Triticum aestivum
MGSLGSSDVEKRLAVESVNTEAACALLASSEQYGYVDVRMWEDFDRGHVAGARNVPYYLSVNPHGKERNLDFVDQVAALHSKQDRLLVGCRSGVRSRLATADLVAAGFTKVKNLEGGYLSLLKSVSYPQLAAAASLH

SEQ ID NO: 5724 - protein, 136 aa, Triticum aestivum
MGSLGSSDVEKRLAVESVNTEAACALLATEQYGYVDVRMWEDFDRGHVAGARNVPYYLSVNPHGKERNLDFVDQVAALHSKQDRLLVGCRSGVRSRLATADLVAAGFTKVKNLEGGYLSLLKSVSYQQPAALANLH

SEQ ID NO: 5725 - protein, 136 aa, Secale cereale
MGSLGSSDDEKRPAVESVNTEAACALLASEQYGYVDVRMWEDFDRGHVAGARNVPYYLSVNPHGKERNLDFVDQVAALHSKQDRLIVGCRSGVRSRLATADLVAAGFTKVKNLEGGYLSLLKSVSYQQQAAVANRH

SEQ ID NO: 5726 - protein, 248 aa, Triticum aestivum
MAERKEESVMDKITEKFHGGSSSSSSSDDEGRSGSSSSVKAKIYRLFGREKPVHSVLGGGKPADLFLWRNKKISGGVLAGATAIWLLFEVLEYHLLTLLCHGFILTLGILFLWSNASAFVNKCPPNIPEVKIPEDLAVNVARSLRYEINRGFASLRAIGQGRDLKKFLIVVAGLWILSFLGSCCNFLTLFYIVFMVLYTVPVLYEKYEDKIDAFGEKAMVELKKYYAIFDEKCLSKIPKGPSKDKKQH

SEQ ID NO: 5727 - protein, 249 aa, Triticum aestivum
MAEHKEESVMDKITEKFHGGSSSSSSSDDDERKSGSSSSVKAKIYRLFGREKPVHSVLGGGKPADLFLWRNKKISGGVLAGATAIWLLFEVLEYHLLTLLCHGFILTLGILFLWSNASAFVNKCPPNIPEVKIPEDLAVNVARSLRYEINRGFASLRAIGQGRDLKKFLIVVAGLWILSFLGSCCNFLTLFYIVFMVLYTVPVLYEKYEDKIDAFGEKAMVELKKYYAIFDEKCLSKIPKGPSKDKKQH

SEQ ID NO: 5728 - protein, 247 aa, Leymus cinereus x Leymus triticoides
MAEHKEESVMDKITEKLHGGSSSSSSSDDEGKSGSSSVKAKIYRLFGREKPVHSVLGGGKPADLFLWRNKKISGGVLAGATAIWLLFEVLEYHLLTLLCHGFILTLGILFLWSNASAFINKCPPNIPEVKIPEDLAVNVARSLRYEINRGFASLRAIGQGRDLKKFLIVVAGLWILSALGSCCNFLTLFYIVFMVLYTVPVLYEKYEDKIDAFGEKAMVELKKYYAIFDEKCLSKIPKGPSKDKKQH

SEQ ID NO: 5729 - protein, 248 aa, Pseudoroegneria spicata
MAEHKEESVMDKITEKFHGGSSSSSSSDDEGKSGSSSSVKAKIYRLFGREKPVHSVLGGGKPADLFLWRNKKISGGVLAGATAIWLLFEVLEYHLLTLLCHGFILTLGILFLWSNASAFINKCPPNIPEVKIPEDLAVNVARSLRYEINRGFASLRAIGQGRDLKKFLIVVAGLWILSALGSCCNFLTLFYIVFMVLYTVPVLYEKYEDKIDAFGEKAMVELKKYYAIFDEKCLSKIPKGLSKDKKQH

SEQ ID NO: 5730 - protein, 251 aa, Secale cereale
MAEHKEESVMDKITEKFHGGSSSSSSSSDDEGRSGAQSSSSVKVKIYRLFGREKPVHSVLGGGKPADLLLWRNKKISGGVLAGATAIWLLFEVLEYHLLTLLCHGFIVTLGILFLWSNASAFINKCPPNIPEVKIPEDLAVNVARSLRYEINRGFASLRAIGQGRDLKKFLIVVAGLWILSALGSCCNFLTLSYIVFMVLYTVPVLYEKYEDKIDAFGEKAMVELKKYYAIFDEKCLSKIPKGPSKDKKQH

SEQ ID NO: 5731 - protein, 251 aa, Secale cereale
MAEHKEESVMDKITEKFHGGSSSSSSSSDDEGRSGAQSSSSVKAKIYRLFGREKPVHSVLGGGKPADLLLWRNKKISGGVLAGATAIWLLFEVLEYHLLTLLCHGFIVTLGILFLWSNASAFINKCPPNIPEVKIPEDLAVNVARSLRYEINRGFASLRAIGQGRDLKKFLIVVAGLWILSALGSCCNFLTLSYIVFMVLYTVPVLYEKYEDKIDAFGEKAMVELKKYYAIFDEKCLSKIPKGPSKDKKLH

SEQ ID NO: 5732 - protein, 251 aa, Secale cereale
MAEHKEESVMDKITEKFHGGSSSSSSSSDDEGRSGTQSSSSVKVKIYRLFGREKPVHSVLGGGKPADLLLWRNKKISGGVLAGATAIWLLFEVLEYHLLTLLCHGFIVTLGILFLWSNASAFINKCPPNIPEVKIPEDLAVNVARSLRYEINRGFASLRAIGQGRDLKKFLIVVAGLWILSALGSCCNFLTLSYIVFMVLYTVPVLYEKYEDKIDAFGEKAMVELKKYYAIFDEKCLSKIPKGPSKDKKQH

SEQ ID NO: 5733 - protein, 251 aa, Secale cereale
MAEHKEESVMDKITEKFHGGSSSSSSSSDDEGRSGAQSSSSVKAKIYRLFGREKPVHSVLGGGKPADLFLWRNKKISGGVLAGATAIWLLFEVLEYHLLTLLCHGFIVTMGILFLWSNASAFINKCPPNIPEVKIPEDLAVNVARSLRYEINRGFASLRAIGQGRDLKKFLIVVAGLWILSALGSCCNFLTLSYIVFMVLYTVPVLYEKYEDKIDAFGEKAMVELKKYYAIFDEKCLSKIPKGLSKDKKQH

SEQ ID NO: 5734 - protein, 125 aa, Secale cereale
MDKITENSDGGPSSSSYVVGRRGRSGAQSSSSVKAKIYRLFGREKPVHSVLGGGKPADLFLWRNKKISGGVLAGATAIWLLFVGPRSTTLLTLLLPRLHRHHWASSSSGPTPPPSSTSALPTFQR

SEQ ID NO: 5735 - protein, 245 aa, Lolium multiflorum
MAEHKEESVMDKISEKFHGSSSSSDSDGEGKSAAAAVKAKIYRLFGREKPVHSVLGGGKPADLFLWRNKKISGGVLAGATSIWLLFEVLEYHLLTLFCHCLILTLGTLFLWSNASAFINKAPPNIPEVKITEDLAVNVARSLRYEINRGFASLRAIGQGRDLKKFLIVIAGLWILSALGSCCNFLTLFYIVFMVLYTVPVLYEKYEDKIDAFGEKAMVELKKYYAIFDEKCLSKIPKGPSKDKKH

SEQ ID NO: 5736 - protein, 249 aa, Avena sativa
MAEHKEESVMDKISEKLHGSSSSSGSDDEGRSSSPSAAAAVKAKIYRLFGREKPVHSVLGGGKPADLFLWRNKKISGGVLAGATSIWLLFEVLEYHLLTLFCHCLILTLGTLFLWSNASAFINKSPPNIPEVKIPEDLAVNVARSLRYEINRGFASLRAIGQGRDLKKFLIVIAGLWILSALGSCCNFLTLFYIVFMVLYTVPVLYEKYEDKIDAFGEKAMVELKKYYAIFDEKCLSKIPKGPSKDKKH

SEQ ID NO: 5737 - protein, 244 aa, Brachypodium distachyon
MAEHKEESVMDKISEKLHGGSSSGSDDESSSAAAAVKAKIYRLFGREKPVHSVLGGGKPADLFLWRNKKISGGVLAGATAIWLLFEVMEYHLLTLLCHCFILTLGILFLWSNASAFINKSPPNIPEVRIPEDLAVNVARSLRYEINRGFASLRDIGQGRDLKKFLIVIAGLWTLSALGSSCNFLTLFYIVFMVLYTVPVLYEKYEDKIDAYGEKAMIELKKYYAIFDEKCLSKIPKGPSKDKKH

SEQ ID NO: 5738 - protein, 114 aa, Secale cereale
GGSSSSSSSDDEGKSGSQSSSSIKAKIYRLFGREKPVHSVLGGGKPADLFLWRNKKISGGVLAGATAIWLLFEVLGVPLSSPSSATASSSPWASSSSGPTPPPSSTSALPTFQR

SEQ ID NO: 5739 - protein, 252 aa, Panicum virgatum
MAEQHKEESVLEKISDKLHGRGGGGSSSSSDSDDDRSSATAAVKAKIYRLFGREKPVHSVLGGGKPADLFLWRNKKISGGVLAGATAIWLLFEVMDYHLLTLLCHCLILTLAILFLWSNATTFINKSPPNIPEVKIPEDLAVNVARSLRYEINRGFATLREIGQGHDLKKFLIVIAGLWILSVLGTCCNFLTLFYIVFMVLYTVPVLYEKYEDKVDAFGEKAMVELKKYYAIFDEKCLSKIPKGPSKDKKLH

SEQ ID NO: 5740 - protein, 249 aa, Cenchrus ciliaris
  misc_feature (223)..(223): Xaa can be any naturally occurring amino acid
  misc_feature (230)..(230): Xaa can be any naturally occurring amino acid
  misc_feature (242)..(242): Xaa can be any naturally occurring amino acid
  misc_feature (247)..(247): Xaa can be any naturally occurring amino acid
MAEQHKEESVLEKLSDKLHGRGSSSSSDSDDERSSATAAVKAKIYRLFGREKPVHSVLGGGKPADLFLWRNKKISGGVLAGATAIWLLFEVMDYHLLTLLCHCLILTLAILFLWSNATTFINKSPPNIPEVKIPEDLAVNVARSLRYEINRGFATLREIGQGHDLKKFLIVVAGLWILSVLGSCCNFLTLSYIVFMVLYTVPVLYEKHEDKVDAFGEKAMVEXKKYYAIXDEKCLSKIPKGXSKDKXQH

SEQ ID NO: 5741 - protein, 252 aa, Setaria italica
MAEQHKEESVLEKLSDKLHGRGGGSSSSSSDSDDERSSATTAVKAKIYRLFGREKPVHSVLGGGKPADLFLWRNKRISGGVLAGATAIWLLFEVMDYHLLTLLCHCLILTLAILFLWSNATTFINKSPPNIPEVKIPEDLAVNVARSLRYEINRGFATLRGIGQGHDLKKFLIVVAGLWILSVLGSCCNFLTLSYIVFMVLYTVPVLYEKHEDKVDAFGEKTMVELKKYYAIFDEKCLSKIPKGPSRDKKQH

SEQ ID NO: 5742 - protein, 252 aa, Panicum virgatum
MAEQHKEESVLEKISDKLHGRGGGSSSSSSDSDDDRSSATAAVKAKIYRLFGREKPVHSVLGGGKPADLFLWRNKRISGGVLAGATAIWLLFEVMDYHLLTLLCHCLILTLAILFLWSNATTFINKSPPNIPEVKIPEDLAVNVAHSLRYEINRGFATLREIGQGHDLKKFLIVIAGLWILSVLGSCCNFLTLFYIVFMVLYTVPVLYEKYEDKVDAFGEKAMVELKKYYAIFDEKCLSKIPKGPSKGKKLH

SEQ ID NO: 5743 - protein, 254 aa, Saccharum officinarum
MAEQHREESGASVMDKISDKLHGRGGGSSSSSDSDDERSSATAAVKAKIYRLFGREKPVHSVLGGGKPADLFLWRNKRISGGVLAGATAIWLLFEVMDYHLLTLLCHCLILTLAILFLWSNATTFINKSPPNIPEVKIPEDLAVNVARSLRYEINRGFATLREIGQGHDLKKFLIVIAGLWILSVLGSCCNFLTLSYIVFMVLYTVPILYEKHEDKVDAFGEKAMVELKKYYAIFDEKCLSKIPKGPLKDKKQH

SEQ ID NO: 5744 - protein, 252 aa, Pennisetum glaucum
MAEQHKEESELEKLSDKLHGRGGGSSSSSSDSDDERSSATAAVKAKIYRLFGREKPVHYVLGGGKPADLFLWRNKKISGGVLAGVTAIWLLFEVMDYHLLTLLCHCLIVTLAILFLWSKATTFINKSPPNIPEVKIPEDLAVNVARSMRYEINRGFATLREIGQGHDLKKFLIVVAGLWILSVLGSCCNFLTLSYIVFMVLYTVPVLYEKHEDKVDAFGEKAMVELKKYYAILDEKCLSKIPKGPSKDKKQH

SEQ ID NO: 5745 - protein, 412 aa, Triticum aestivum
MEGYRGRPWTRLPALLLACAAAAAVGECRVVHVGEAHRRSMLANGLGATPPMGWNSWNHFACDGNGEVVIRETADALVSTGLAAAGYKYVNLDDCWAEPERDAKGNLAANKKTFPHGIKALADYVHSKGLKLGIYSDAGYKTCAKAQPGSLGHEEQDAKTFASWGIDYLKYDNCNNGDTKPLQRYPDMSKALMQAGRPIFFNLCEWGDMHPARWGAAYGNSWRTTNDIEDTWDSMTSMADQNEVWAEYARPGGWNDPDMLEVGNGGMTNDEYIVHFSIWAISKAPLIIGCDVRHMSQDTYDILANKEVIAVNQDPLGVQGKKVRMEGSSEIWAAPLTGYRTAVLLLNRHAKDEAQITAHWDDIGLPAGTAVDARDLWLHKTLDAKFTDKMSFNVTPHAARMFVLTPLKSQMD

SEQ ID NO: 5746 - protein, 411 aa, Secale cereale
MEGRGRPWTRLPALLLAALACAAVGECRVVHVGEAHRRSMLANGLGATPPMGWNSWNHFACDGNGEVVIRETADALVSTGLAAVGYKYVNLDDCWAEPERDAKGNLAANKKTFPHGIKALADYVHGKGLKLGIYSDAGYKTCAKAQPGSLGHEEQDAKTFASWGIDYLKYDNCNNGDTKPLQRYPDMSKALMQAGRPIFFNLCEWGDMHPARWGAAYGNSWRTTNDIEDTWDSMMSMADQNEVWAEYARPGGWNDPDMLEVGNGGMTNDEYIVHFSIWAISKAPLIIGCDVRHMSQDTYDILANKEVIAVNQDPLGVQGKKVRMEGSSEIWAAPLTGYRTAVLLLNRHAKDEAQITAHWDDIGLPAGTAVEARDLWLHKTLNTKFTDKMSFNVTPHAARMFVLTPLKSQMD

SEQ ID NO: 5747 - protein, 415 aa, Triticum aestivum
MEGCRVRPWTRLPAPLLVALACAAAAAVGECRVVHVGEAHRRSMLANGLGATPPMGWNSWNHFGCDGNGEVVIRETADALVSTGLAAVGYKYVNLDDCWAEPERDAKGNLAANKKTLPHGIKALADYVHSKGLKLGIYSDAGYKTCAKAQPGSLGHEEQDAKTSASWGIDYLKYDNCNNGDTKPLQRYPDMSKALMQAGRPIFFNLCEWGDMHPARWGAAYGNSWRTTNDIEDTWNSMMSRADQNEVWAEYARPGGWNDPDMLEVGNGGMTNDEYIVHFSIWAISKAPLIIGCDVRHMSQDTYDILANKEVIAVNQDPLGIQGKKVRMEGSSEIWAGPLTGYRTAVLLLNRHDKDEAQITAHWDDIGLPAGTAVEARDLWMHKTLDTKFTDKMSFNVTPHAARMFMLTPLKSQMD

SEQ ID NO: 5748 - protein, 420 aa, Brachypodium distachyon
MEGNRGGSPWPRLPAPALMPMLLLVVLASVAAVGEAKVVHVGEAHRRSMLANGLGSTPPMGWNSWNHFGCDGNGEVVIRETADALISTGLAAAGYRYVNLDDCWAESERDAKGNLVAKKSTFPNGIKALADYVHSKGLKLGIYSDAGYKTCAKAQPGSLGYEEQDAKTFASWGVDYLKYDNCNNGDLKPLERYPEMSKALMKAGHPIYFSICEWGDMHPARWAAAYGNSWRTTNDIEDTWDSMTSRADQNEVWAEYARPGGWNDPDMLEVGNGGMTNDEYIVHFSIWAISKAPLIIGCDVRHMSQDTYDILANTEVIAVNQDPLGVQGKKVRMEGSNEIWAAPLSGYRTAVVLLNRHAKDEAEITARWDDIGLPAGMAVEARDLWQHKTLDAKFTDKMPFNVTPHAARMFLLTPLTSQIN

SEQ ID NO: 5749 - protein, 417 aa, Avena sativa
MEGGRRCSPWTRLPALLLLLLLACAASVRVGECRVVHVGEAHRRSMLANGLGSTPPMGWNSWNHFACDGNGEVVIKETADALVSTGLAAAGYKYVNLDDCWAEPERDAKGNLVANKKTFPHGIKALADYVHSKGLKLGIYSDAGYKTCAKAQPGSLGYEEKDAKTFASWGVDYLKYDNCNNGDLKPLERYPDMSKALMKTGRPIYLSICEWGDMHPAKWGAALGNSWRTTDDIEDTWESMTSRADQNEVWAEYARPGGWNDPDMLEVGNGGMTNDEYIVHFSIWAISKAPLIIGCDVRHMSQDTYDILANKEVIAVNQDPLGIQGKKVRMEGSKETWAAPLSGYRMAVLLANRHVRDEVEMTVHWDDIGLPAGTTVQARDLWLHKTLDAKFTDKMAFNLTSHTARMFVLTPLNSQIN

SEQ ID NO: 5750 - protein, 417 aa, Pennisetum glaucum
MAGGGRRRTGPSSPARLALLVVMVMLLAAAAAEAKVVHVEEAHRRSMLANGLGSAPPMGWNSWNHFQCDGNGEVVIRETADALVSTGLAALGYKYVNIDDCWAEPKRDATGNLVANTKTFPHGIKALADYVHSKGLKLGIYSDAGFQTCAKVQPGSLGHEEQDAKTFAAWGVDYLKYDNCNNGDLKPLERYPEMSKALMKAGRPIYFSLCEWGDMHPARWGAAYGNSWRTTNDIADTWESMIATADQNEVWAEYARPGGWNDPDMLEVGNGGMKNSEYVVHFSLWAISKAPLIIGCDVRHMSQETYDILANKEVIAVNQDPLGVQGKKVRMEGSNEIWAAPLSEYRTAVVLLNRHATDEATITAHWDDIGLPAGTTVEARDLWLHKTLGAAFTDKMAFDVAPRSCRMFVLKPTSRLQ

SEQ ID NO: 5751 - protein, 411 aa, Setaria italica
MAGGGRRTGPSPARLALMVLLLAAAVAAEAKVVHVEEPHRRSMLANGLGSAPPMGWNSWNHFQCDGNGEVVIRETADALVSTGLAALGYKYVNIDDCWAEPKRDAMGNLVANTNTFPHGIKALADYVHSKGLKLGIYSDAGFQTCAKVQPGSLGHEEQDAKTFAAWGVDYLKYDNCNNGDLKPLERYPEMSKALMKAGRPIYFSLCEWGDMHPARWGAAYGNSWRTTNDIADTWESMIATADQNEVWAEYARPGGWNDPDMLEVGNGGMKNNEYVVHFSLWAISKAPLIIGCDLRHMPQETYDILANKEVIAVNQDPLGVQAKKVRMEGSSEIWAAPLSDYRTAVVLLNRHATDEATITARWDDIGLPAGTAVEARDLWLHKTLDTAFTDKMAFDVAARSCRMFVLKSRLR

SEQ ID NO: 5752 - protein, 414 aa, Zea mays
MAGGRGSSAARLALLLVVVVAAVAGGAVAGGKVVHVEEAHRRSMLANGLGSAPPMGWNSWNHFQCDGNGEVVIRETADALVSTGLAALGYRYVNIDDCWAEPQRDAKGNLVANTKTFPHGIKALADYVHGKGLKLGIYSDAGFQTCAKAQPGSLGHEELDAKTFAAWGVDYLKYDNCNNGDLKPLERYPEMSRALMKVGRPIYFSLCEWGDMHPATWGATYGNSWRTTNDIADTWDSMIATADQNEVWSEYARPGGWNDPDMLEVGNGGMTNSEYVVHFSLWAISKAPLIIGCDVRHMSRETYAILANKEVIAVNQDPLGVQGKKVRMEGSSEIWAAPLSEYRTAVLLLNRHAKDEATIAAHWDDIGLPAGTPVEARDLWLHETLDATFTDKMSFDVAPHSCRMLVLKPRIQIQ

SEQ ID NO: 5753 - protein, 413 aa, Oryza sativa
MAAAAAVLLAVACAAAAMIAGGECGRVVHVGEEHRRSMLANGLATAPPMGWNSWNHFACDGNGEDVIRETADALVSTGLAAAGYKYVNIDDCWAEPQRDSKGNLVANKKTFPHGIKALADYVHSKGLKLGIYSDAGFKTCAKVQPGSLGHEEQDAKTFASWGVDYLKYDNCNNGDLKPLERYPEMSKALMMAGRPIYFSLCEWGDMHPAKWGAAYGNSWRTTNDIADTWESMVSRADENEVWADYARPGGWNDPDMLEVGNGGMTNDEYIVHFSLWAISKAPLIIGCDVRHMSQETYDILANKEVIAVNQDALGIQGKKVRMEGSSEVWAAPLSGYRTAVLLLNRHAAEAAAITAHWDDVGLPAGTAVEARDLWRHATVAGAGGELTEKITLDVAPHSCRMLLLKPLISSRAN

SEQ ID NO: 5754 - protein, 409 aa, Sorghum bicolor
MAGGGGSSPARLALLLMAVAVVGGGGKVVQVEEAHRRSMLANGLGSAPPMGWNSWNHFQCDGNGEVVIRETADALVSTGLAALGYRYVNIDDCWAEPKRDAKGNLVANTKTFPQGIKALADYVHSKGLKLGIYSDAGFQTCAKVQPGSLGHEEQDAKTFAAWGVDYLKYDNCNNGDLKPLERYPEMSRALMKVGRPIYFSLCEWGDMHPAKWGAAYGNSWRTTNDIADTWDSMIATADQNEVWAEYARPGGWNDPDMLEVGNGGMTNSEYVVHFSLWAISKAPLIIGCDVRHMSQETYDILANKEVIAVNQDPLGVPGKKVRMEGSSEIWAAPLSEYRTAVVLLNRHAKDQATITAHWDDIGLPAGTPVEATDLWLHETVDATFTDTMSFDVAPHSCRMFVLKPNIHIR

SEQ ID NO: 5755 - protein, 339 aa, Secale cereale
ERFRFRSPPLSLKLAFAAVSLGVSFAAVSCSSSSPLPSSAASSSPRPSPRTVAADLLAVLAGPRAAARVPAREASRLSSCLRFLSPVNPAATSTTYPWRGSRKFLLEGCDAAEADAMVMWPPAPVLELARLAVDSGGDPGAIHRLLDPTMLPVPDIEGTKKSKCHLTRTPYGRRFADEDINSYFAFLFELIVARGPSVGLNVSLNRYDLFHGHLFLASGTGRVGILFHAKEYPAFDKKRFPYNLGYCQRESDVPYDDSMNLRNILWLAPLPSSDTKAWLAPGVLVVLDAHPDGIIYQDMIRDYVQIVRTIYEDDFGELAVDVNYLNVANAAPADRIFIC

SEQ ID NO: 5756 - protein, 340 aa, Secale cereale
MERFRFRSPPLSLKLAFAAVSLGVSFAAVSCSSSSPLPSSAASSSPRPSPRTVAADLLAVLAGPRAAARVPSREASRLSSCLRFLSPVNPAATSTTYPWRGSRKVLLEDCDAAEADAMVMWPPAPVLELARLAVDSGGDPGAIHRLLDPTMLPVPDIEGTKKNKCHLTRTPYGRRFADEDINSYFAFLFELIVARGPSVGLNVSLNRYDLFHGHLFLASGTGRVGILFHAKEYPAFDKELFPYNLGYCQRESDVPYDDSMNLRNILWLAPLPSSDTKAWLAPGVLVVLDAHPDGIIYQDMIRDYVQIVRTIYEDDFGELAVDVNYLNVANAAPADRIFIC

SEQ ID NO: 5757 - protein, 342 aa, Brachypodium distachyon
MERFRFRFRRSPLLSLNLKLAFAVSLGLGVSFAVSSSSSSALPSPPPSPQAVAADLLAVLAGPRAASRVPAGEASRLRSCLRFLSPASASAVSRESPPWRGFRKVLLEGCDDDAAEADGLVMWPPAPVMELARLAVDSGGNPGAIHHALDPTMLPVPDIEGSKKNKCHLTRTPYGRRFANQEINSYLAFLFELIATRGPSVGLNVSLNRYDLFHGHLFLASGTGRLGILFHAKEYPAFDKELFPYNLGYCQAGSDVPYDDSMNLRNILWLAPLPSSETKAWLAPGVLVILDAHPDGIIYQDMIRDYVQIVRTIYEDDFGELAVDVNYLNVANAAPADRIFIC

SEQ ID NO: 5758 - protein, 199 aa, Secale cereale
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLGGNALTFAHNNGGGVLPPFTLPPILDASDAFASCCQALVVKPKKH

SEQ ID NO: 5759 - protein, 199 aa, Triticum aestivum
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLTGNALTFAHDNGAGVLPPFTLPPILDASDAFASCCQALVAKPKKH

SEQ ID NO: 5760 - protein, 322 aa, Avena sativa
MTMDLMGRYGRADEQVAIQEAAAAGLRGMEHLILQLSRTGTGTSESSLAGASEPAAQGQQQQQQVDCREITDMTVSKFKKVISILNHRTGHARFRRGPVVAQSQGPSVSEPAPVRTASSSRPMTLDFSKSASGFGSKDQAAAYSVSAASSSFLSSVTGDGSVSNGRGGGGSSLMLPPPPSASCGKPPLAAGAAAGPKRKCHDHAHSENVAGASGGRCHCSKRRKSRVKRMTRVPAISSKAAEIPADDFSWRKYGQKPIKGSPYPRGYYKCSTVRGCPARKHVERDPSDPSMLIVTYEGDHRHAPGDQEPAAALTPLPELHKL

SEQ ID NO: 5761 - protein, 195 aa, Brachypodium distachyon
MAARSENDSDGDEGTNPTGAGGGFSPPPLAAAPVVCVLRSAGDFAGGAFVGSIFGYGQGLITKKGFKGSFSNAGSSAKSFAVLSGVQSLVLCLLRKLRGKDDIVNSGIAGCCTGLALSFPGTPQALLQNCATFAAFSCIMEGLNKQQAMAQTLDGNALNFTLGKGGVLPPFTLPPILDASDALASCCQALVKRKN

SEQ ID NO: 5762 - protein, 69 aa, Triticum aestivum
MRFAGWYLKIAVGGAAIGAAMELFMIHTGFYEKVTVLESEKRAWESSPEAQAMREALNPWHKRDEQEKK

SEQ ID NO: 5763 - protein, 69 aa, Secale cereale
MRFAGWYLKIAVGGAAIGAAMELFMINTGFYEKVTVLESEKRAWESSPEAQAMREALNPWHKRDEQEKK

SEQ ID NO: 5764 - protein, 69 aa, Secale cereale
MRFAGWYLKIAIGGAAIGAAMELFMIHTGFYEKVTVLESEKRAWESSPEAQAMREALNPWHKRDEQEKK

SEQ ID NO: 5765 - protein, 69 aa, Brachypodium distachyon
MRFAGWYLKIAAGGAAIGASMELFMIHTGFYEKVTVLESEKRAWESSPEAQAMREALNPWHKRDEQEKR

SEQ ID NO: 5766 - protein, 69 aa, Unknown
  Sequence found in Organisms: Setaria italica, Panicum virgatum
MRFAGWYLKIAAVGASIGAAMELFMIHTGFYEKVTVLESEKRAWESSPEAQAMREALNPWRKHDEQQKK

SEQ ID NO: 5767 - protein, 70 aa, Oryza sativa
MGLAARASTAGKAMVRMSIPISSTMNHPRPRTSSSSPSGEVSFSATTSVTPGFPRHRVGLHRGGGAALRQ

SEQ ID NO: 5768 - protein, 94 aa, Festuca arundinacea
HEGRLLAPATAASDTACSQRRGMRFAGWYLKIAAGGAAIGACMELFMIHTGFYEQVTMLESEKRAWESSPEAQAMREALNPWHKRDEKPDEKEK

SEQ ID NO: 5769 - protein, 106 aa, Oryza sativa
MANEGGVDERRDGVGGEGEHSRQGDGEDFHTNLINHEPPAPEHLLSSILPLGVGLPPPGLLLVVVYHVLHRRLPAAPRGPPPRSSSTRAVTVGEGKGETVERWSGG

SEQ ID NO: 5770 - protein, 69 aa, Setaria italica
MRFAGWYLKIAAVGASIGAAMELFMIQTGFYEKVTVLESEKRAWESSPEAQAMREALNPWRKHDEQQKK

SEQ ID NO: 5771 - protein, 69 aa, Sorghum bicolor
MKFAGWYLKIAAVGASIGAAMELFMIHTGFYDKVVVLESEKRAWESSPEAQAMREALNPWRKHDEQQKK

SEQ ID NO: 5772 - protein, 71 aa, Zea mays
MRFAGWYLKIAAVGASIGAAMELFMIHTGFYEKVTVLESEKRAWESSPEAQAMREALNPWHKHDEQEQQKK

SEQ ID NO: 5773 - protein, 70 aa, Zea mays
MRFAGWYLKIAAVGASIGAAMELFMIHTGFYEKVTVLESEKRAWESSPEAQAMREALNPWRKHDEQEQQK

SEQ ID NO: 5774 - protein, 69 aa, Sorghum bicolor
MRFAGWYLKIAAVGASIGAAMELFMIHTGFYDKVVVLESEKRAWESSPEAQAMREALNPWRKHDEQQKK

SEQ ID NO: 5775 - protein, 69 aa, Panicum virgatum
MRFAGWYLKIAAVGASIGAAMELFMIHTGFYEKVTVLESEKRAWESSAEAQAMRDALNPWGKHDEQQKK

SEQ ID NO: 5776 - protein, 51 aa, Zea mays
MELFMIHTGFYEKVTVLGSEKRAWESSLEAQAMREALNPWQKHDEQEQQKK

SEQ ID NO: 5777 - protein, 71 aa, Saccharum officinarum
MRFAGWYLKIAAVGASIGAAMELFMIHTGFYDKVVVLESEKRAWESSPEAQAMREALNPWRKHDEEQKKQS

SEQ ID NO: 5778 - protein, 63 aa, Pennisetum glaucum
MRFAGWYLKIAAVGASIGAAMELFMIHTGFYEKVTVLESEKRAWESSPEAQAMREALNPWRKH

SEQ ID NO: 5779 - protein, 401 aa, Triticum aestivum
MGKSKDKKASREAKVDKKLALGLGVKRKQLKKKKDRVLDAAVESEGAAGHAIAEDIGSKKIVLVKQKKKIKHAKVTSCCTKAHNLVTLNEDEATPKLKKKKSKKQLKESKSPVEVQSPLDSNDAGTLKLKKKKRKVKEGKSSVEPNDADDILHENLDEETLNADVNQLPAESEVMDIGEPEKAKKRKKNKTADVKQVAEESEVMDIGEPEKAKKRKKNKTKKVKQSGEVNRTDMQVSVREDNLEVHEVDTANVDEIASVDEDCSRGMKKWILEYRQKRPGLKVLQQNIDVFITAHEEQQEREKKEREAAAAEDGWTVVMHHKGRKKTTDAETGTAVGSVSLAAMQEKMAQKKPKEVGRNFYRHQKREAQMSELAMLQSKFEQDKKRIQQLRAQRKFKPYGF

SEQ ID NO: 5780 - protein, 349 aa, Triticum aestivum
MSPQGTNEVQSNQLNTMATDAPAGDPGSVAVANNDNRKVSREDIELVQNLIERCLQLYMTKGEVVRTLSTRARIEPGFTTLVWQKLEEENSEFFRAYYIRLKLKRQIVLFNHLLQHQYNLMKYPAPPNVPLAPMQNGMHPLPVNNLPMGYPVLQQPLMPAPGQPHIDPMVCGLSSGHVVNGIPAPGGYHPMRMNSGNDMVVDNGAPEVAHAGAMSSDMAVSPSSAASSHAPFTPSEIPGMAMDTSVLDSAFGSEIGNTGPLQLGADGSSRESIRSLGQLWNFSLSDLTADLTSLGDLEALENYAGTPFLPSDSDLLLDSPDHDDIGNHDDIVEYFADAINGSQSDEEKP

SEQ ID NO: 5781 - protein, 363 aa, Triticum aestivum
MKDSQDIQSTTELQMSPQGTNEVQSNQLNTMATDAPAGDPGSVAVANNDNRKVSREDIELVQNLIERCLQLYMTKGEVVRTLSTRARIEPGFTTLVWQKLEEENSEFFRAYYIRLKLKRQIVLFNHLLQHQYNLMKYPAPPNVPLAPMQNGMHPMPVNNLPMGYPVLQQPLMPAPGQPHIDPMVCGLSSGHVVNGIPAPGGYHPMRMNSGNDMVVDNGAPEAAHAGAMSSDMAVSPSSAASSHAPFTPSEIPGMAMDTSVLDSAFGSEIGNTGPLQLGADGSSRDSIRSLGQLWNFSLSDLTADLTSLGDLEALENYAGTPFLPSDSDLLLDSPDHDDIGNHDDIVEYFADAINGSQSDEEKP

SEQ ID NO: 5782 - protein, 363 aa, Secale cereale
MKDSQDIQSTTELQMSPQGTNEVQSNQLNTMATDAPAGDPGTVAVANNDNRKVSREDIELVQNLIERCLQLYMTKGEVVRTLSTRARIEPGFTTLVWQKLEEENSEFFRAYYIRLKLKRQIVLFNHLLQHQYNLMKYPAPPNVPLAPMQNGMHPMPVNNLPMGYPVLQQPLMPAPGQPHIDPMVCGLSSGHVVNGIPAPGGYHPMRMNSGNDMVVDNGAPEAAHAGAMSSDMAVSPSSAASSHAPFTPSEIPGMAMDTSVLDSAFGSEIGNTGPLQLGADGSSRDSIRSLGQLWNFSLSDLTADLTSLGDLEALENYAGTPFLPSDSDLLLDSPDHDDIGNHDDIVEYFADAINGSQSDEEKP

SEQ ID NO: 5783 - protein, 345 aa, Hordeum vulgare
MSPQGTNEVQSNQLNTMATDAPAGDPGSLAVAINDNRKVSREDIELVQNLIERCLQLYMTKGEVVRTLSTRARIEPGFTTLVWQKLEEENPEFFRAYYIRLKLKRQIILFNHLLQHQCNLMKYPAHPNVPLAPMQNGMHPMPVNNLPMGYPVLQQPLMPAPGQPHIDPMVCGLSSGHVVNGIPAPGGYQPIRMNSGNDMVVDNGAPEVAHTGAMSSEMAVSPSSAASTNHAPFTPSEIPGMAMDTSMLDSAFGSDIGNTEPLQLGPDGSSRDSIRSLGQLWNFSLSDLTADLTSLGDLEALENYEGTPFLPSDSDLLLDSPDHNDDIVEYFADAINGSQSDEEKS

SEQ ID NO: 5784 - protein, 357 aa, Triticum aestivum
MKDSQDIQSTTELQMSPQGTNEVQSNQLNTMATDAPAGDPGSVAVANNDNRKVSREDIELVQNLIERCLQLYMTKGEVVRTLSTRARIEPGFTTLVWQKLEEENSEFFRAYYIRLKLKRQIVLFNHLLQHQYNLMKYPAPPNVPLAPMQNGMHPMPVNNLPMGYPVLQQPLMPAPGQPHIDPMVCGLSSGHVVNGIPAPGGYHPMRMNSGNDMVVDNGAPEAAHAGAMSSDMAVSPSSAASSHAPFTPSEIPGMAMDTSVLDSAFGSEIGNTGPLQLGADGSSRDSIRSLGQLWNFSLSDLTADLTSLGDLEALENYAGTPFLPSDSDLLLDSPDHDDIVEYFADAINGSQSDEEKP

SEQ ID NO: 5785 - protein, 345 aa, Triticum aestivum
MSPQGTNEVQSNQLNTMATDAPAGDPGSLTVASNDNRKVSREDIELVQNLIERCLQLYMTKGEVVRTLSTRARIEPGFTTLVWQKLEEENPEFFRAYYIRLKLKRQIILFNHLLQHQCNLMKYPAHPNVPLAPMQNGMHPMPVNNLPMGYPVLQQPLMPAPGQPRIDPMVCGLSSGHVVNGIPAPGGYQPIRMNSGNDMVVDNGAPEVAHNGAMSSEMAVSPSSAASSNHAPFTPSEIPGMAMDTSMLDSAFGSDIGNTEPLQLGPDGSSRDSIRSLGQLWNFSLSDLTADLTSLGDLEALENYEGTPFLPSDSDLLLDSPDHNDDIVEYFADAINGTQSDEEKS

SEQ ID NO: 5786 - protein, 363 aa, Secale cereale
MKDSQDIQSTTELQMSPQGTNEVQSNQLNTMATDAPAGDPGSVAVANNDNRKVSREDIELVQNLIERCLQLYMTKGEVVRTLSTRARIEPGFTTLVWQKLEEENSEFFRAYYIRLKLKRQIVLFNHLLQHQYNLMKYPAPPNVPLAPMQNGMHPMPVNNLPMGYPVLQQPLMPAPGQPHIDPMVCGLSSGHVVNGIPAPGGYHPMRMNSGNDMVVDNGAPEAAHAGAMSSDMAVSPSSAASSHAPFTPSEIPGMAMDTSVLDSAFGSEIGNTGPLQLGADGSSRDSIRSLGQLWNFSLSDLTADLTSLGDLEALENYAGTPFCPRTRISYLTSPDHDDIGNHDDIVEYFADAINGSQSDEEKP

SEQ ID NO: 5787 - protein, 345 aa, Secale cereale
MSPQGTNEVQSNQLNTMATDAPTAYPGSLAVASNDNRKVSREDIELVQNLIERCLQLYMTKGEVVRTLSTRARIEPGFTTLVWQKLDEENPEFFRAYYIRLKLKRQIILFNHLLQHQCNLMKYPAHPNVPLAPMQNGMHPMPVNNLPMGYPVLQQPLMPTPGQPHIDPMVCGLSSGHVVNGIPAPGGYQPIRMNSGNDMVVDTGAPEVAHTGAMSSEMAVSPSSAASSNHAPFTPSEIPGMAMDTSMLDSAFGSEIGNGGPLQLGPDGSSRDSIRSLGQLWNFSLSDLTADLTSLGDLEALENYAGTPFLPSDSDLLLDSPDHDDDIVEYFADAINGSQSDEEKS

SEQ ID NO: 5788 - protein, 353 aa, Triticum aestivum
DIQSTTELQMSPQGTNEVQSNQLNTMATDAPAGDPGSLTVASNDNRKVSREDIELVQNLIERCLQLYMTKGEVVRTLSTRARIEPGFTTLVWQKLEEENPEFFRAYYIRLKLKRQIILFNHLLQHQCNLMKYPAHPNVPLAPMQNGMHPMPVNNLPMGYPVLQQPLMPAPGQPHIDPMVCGLSGGHVVNGIPAPGGYQPIRMNSGNDMVVDNGAPEVAHGAMSSEMAVSPSSAASSNHAPFTPSEIPGMAMDTSMLDSAFGSDIGNTEPLQLGPDGSSRDSIRSLGQLWNFSLSDLTADLTSLGDLEALENYEGTPFLPSDSDLLLDSPDHNDDIVEYFADAINGTQSDEEKS

SEQ ID NO: 5789 - protein, 332 aa, Avena sativa
NQLSTMATDAPVGDSGSLSVASNDNRKVSREDIELVQNLIERCLQLYMTKGEVVRTLSTRARIEPGFTTLVWQKLEEENSEFFRAYYIRLKLKRQIILFNHLLQHQYNLMKYPAPPNVPMAPMQNGMHPMPVNNLPMGYPVLQQPLMPAPGQPHLDPMVYGMSSGHAVNGIPAPGGYHPIRMNSGNDMLVDNSAPEAAHAGAMSSEMAMSPSSAASSNHVPFTPSEIPGMAMDTSVLDSAFGSDIGNTGPLQLGADGSSRDSIRSLGQLWNFSLSDLTADLTSLGDLEALENYAGTPFLPSDSDLLLDSPDHDDIVEYFADAINGSQSDEEK

SEQ ID NO: 5790 - protein, 357 aa, Brachypodium distachyon
MKDSQDIQSTTELQMSPQGTNEVQSNQANTVGTDAPVGDSGSLSVASNDNRKVSREDIELVQNLIERCLQLYMTKGEVVRTLSTRARIEPGFTTLVWQKLEEENSEFFRAYYIRLKLKKQIILFNHLLQHQYNLMKYPAPPNPLVPMQNGIHSMPVNNLPMGYPVLQQPLMPAPGQPHIDAMVCGLSSGHVVNGIPAPGGYHPIRMNSGNDMVVDNGAPEAAHPGAMSSEMAVSPSSAASSNHAPFTPSDIPGMAMDTSALDSAFGSDVGNTGPLQLGPDGSSRDSIRSLGQLWNFSLSDLTADLTSLGDLEALENYAGTPFLPSDSDLLLDSPDHDDIVEYFADAINGTQSDEDKS

SEQ ID NO: 5791 - protein, 340 aa, Saccharum officinarum
MKDSQDIQSTTGLQSSAQGTNEVQSQQPNPMATDAPAGNLGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPAPPNIPLAPIQNGIHHMPVSNLPMGYPVLQQPIMPAPGQPHMDPMACGLSSGHVVNGIPAGGYHPMRMNSGNDMVVDNGAPEAPHAGATGSAMSSEMVVSPSSAASSNHAPFTPSEIPGMTMDVSALDSAFGSDVGNPGCLQLGPDGSSRDSNRSFGQLWNFSLSDLTADLTSLGADLDVLENYTGTPFCLQIRTFCLIPRP

SEQ ID NO: 5792 - protein, 362 aa, Oryza sativa
MKDSQDIQSPTELQSSAQGTNEVQSNQPNPMATDGPGGDSGSLSIASNDNRKVSREDIELVQNLIERCLQLYMNKGEVVRTLSTRARIEPGFTTLVWQKLEEENSEFFRAYYIRLKLKRQIILFNHLLQHQYNLMKYPAPPNVPLAPMQNGMHPMPVNNLPMGYPVLQQPMMPAPGQPHIDSMACGLSSGHVVNGIPAAGGYHPIRMNSGNDMVVDNGAPETAHVGATCSAMSSEMAVSPSSAASSNHAPFTPSEIPGITMDTSALDSTFVSDVENTGQLQLGPDGSSRDSIRSLGQLWNFSLSDLTADLTSLGDLEALENYAGTPFLASDSDILLDSPDQNDIVEYFADAINGPSQSDEEK

SEQ ID NO: 5793 - protein, 332 aa, Setaria italica
MATDAPAGDSGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPAPPSVPLAPIQNGIHHMPVSNLPMGYPVLQQPMMPAPGQPHIDPMACGLSSGHVVNGIPAPGGYHPIRMNSGNDMAVDNGVAEAPHAGVTGSAMSSEMAVSPSSVASSNHAPFTPSEIPGMNMDVSALDSTFGSDVGNAGPLQLGPDGSSRDSIKSLGQLWNFSLSDLTADLTSLGDLEALENYAGTPFLPLDSDILLDSPDQDDIVEYFADAINGSQSDEEKP

SEQ ID NO: 5794 - protein, 343 aa, Setaria italica
GTNEVQSQQPNPMATDSPAGDSGSLSVASNDNKVSREDIELVQNLIERCLQMYMNKGEVVRTLSTRARIEPGFTTLVWQKLEEENSEFFRAYYTRLKLKRQIILFNHLLQHQYNLMKYSSPPNVPLAPIQNGTHHVPVSNLPMGYPVLQQPIMPAPGQPHMDPMACGLSSDHVVNGIPAPGGYHPIRMDSGNDMVVDNGVPETPHAGATGSAMSSEMAVSPSSVASSNHAPFTPSEIPGMSMDVSTLDSTFGSDVGNPGLLQLGPDGSSRDSIRSFGQLWNFSLSDLTTDLTSLGDLEALENYAGTPFLPSDSDILLDSPDQDDIVEYFTDAINGSQSDEEKP

SEQ ID NO: 5795 - protein, 362 aa, Panicum virgatum
MKDAQDIQSTTELQSSAQGTNEVQSQQPNAMATDAPAGDSGSLSVRSNDNKKVSREDIELVQNLIERCLQLYMNKGEVVRTLSTRARIEPGFTTLVWQKLEEENSEFFRAYYIRLKLKRQIILFNHLLQHQYNLMKYPVPTNVPLAPMQNGIHHMPVSNLPMGYPVLQQPIMPAPGQPHIDPMACGMSSGHIVNGIPAPGGYHPIRMNSGNDMVVDNGVTEAPHAGASGSAMSSEMAVSPSSAASSNHAPFTPSEIPGMTMDVSALDSTFGSDVGNAGPLQLGPDGSSRDSIRSLGQIWNFSLSDLTADLTSLGDLEALENYTGTPFLHSDSDILLDSPDQDDIVEYFADAINGSQSDEEKP

SEQ ID NO: 5796 - protein, 362 aa, Pennisetum glaucum
MKDSQDIQSTTELHSSKQGTNEVQSQQPNPMATDAPAGDSGSLSVASNDNKKVSREDIELVQNLIERCLQLYMNKGEVVRTLSTRARIEPGFTTLVWQKLEEENSEFFRAYYIRLKLKKQIILFNHLLQHQYNLMKYPAPPSVPLAPMQNGIHHMPVSNLPMGYPVIQQPMMHAPGQPHIDPMACGLSSGHVVNGIPAPGGYHPIRMNSGNDMAVDNGVSEAPHAGAAGSAMSSEMAVSPSSAASSNHAPFTPSEIPGMNMDVSALDSAFGSDVGNAGSLQLGPDGSSRDSIKSLGQLWNFSLSDLTADLTSLGDLEALENYAGTPFLPLDSDILLDSPDQDDIVEYFADAINGSPSDEEKP

SEQ ID NO: 5797 - protein, 363 aa, Panicum virgatum
MKDAQDIQSTTELQSSAQGINEVQSQQPNAMATDAPAGDSGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPVPSSVPLAPMQNGIHHMPVGNLPMGYPVLQQPIMPAPGQPHIDPMACGMSSGHVVNGIPAPGGYHPIRMNSGNDMVVDNGVTEAPHAGATGSAMSSEMAVSPSSAASSNHAPFTPSEIPGMTMDVSALDSTFGSDVGNAGPLQLGPDGSSRDSIRSLGQIWNFSLSDLTADLMSLGDLEALENYTGTPFLHSDSDILLDSPDQDDIVEYFADAINGSQSDEEKPQ

SEQ ID NO: 5798 - protein, 363 aa, Zea mays
MKDSQDIQSTTELQSPVQGTNEVQSQQPNSMAADAPAGNSGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPAPPNIPLAPIQNGIHHMPVSNLPMGYPVLQQPIMPAPGQPHMDPMACGLSSGHVVNGIPAPGGYHPMRMNSGNDMVLDNGAPEAPHAGATGSAMSSEMAVSPSSAASSNHAPFTPSDIPGMTMDVSALDSAFGCDVGNPESLQLGPDGSSRDSIRSLGQLWNFSLSDLTADLTSLGADLDVLENYTGTPFLPSDSDILLDSPDQDDIVEYFADAINGSPSDEEKP

SEQ ID NO: 5799 - protein, 362 aa, Sorghum bicolor
MKDSQDIQSTTELQSSAQGTNEVQSQQPNPMATDAPAGNSGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPAPPNIPLAPIQNGIHHMPVSNLPMGYPVLQQPIMPAPGQPHMDPMACGLSSGHVVNGIPAGGYHPMRMNSGNDMVVDNGAPEAPHAAATGSAMSSEMAVSPSSAASSNHAPFTPSEIPGMTMDVSALDSAFGSDVGNPGSLQLGPDGSSRDSIRSLGQLWNFSLSDLTADLTSLGADLDVLENYTGTPFLPSDSDILLDSPDQDDIVEYFADAINGSPSDEEKS

SEQ ID NO: 5800 - protein, 363 aa, Panicum virgatum
MKDAQDIQSTTELQSSAQGINEVQSQQPNAMATDAPAGDSGSLSVTSNDNKKVSREDIELVQNLIERCLQLYMNKGEVVRTLSTRARIEPGFTTLVWQKLEEENSEFFRAYYIRLKLKRQIILFNHLLQHQYNLMKYPVPSSVPLAPMQNGIHHMPVGNLPMGYPVLQQPIMPAPGQPHIDPMACGMSSGHVVNGIPAPGGYHPIRMNSGNDMVVDNGVTEAPHAGATGSAMSSEMAVSPSSAASSNHAPFTPSEIPGMTMDVSALDSTFGSDVGNAGPLQLGPDGSSRDSIRSLGQIWNFSLSDLTADLMSLGDLEALENYTGTPFLHSDSDILLDSPDQDDIVEYFADAINGSQSDEEKPQ

SEQ ID NO: 5801 - protein, 361 aa, Zea mays
MKDSQDIQSTTELQSSAQGTNEVQSQQPNPMTTDAPAGNSGSLSIASNDSKKVSREDIELVQNLIERCLQLYMNKGEVVRTLSTRARIEPGFTTLVWQKLEEENSEFFRAYYIRLKLKRQIILFNHLLQHQYNLMKYPAPPNVPLAPIQNGIHHMPVSNLPMGYPVLPQPIMPAPGQPHMDPMACGLSNGHVVNGIPAPGGYHPMRMNSGNDMVVDNGAPEAPHAGATGSVMSSEMAVSPSSAASSNHAPFMPPEIPGMAMDVPGLDSTFGSDVGNGPLQLGPDGSSRDSIRSLGQLWNFSLSDLTADLTSLGDLDVLENYTGTPFLPSDSDILLDSPDQDDIVEYFADAINGSQSDEERS

SEQ ID NO: 5802 - protein, 1369 aa, Triticum aestivum
MAGKSKGARNKAKAQAASQEAVSVEPVADVAEEAKPQNGEVTEAPAAEVAPAAEVAAADVEKEEGDVAEAAQAAEKPAEGELHLYPVSVKTQSGEKLELQLSPGDSVIDVKQFLLDAPETCFYTCYDLILHTKDGSTHQLEDYNEISEIADITAGGCSLEMVAATYDERSIRSHLRRVRELLSLSSLHVSLSTSLALQQESAQAKNADAGKTAHQELDGLNFMEDTTVALTNLLASAPAEIKCVDSIVFSSFNPPPSYRRLHGDLIYIDVVTLEGSKHCITGSSKSFYVNASNGSVLDSRPLKQSHEASTLVGLLQKISAKFKKGFREILDRKASAHPFENVQALLPVTSWLGAHPVPEHRRDAARAEDSVVLSYGTELIGMQRDWNEELQSCREFPHANPQERILRGRALYKVTCDFVDAAVKGAVGVINRCIPPINPTDPECFHMYVHNNIFFSFAVDSDYEQISKDQKPDCQNGSSRSTPVPSPGLGAKADSGVAPDSKTEEANSVLEGPTEAQIADSEQATYASANNDLKGTKSYQEADISGLYNLAMAIIDYRGHRVVAQSIIPGILQGDKSDSLLYGSVDNGKKISWNESFHAKVVEAAKRLHVKEHVVLDGSGNPVKLAATVECKGIVGSDDRHYILDLMRVTPRDSNYIGLQHRFCVLRPELVASFVEAESIKKSPTQKVPDVPTELNGQESDDIASGSDATAASVEEHDKSDETPVSTPAESNDSTAEILFNPNVFTEYKLAGSPEEIEADEALVKKVGSYLLDTVIPKFVQDLCSLDVSPMDGQTLTDVLHSNGINVRYLGKVAGLIKHLPHLWDLFSAEIIVRSAKHVVKDILRQSPDHNIAPAVAHFLNCFFGKVLAASTKGSTGSPQSKTQKKSSQSASSKKGQSAFSQLTSDGVWSDIKEFAKHKYQFEAPDDVRVGAKRVAVLRNLCQKVGITIAARKYDLHSTTPFQPSDILNLQPVVKHSVPTCTDARKLMEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSDDSRTKDSENWLNTFKGREQQVIAQKQKGQGTVPSANAVEFLKAHPGLFQAMKAAAIQSGGDGPANVNRVRGGDERAAKAAAEARKTAVARGVNLRNGPAASVSDINQILNLINSAASASAASSGNAQATESEVPQSNGPALNGAKEAKDTSRPSAKADGQAPVGLGASLELKKQKSKQKA

SEQ ID NO: 5803 - protein, 903 aa, Triticum aestivum
MAGKSKGARNKAKAQAASQEAVSVEPVADVVEEAKPENGEVTEAPAAEVAPAAEVAAADVEKEEGDVAEAAQAAEKPAEGELHLYPVSVKTQSGEKLELQLSPGDSVIDVKQFLLDAPETCFYTCYDLILHTKDGSTHQLEDYNEISEIADITAGGCSLEMVAATYDERSIRSHLRRVRELLSLSSLHVSLSTSLALQQESAQAKNADAGKTAHQELDGLNFMEDTTVALTNLLASAPAEIKCVDSIVFSSFNPPPSYRRLHGDLIYIDVVTLEGSKHCITGSSKSFYVNASNGSVLDSRPLKQSHEASTLVGLLQKISAKFKKGFREILDRKASAHPFENVQALLPVTSWLGAHPVPEHRRDAARAEDSVVLSYGTELIGMQRDWNEELQSCREFPHANPQERILRGRALYKVTCDFVDAAVKGAVGVINRCIPPINPTDPECFHMYVHNNIFFSFAVDSDYEQISKDQKPDCQNGSGRSTPVPSPALGAKADSGVAPDSKTEESNSVLEGPTEAQIADSEQATYASANNDLKGTKSYQEADISGLYNLAMAIIDYRGHRVVAQSIIPGILQGDKSDSLLYGSVDNGKKISWNESFHAKVVEAAKRLHVKEHVVLDGSGNPVKLAATVECKGIVGSDDRHYILDLMRVTPRDSNYIGLQHRFCVLRPELVASFVEAESIKKSPTQKVPDVPTESNGQEESDDIASASDATAVSAEEHDKSDESPASTPAESNDSTAEILFNPNVFTEYKLAGSPEEIEADEALVKKVGSYLLDTVIPKFVQDLCSLDVSPMDGQTLTDVLHSNGINVRYLGKVAGMIKHLPHLWDLFSAEIIVRSAKHVVKDILRQSPDHNIAPAVAHFLNCFLAKFWLLQQKVVLAARSLKPRRNQVNQFLQKRVNLHIPS

SEQ ID NO: 5804 - protein, 1369 aa, Secale cereale
MAGKSKGARNKAKAQAASQEAVSVEPAVPVPDVVEEAKPENGEVIEAPAAEVAAADVEKEEGDAAEAAQAAEKPAEGELHLYPVSVKTQSGEKLELQLSPGDSVIDVKQFLLDAPETCFYTCYDLILHTKDGSTHQLEDYNEISEIADITAGGCSLEMVAATYDERSIRSHLRRVRELLSLSSLHVSLSTSLALQQESAQAKNADAGKTAHQELDGLNFMEDTTVALTNLLASAPAEIKCVDSIVFSSFNPPPSYRRLHGDLIYIDVVTLEGSKHCITGSSKSFYVNASNGSVLDSRPLKQSHEASTLVGLLQKISAKFKKGFREILDRKASAHPFENVQALLPVTSWLGSHPVPEHRRDAARAEDSVVLSYGTELIGMQRDWNEELQSCREFPHANPQERILRGRALYKVTCDFVDAAVKGAVGVINRCIPPINPTDPECFHMYVHNNIFFSFAVDSDYEQISKDQKPDCQNGSGRSTPVPSPGLGAKADSGVEPDSKIEEPNSVLEGPTEAQIADSEQATYASANNDLKGTKSYQEADISGLYNLAMAIIDYRGHRVVAQSIIPGILQGDKSDSLLYGSVDNGKKISWNESFHAKVVEAAKRLHVKEHEVLDGSGNPVKLAATVECKGIVGSDDRHYILDLMRVTPRDSNYIGLQHRFCVLRPELVASFVEAESIKKSPTQKVPDVPTESNGQESDDLASASDATAASVDEHDKSDESPASTPAESNDSTAEILFNPNVFTEYKLAGSPEEIEADEALVKKVGSYLLDTVIPKFVQDLCSLDVSPMDGQTLTDVLHSNGINVRYLGKVAGMIKHLPHLWDLFSAEIIVRSAKHVVKDILRQSPDHNIAPAVAHFLNCFFGKVLAASTKGSTGSPQSKTQKGQKSSQSASSRKGQSAYSQLTSDGVWSDIKEFAKHKYQFEAPDDARVGAKRVAVLRNLCQKVGITIAARKYDLHSTTPFQPSDILNLQPVVKHSVPTCTDARKLMEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSEDSRTKDSENWLNTFKGREQQVIAQKQKGQGTAAPSTNAVEFLKAHPGLFQAMKAAAIQSGGDGPATVSRGRGSDERAAKAAAEARKTAVARGVNLRNGPTASVSDINQILNLINTAASASAASSGNAQATESEAPQSNGPALNGAKEAKDTSRPSAKADGQAPVGLGASLELKKQKSKQKA

SEQ ID NO: 5805 - protein, 1370 aa, Triticum aestivum
MAGKSKGARNKAKAQAASQEAVSVDPVADVVEEAKPENGEVTEAPAAEVAPAAETAAVVVEKEEGDAAEAAQAAEKPAEGELHLYPVSVKTQSGEKLELQLSPGDSVIDVKQFLLDAPETCFYTCYDLILHTKDGSTHQLEDYNEISEIADITAGGCSLEMVAATYDERSIRSHLRRVRELLSLSSLHVSLSTSLALQQESAQAKNADAGKTAHQELDGLNFMEDTTVALTNLLASAPAEIKCVDSIVFSSFNPPPSYRRLHGDLIYIDVVTLEGSKHCITGSSKSFYVNASNGSVLDSRPLKQSHEASTLVGLLQKISAKFKKGFREILDRKASAHPFENVQALLPVTSWLGAHPVPEHRRDAARAEDSVVLSYGTELIGMQRDWNEELQSCREFPHANPQERILRGRALYKVTCDFVDAAVKGAVGVINRCIPPINPTDPECFHMYVHNNIFFSFAVDSDYEQISKDQKPDCQNGSSRSTPVPSPGLGAKADSGVAPDSKTEEANSVLEGPTEAQIADSEQATYASANNDLKGTKSYQEADISGLYNLAMAIIDYRGHRVVAQSIIPGILQGDKSDSLLYGSVDNGKKISWNESFHAKVVEAAKRLHVKEHVVLDGSGNPVKLAATVECKGIVGSDDRHYILDLMRVTPRDSNYIGLQHRFCVLRPELVASFVEAESIKKSPTEKVPDVPTESNGQEESDDIASGSDATAASVEEHDKSDESPASTPAESNDSTAEILFNPNVFTEYKLAGSPEEIEADEALVKKVGSYLLDTVIPKFVQDLCSLDVSPMDGQTLTDVLHSNGINVRYLGKVAGMIKHLPHLWDLFSAEIIVRSAKHVVKDILRQSPDHNIAPAVAHFLNCFFGKVLAASSKGSTGSPQSKTQKKSSESASSKKGQSAFSQLTSDGVWSDIKEFAKHKYQFEAPDDVRVGTKRVAVLRNLCQKVGITIAARKYDLHSTTPFQPSDILNLQPVVKHSVPTCTDARKLMEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSDDSRTKDSENWLNTFKGREQQVIAQKQKGQGTVPSANAVEFLKAHPGLFQAMKAAAIQSGGDGPANVNRGRGGDERAAKAAAEARKTAVARGVNLRNGPAASVSDINQILNLINSAASASAASSGNAQATESEVPQSNGPALNGAKESKDTSRPSAKADGQAPVGLGASLELKKQKSKQKA

SEQ ID NO: 5806 - protein, 988 aa, Triticum aestivum
MQRDWNEELQSCREFPHANPQERILRGRALYKVTCDFVDAAVKGAVGVINRCIPPINPTDPECFHMYVHNNIFFSFAVDSDYEQISKDQKPDCQNGSSRSTPVPSPGLGAKADSGVAPDSKTEEANSVLEGPTEAQIADSEQATYASANNDLKGTKSYQEADISGLYNLAMAIIDYRGHRVVAQSIIPGILQGDKSDSLLYGSVDNGKKISWNESFHAKVVEAAKRLHVKEHVVLDGSGNPVKLAATVECKGIVGSDDRHYILDLMRVTPRDSNYIGLQHRFCVLRPELVASFVEAESIKKSPTQKVPDVPTELNGQESDDIASGSDATAASVEEHDKSDETPVSTPAESNDSTAEILFNPNVFTEYKLAGSPEEIEADEALVKKVGSYLLDTVIPKFVQDLCSLDVSPMDGQTLTDVLHSNGINVRYLGKVAGLIKHLPHLWDLFSAEIIVRSAKHVVKDILRQSPDHNIAPAVAHFLNCFFGKVLAASTKGSTGSPQSKTQKKSSQSASSKKGQSAFSQLTSDGVWSDIKEFAKHKYQFEAPDDVRVGAKRVAVLRNLCQKVGITIAARKYDLHSTTPFQPSDILNLQPVVKHSVPTCTDARKLMEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSDDSRTKDSENWLNTFKGREQQVIAQKQKGQGTVPSANAVEFLKAHPGLFQAMKAAAIQSGGDGPANVNRVRGGDERAAKAAAEARKTAVARGVNLRNGPAASVSDINQILNLINSAASASAASSGNAQATESEVPQSNGPALNGAKEAKDTSRPSAKADGQAPVGLGASLELKKQKSKQKA

SEQ ID NO: 5807 - protein, 1383 aa, Brachypodium distachyon
MAGKSKGGRNKAKAQAASQAVPVEPVVPVTDGVQEDKPENGVVSEAPAAEVGAVDVEKEEGDAASVAQPAEKPAEGELHLYPVSVKTQSGEKLELQLSPGDSVIDVKQFLLDAPETCFYTCYDLILHTKDGSAHQLEDYNEISEIADITAGGCSLEMVAATYDERSIRSHLRRVRELLSLSSLHVSLSTSLALQQESTQGKNAADAGKTANQELDGLNYMEDTTVALTNLLASAPAEIKCVDSIVFSSFNPPPSYRRLHGDLIYIDVVTLEGNAYCITGSSKSFYVNASSENILDSRPLKQSHEASTLVGLLQKVSAKFKKGFREILDRKASAHPFENVQALLPVTSWLGAYPVSEHKRDAARAEDSVVLSYGTELIGMQRDWNEELQSCREFPHGNPQERILRGRALYKVTCDFVDAAVKGAVGVINRCIPPINPTDPECFHMYVHNNIFFSFAVDSDYEQISKDHKLDCQNGSSRSTLVTSPDLGAKADRKHTDSSVAPNSKTEEPNGVLDNNPDASAEAQIADSEQATYASANNDLKGTKSYQEADVPGLYNLAMAIIDYRGHRVVAQSIIPGILQGDKSDSLLYGSVDNGKKISWNEAFHAKVVEAAKRLHVKEHVVLDGSGNPVKLAATVECKGIVGSDDRHYILDLMRVTPRDSNFIGLQHRFCVLRPELVASFVEAESIKQPPAEKVPDVPAESNGQDATATIVEGHDKSDESSAPRPAENTDSAAEILFNPNVFTEYKLAGSPEEIAADEALVKKVGSYLLETVIPKFVQDLCSLDVSPMDGQTLTDVLHSNGINVRYLGKVAGMIKQLPHLWDLFSAEIIVRSAKHVVKDILRQSPDHNIGPAVAHFLNCFIGKVLAASTKGSAAQSKSQKGHETQKSTKGQKSGHSASSRKGQSAYSHLTSDGIWSDIKEFAKHKYQFEVPDDARVGAKRVAVLRNLCQKVGITIAARKYDLNAAAPFQPSDILNLQPVVKHSVPTCTDARKLMEAGKIRMAEGTLNEAYALFNEAFSLLQQINGPMHKDAANCCRYLAMVLYHAGDTAGAIVQQHRELVINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSIQHETKTHDILVKQLGNDDSRTKDSENWLNTFKGREQQVNAQKQKGRGTNPSDSAIDFIKAHPGLYQAMKAIQSGDGSANINKSHNAAVVGEGLPRGRGVDERGAKATAEARKKAAARGVTLRNVPPANSVSELNQILSLINSAATSATTNTQTTESEGKQSNGPALNGTKETKETNGPPAKADGHTPVGLGASLELKKQKSKQKA

SEQ ID NO: 5808 - protein, 712 aa, Triticum aestivum
MEESFVPLRGIKNDVRGRLTCYKQDWTGGFSAGIRILAPTTYIFFASAIPVISFGEQLERSTDGVLTAVQTLASTALCGIIHSIVGGQPLLILGVAEPTVIMYTFMFSFAKDRADLGPNLFLAWAGWVCVWTALLLFLLAVLGACSIINRFTRIAGELFGLLIAMLFMQQAIKGLVDEFRIPERENIKALQFVPSWRFANGMFAIVLSFGLLLTALRSRKARSWRYGAGWLRGFIADYGVPLMVLVWTGVSYIPHDSVPKGIPRRLFSPNPWSPGAYDNWTVIKDMPQVPVMYIIGAFMPATMIAVLYYFDHSVASQLAQQAEFNLRKPPSFHYDLLLLGFLTLMCGLIGIPPSNGVIPQSPMHTKSLATLKHQILRNRLVATARQSMRQNASLSQLYNNMQDAYHQIQTPLIHQQQTVKGLNELKDSTVQLASSMGNFDAPVDETIFDIEKEIDDLLPMEVKEQRLSNFLQAVMVGGCVAAMPLLKKIPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLAAQDIDVALGRTQSAEILDDMVTRSRGEIKRLNSPKITSSGGTPVTELKGIRSPCMSEKAYSPRVNELRHERSPLGGRDSPRMGEARPSKLGEGSTPK

SEQ ID NO: 5809 - protein, 712 aa, Triticum aestivum
MEESFVPLRGIKNDVRGRLACYKQDWTGGFSAGIRILAPTTYIFFASAIPVISFGEQLERSTDGVLTAVQTLASTALCGIIHSIVGGQPLLILGVAEPTVIMYTFMFSFAKDRADLGPNLFLAWAGWVCVWTALLLFLLAVLGACSIINRFTRIAGELFGLLIAMLFMQQAIKGLVDEFGVPERENIKALQFVPSWRFANGMFAIVLSFGLLLTALRSRKARSWRYGAGWLRGFIADYGVPLMVLVWTGVSYIPHDSVPKGIPRRLFSPNPWSPGAYDNWTVIKDMLQVPVMYIIGAFMPATMIAVLYYFDHSVASQLAQQAEFNLRKPPSFHYDLLLLGFLTLMCGLIGIPPSNGVIPQSPMHTKSLATLKHQILRNRLVATARQSMRQNASLSQLYNNMQDAYHQIQTPLIHQQQSVKGLNELKDSTVQLASSMGNFDAPVDETIFDIEKEIDDLLPMEVKEQRLSNFLQAVMVGGCVAAMPLLKKIPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLAAQDIDVALGRTQSAEILDDMVTRSRGEIKRLNSPKITSSGGTPVTELKGIRSPCISEKAYSPRVAELRHERSPLGGRDSPRTGEARPSKLGEGSTPK

SEQ ID NO: 5810 - protein, 712 aa, Triticum aestivum
MEESFVPLRGIKNDVRGRLACYKQDWTGGFSAGIRILAPTTYIFFASAIPVISFGEQLERSTDGVLTAVQTLASTALCGIIHSIVGGQPLLILGVAEPTVIMYTFMFSFAKDRADLGPNLFLAWAGWVCVWTALLLFLLAVLGACSIINRFTRIAGELFGLLIAMLFMQQAIKGLVDEFRIPERENIKALQYIPSWRFANGMFAIVLSFGLLLTALRSRKARSWRYGAGWLRGFIADYGVPLMVLVWTGVSYIPHDSVPKGIPRRLFSPNPWSPGAYDNWTVIKDMAQVPVMYIIGAFMPATMIAVLYYFDHSVASQLAQQAEFNLRKPPSFHYDLLLLGFLTLMCGLIGIPPSNGVIPQSPMHTKSLATLKHQILRNRLVATARQSMRQNASLSQLYNNMQDAYHQIQTPLIHQQQSVKGLNELKDSTVQLASSMGNFDAPVDETIFDIEKEIDDLLPMEVKEQRLSNFLQAVMVGGCVAAMPLLKKIPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLAAQDIDVALGRTQSAEILDDMVTRSRGEIKRLNSPKITSSGGTPVTELKGIRSPCISEKAYSPRVTELRHERSPLGGRDSPRTGEARTSKLGEGSTPK

SEQ ID NO: 5811 - protein, 712 aa, Secale cereale
MEESFVPLRGIKNDIRGRLACYKQDWTGGFSAGIRILAPTTYIFFASAIPVISFGEQLERSTDGVLTAVQTLASTALCGIIHSIVGGQPLLILGVAEPTVIMYTFMFSFAKDRPDLGPNLFLAWAGWVCVWTALLLFLLAVLGACSIINRFTRIAGELFGLLIAMLFMQQAIKGLVDEFRIPERENIKALQFVPSWRFANGMFAIVLSFGLLLTALRSRKARSWRYGAGWLRGFIADYGVPLMVLVWTGVSYIPHDSVPKGIPRRLFSPNPWSPGAYDNWTVIKDMLQVPPMYIIGAFMPATMIAVLYYFDHSVASQLAQQAEFNLRKPPSFHYDLLLLGFLTLMCGLIGIPPSNGVIPQSPMHTKSLATLKHQILRNRLVATARQSMRQNASLSQLYNNMQDAYHQIQTPLIHQQQSMKGLNELKDSTVQLASSMGNFDAPVDETIFDIEKEIDDLLPMEVKEQRLSNFLQAVMVGGCVAAMPLLKRIPTAVLWGYFAFMAIESLPGNQFWERILLLFTAPSRRYKVLEEYHTTFVETVPFKTIAMFTLFQTTYLLVCFGITWIPIAGVLFPLMIMFLVPVRQYILPKLFKGAHLNDLDAAEYEESPAIPFNLAAQDIDVALGRTQGAEILDDMVTRSRGEIKRLNSPKITSSGGTPVTELKGIRSPCISEKAYSPRVTELRHERSPLGGRDSPRTGEARPSKLGEGSTPK

SEQ ID NO: 5812 - protein, 176 aa, Triticum aestivum
MEESFVPLRGIKNDVRGRLACYKQDWTGGFSAGIRILAPTTYIFFASAIPVISFGEQLERSTDGVLTAVQTLASTALCGIIHSIVGGQPLLILGVAEPTVIMYTFMFSFAKDRADLGPNLFLAWAGWVVRVDCPLAVLAGGTGRVLHHKPVHPHSRRAVRAAHRHALHAAGYQGTC

SEQ ID NO: 5813 - protein, 709 aa, Setaria italica
MEESFVPLRGIKNDLQGRLACYKQDWTGGFRAGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENRKALEFVPSWCFANGMFAIVLSFGLLLTALRSRKARSWRYGAGWLRGFIADYGVPLMVLVWTGVSYIPYGSVPKGIPRRLFSPNPWSPGAYDNWTVVKDMTHVPLLYIIGAFIPATMIAVLYYFDHSVASQLAQQKEFNLRKPPSFHYDLLLLGFLTLLCGLIGIPPSNGVIPQSPMHTKSLATLKHQLLRNRLVATARKSMSQNASLSQLYGSMQDAYQQMQTPLVYQQQSVRRGLNELKDSTVQLASSMGNIDAPVDETIFDIEKEIDDLLPMEVKEQRLSNLLQAAMVGGCVAAMPLLKKIPTSVLWGYFAFMAIESLPGNQFWERILLLFTAPSRRYKVLEEYHTTFVETVPFKTIAMFTLFQTAYLLVCFGITWIPIAGVLFPLMIMLLVPVRQYILPKLFKGAHLTDLDAAEYEESPAIPFSLAAQDIDVALGRAQSAEILDDMFTRSRGEIKRLNSPKITSSGGTPVAELKNIRSPSISEKAYSPRLTELRHERSPLGGRSSPRTPSKLGEGSTPK

SEQ ID NO: 5814 - protein, 711 aa, Oryza sativa
MEESFVPLRGIKNDLHGRLQCYKQDWTGGFRAGIRILAPTTYIFFASAIPVISFGEQLERNTDGVLTAVQTLASTALCGIIHSFLGGQPLLILGVAEPTVLMYTFMFNFAKDRPDLGRRLFLAWTGWVCVWTAILLFLLAILGACSIINRFTRIAGELFGLLIAMLFMQQAIKGLVDEFRIPERENRKALEFVSSWRFANGMFAIVLSFGLLLTALRSRKARSWRYGTGWLRGFIADYGVPLMVLVWTGVSYIPYGSVPKGIPRRLFSPNPWSPGAYDNWTVIRDMPNVPLLYIIGAFIPATMIAVLYYFDHSVASQLAQQKEFNLRKPPSFHYDLLLLGFLTLLCGLIGIPPANGVIPQSPMHTKSLATLKHQLLRNRLVATARQSMSQNASLSQLYGSMQEAYQQMQTPLIYQQPSVKGLNELKDSTVQMASSMGNIDAPVDETVFDIEKEIDDLLPIEVKEQRLSNLLQATMVGGCVAAMPLLKKIPTSVLWGYFAFMAIESLPGNQFWERILLLFTAPSRRYKVLEEYHTTFVETVPFKTIAMFTLFQTMYLLVCFGITWIPIAGVLFPLMIMLLVPVRQYILPKLFKGAHLTDLDAAEYEESPAIPFIAAQDIDVALARTQSAEILDDIVTRSRGEIKRLNSPKITSSGGTPVAELKGIRSPCISERAYSPCITELRHDRSPLGGRGSPRTGETRSSKLGEGSTPK

SEQ ID NO: 5815 - protein, 467 aa, Panicum virgatum
MEESFVPLRGIKNDLHGRLACYKQDWTGGFRTGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENRKALEFVPSWRFANGMFAIVLSFGLLLTALRSRKARSWRYGAGWLRGFIADYGVPLMVLVWTGVSYIPYGSVPKGIPRRLFSPNPWSPGAYDNWTVIKDMAHVPLLYIIGAFIPATMIAVLYYFDHSVASQLAQQKEFNLRKPPSFHYDLLLLGFLTLLCGLIGIPPSNGVIPQSPMHTKSLATLKHQLLRNRLVATARKSMSQNASLSQLYSSMQDAYQQMQTPLVYQQPSVRRGLNELKDSTVQLASSMGNIDAPVDETVFDIEKEIDDLCPSKSRSSA

SEQ ID NO: 5816 - protein, 161 aa, Panicum virgatum
MEESFVPLRGIKNDLHGRLACYKQDWTGGFRTGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAASCLGF

SEQ ID NO: 5817 - protein, 709 aa, Panicum virgatum
MEESFVPLRGIKNDLHGRLACYKQDWTGGFRAGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENRKALEFVPSWRFANGMFAIVLSFGLLLTALRSRKARSWRYGAGWLRGFIADYGVPLMVLVWTGVSYIPYGSVPKGIPRRLFSPNPWSPGAYDNWTVIKDMAHVPLLYIIGAFIPATMIAVLYYFDHSVASQLAQQKEFNLRKPPSFHYDLLLLGFLTLLCGLIGIPPANGVIPQSPMHTKSLATLKHQLLRNRLVATARKSMGQNASLSQLYGSMQDAYQQMQTPLVYQQPSVRRGLNELKDSTVQLASSMGNIDAPVDETVFDIAKEIDDLLPIEVKEQRLSNLLQAAMVGACVAAMPLLKKIPTSVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLTDLDAAEYEESPAIPFSLAAQDIDVALGRAQSAEILDDMVTRSRGEIKRLNSPKITSSGGTPVAELKNIRSPSISEKAYSPRLTELRHERSPLGGRNSPRMPSKLGEGSTPK

SEQ ID NO: 5818 - protein, 709 aa, Pennisetum glaucum
MEESFVPLRGIKNDLHGRLACYKQDWTGGFRAGIRILAPTTYIFFASAIPVISFGEQLERNTDGVLTAVQTLASTALCGIIHSIVGGQPLLILGVAEPTVLMYTFMFNFAKDRPDLGRNMFLAWTGWVCVWTAILLFLLAILGACSIINRFTRIAGELFGLLIAMLFMQQAIKGLVDEFRIPERENRKALEFIPSWRFANGMFAIVLSFGLLLTALRSRKARSWRYGAGWLRGFIADYGVPLMVLVWTGVSYIPYESVPKGIPRRLFSPNPWSPGAYDNWTVIKDMAHVPLLYIIGAFIPATMIAVLYYFDHSVASQLAQQKEFNLRKPPSFHYDLLLLGFLTLLCGLIGIPPSNGVIPQSPMHTKSLATLKHQLLRNRLVATARKSMSQNASLSQLYGSMQDAYQQMQTPLVYQQQSVRRGLNELKDSTVQLASSMGNIDAPVDETVFDIEKEIDDLLPIEVKEQRLSNLLQAAMVGGCVAAMPLLKKIPTSVLWGYFAFMAIESLPGNQFWERILLLFTAPSRRYKVLEEYHTTFVETVPFKTIAMFTLFQTAYLLVCFGITWIPIAGVLFPLMIMLLVPVRQYILPKLFKGAHLTDLDAAEYEESPAIPFSLAAQDIDVAMGRAQSAEILDDMVTRSRGEIKRLNSPKITSSGGTPVAELKNIRSPSISEKAYSPRLAELRHERSPLGGRSSPRTPSKLGEGSTPK

SEQ ID NO: 5819 - protein, 709 aa, Sorghum bicolor
MEESFVPLRGIKDDLHGRLACYKQDWTGGFRAGIRILAPTTYIFFASAIPVISFGEQLERNTDGVLTAVQTLASTAVCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENRKALEFVPSWRFANGMFAIVLSFGLLLTALRSRKARSWRYGTGWLRGFIADYGVPLMVLVWTGVSYIPYGNVPKGIPRRLFSPNPWSPGAYDNWTVIKDMTQVPLLYILGAFIPATMIAVLYYFDHSVASQLAQQKEFNLRKPPSFHYDLLLLGFLTLMCGLIGIPPSNGVIPQSPMHTKSLATLKHQLLRNRLVATARKSMSQNASLSQLYGSMQDAYQQMQTPLVYQQQSVRRGLNELKDSTVQLASSMGNIDAPVDETVFDIEKEIDDLLPIEVKEQRLSNLLQASMVGGCVAAMPLLKKIPTSVLWGYFAFMAIESLPGNQFWERILLLFTAPSRRYKVLEEYHTTFVETVPFKTIAMFTLFQTMYLLVCFGITWIPIAGVLFPLMIMLLVPVRQYILPKLFKGAHLTDLDAAEYEESPAIPFSLAAQDIDVALGRTQSAEILDDMVTRSRGEIKRLNSPKITSSGGTPVAELKGIRSPSISEKAYSPRLTELRHERSPLGGRNSPRTPSKLGEGSTPK

SEQ ID NO: 5820 - protein, 709 aa, Saccharum officinarum
MEESFVPLRGIKNDLHGRLACYKQDWTGGFRAGIRILAPTTYIFFASAIPVISFGEQLERNTDGVLTAVQTLASTAVCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENQKALEFVPSWRFANGMFAIVLSFGLLLTALRSRKARSWRYGTGWLRGFIADYGVPLMVLVWTGVSYIPYGNVPKGIPRRLFSPNPWSPGAYDNWTVIKDMTQVPLLYIIGAFIPATMIAVLYYFDHSVASQLAQQKEFNLRKPPSFHYDLLLLGFLTLMCGLIGIPPSNGVIPQSPMHTKSLATLKHQLLRNRLVATARKSMSQNASLSQLYGSMQDVYQQMQTPLVYQQQSVRRGLNELKDSTVQLASSMGNIDAPVDETVFDIEKEIDDLLPIEVKEQRLSNLLQASMVGGCVAAMPLLKKIPTSVLWGYFAFMAIESLPGNQFWERILLLFTAPSRRYKVLEEYHTTFVETVPFKTIAMFTLFQTVYLLVCFGITWIPIAGVLFPLMIMLLVPVRQYILPKLFKGAHLTDLDAAEYEESPAIPFSLAAQDIDVALGRTQSAEILDDMITRSRGEIKRLNSPKITSSGGTPVAELKGIRSPSISEKAYSPRLTELRHERSPLGGRSSPRTPSKLGEGSTPK

SEQ ID NO: 5821 - protein, 709 aa, Zea mays
MEESFVPLRGIKDDLHGRLACYKQDWTGGFRAGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRVPERENTKALEFVPSWRFANGMFAIVLSFGLLLTALRSRKARSWRYGTGWLRGFIADYGVPLMVLVWTGVSYIPYGNVPKGIPRRLFSPNPWSPGAYDNWTVVKDMTQVPLLYILGAFIPATMIAVLYYFDHSVASQLAQQKEFNLRKPPSFHYDLLLLGFLTLMCGLIGIPPSNGVIPQSPMHTKSLATLKHQILRNRLVATARKGMSQNASLSQLYGSMQDAYQQMQTPLVYQQQSVRRGLNELKDSTVQLASSMGNIDAPVDETVFDIEKEIDDLLPIEVKEQRLSNLLQASMVVGCVAAMPLLKKIPTSVLWGYFAFMAIESLPGNQFWERILLLFTAPSRRYKVLEEYHTTFVETVPFKTIAMFTVFQTAYLLVCFGITWIPIAGVLFPLMIMLLVPVRQYILPKLFKGAHLTDLDAAEYEESPAIPFSLAAQDIDVALGRSQSAEILDDMVTRSRGEIKRLNSPKITSSGGTPVAELKGIRSPSISEKAYSPRLTELQHERSPLGGRSRPRTPSKLGEGSAPK

SEQ ID NO: 5822 - protein, 702 aa, Zea mays
MEESFVPLRGIKNDLHGRLACYKQDWAGGFRAGIRILAPTTYIFFASAIPVISFGEQLERNTDGVLTAVQTLASTALCGVIHSIVGGQPLLILGVAEPTVLMYTFMFSFAKDRPDLGRSLFLAWTGWVCVWTAILLFLLAILGACSIINRFTRVAGELFGLLIAMLFMQQAIKGLIDEFRIPEREDRKALEFVPSWRFANGMFAIVLSFGLLLTALRSRKARSWRYGAGWLRGFIADYGVPLMVLVWTGVSYIPYGNVPKAIPRRLFSPNPWSPGAYDNWTVIKDMTQVPLLYIIGAFIPATMIAVLYYFDHSVASQLAQQKEFNLRKPPSFHYDLLLLGFLTLMCGLIGIPPSNGVIPQSPMHTKSLATLKHQLLRNRLVATARKSMSQNASLSQLYGSMQDAYQQMQTPLVYQQQSVRRGLNELKDSTVQLASSMGNIDAPVDETVFDIEKEIDDLLPIEVKEQRLSNLLQASMVGGCVAAMPLLKKIPTSVLWGYFAFMAIESLPGNQFWERILLLFTAPSRRYKVLEEYHTTFVETVPFKTIAMFTMFQTAYLLVCFGITWIPIAGVLFPLMIMLLVPVRQYILPKLFKGAHLTDLDAAEYEESPAIPFSLAAQDIDVAFGNTQSAEILDNMVTRSRGEIKRINSPKITSSGGTPVAELKGIRSPSISEKAYSPRVIELWHERSPRTPSMLGEGSTPK

SEQ ID NO: 5823 - protein, 719 aa, Musa acuminata
MEETFVPFRGIKNDLQGRLKCYKQDWTGGFRAGIRILAPTTYIFFASAIPVISFGEQLERSTDGVLTAVQTLASTALCGIVHSIIGGQPLLILGVAEPTVLMYTFMFNFAKDRADLGRNLFLAWSGWVCVWTSFLLFLLAILGACSIINRFTRLAGELFGLLIAMLFMQQAIKGLVDEFRIPERENPKALEFIPSWRFANGMFALVLSFGLLFTALRSRKARSWRYGTGWLRGLIADYGVPLMVLVWTGVSYMPTSSVPKGIPRRLFSPNPWSPGAYENWTVIKEMLNVPFLYILGAFIPATMIAVLYYFDHSVASQLSQQKEFNLRKPASFHYDLLLLGFLTLLCGLIGIPPSNGVIPQSPMHTKSLATLKHQLLRSRLVATARQSMSQNSSLSQLYGNMQDAYRQMQTPLIYQESSARGLMELKDSTVQLASSMGNFDAPVDETVFDIEKEIDDLLPVEVKEQRLSNLLQAMMVGGCVGALPFLRKIPTSVLWGYFAFMAIESLPGNQFWERILLLFTAPSRRFKVLEEQHATFVETVPFKTITFFTLFQTIYLLVCFGITWIPIAGVLFPLMIMLLVPVRQYFLPKLFKGAHLTDLDAAEYEESPPLAYNLAAEIDIAKGCSFAESGEVLDDIVTRSRGEIKHMNSPKLTSSSGTPTNDIRGKTSPWLSDKAYSPRLNELRQDHSPRLGGRGPISPRTGEVGPSKLREGARDSPSK

SEQ ID NO: 5824 - protein, 713 aa, Quercus alba
MEETFVPFRGIKNDLNGRLMCYKQDWTGGFKAGFRILAPTTYIFFASAIPVISFGEQLDRSTDGVLTAVQTLASTALCGIIHSIIGGQPLLILGVAEPTVIMYTFMFKFAKDRPDLGSKLFLAWTGWVCVWTAILLFLLAVLGACSIINRFTRIAGELFGLLIAMLFMQEAIKGLVEEFRIPERENPNSIEFQPSWRFSNGMFALVLSFALLLTALRSRKARSWRYGSGSLRGFIADYGVPLMVVVWTAISYLPAGSVPKGIPRRLFSPNPWSPGAYENWTVIKDMLNVPVLYIIGAFIPATMIAVLYYFDHSVASQLAQQKEFNLRKPPSFHYDLLLLGFMVILCGLIGIPPSNGVIPQSPMHTKSLATLKHQLLRNRLVATARKCMRNNASLGQVYGSMQEAYQQMQTPLIYQEPSARGLKELKDSTIQIASSTGNINAPVDESTFDVEKEIDDLLPVEVKEQRLSNLLQAMMVGGCVAAMPFLKKIPTSVLWGYFAFMAIESLPGNQFWERILLLFTAPSRRYKVLEEYHATFVETVPFKTIAIFTIFQTAYLLVCFGITWVPIAGVLFPLMIMLLVPVRQYILPKFFKAAHLQDLDAAEYEEAPALSFNLAIDGEMGRTASFGDDGEILDGIVTRSRGEIRRMCSLKLTSCTATPSKEFRSLQSPRLSDSVHSPRISELRGEQSPRLGGRGPFSPRTGEPRPSNLGKGS

SEQ ID NO: 5825 - protein, 721 aa, Amorphophallus konjac
MDETFVPFRGIKNDLDARLKCYKQDWTGGFKAGIRILAPTTYIFFASAIPVISFGEQLERNTDGILTAVQTLASTALCGIIHSLIGGQPLLILGVAEPTVLMYTFMFNFAKDRPDLGPKVFLAWTGWVCVWTAVLLCSLAILGACSIINRFTRIAGELFGLLIAMLFMQQAIKGLVDEFQVPKRENPKLPEFVFSWRFSNGMFALVLSFGLLLTALKSRKARSWRYGTGWLRGFIADYGVPLMVLIWTGVSYIPAGSIPHGIPRRLFSPNPWSPGAYENWTVVKEMVKVPVLYILGAFIPATMIAVLYYFDHSVASQLAQQKEFNLRKPPSFHYDLLLLGFLTLLCGLIGIPPANGVIPQSPMHTKSLATLKHQLLRNRLVATAKQSMQKNSSLGQLYGNMQEAYQQMQTPLTYQQQSVQGLRELKDSTIQLASSMGSIDAPVDETVFDIENEIDDLLPVEVKEQRLSNLLQALMVGGCVAAMPFLRKIPTSVLWGYFAFMAIESLPGNQFWERILLLFTAPSRRYKVLEEYHATFVETVPFRTIVTFTLFQTAYLLVCFGITWIPIAGVLFPLMIMLLVPARQYVMPKLFKGVHLTDLDAAEYEESPALAYNIASVEIDTALRGGSFAETSGEILDGMITRSRGEVKHVNSPKLTSSTATPVGDGGRGIHSPRFSAFSPRVNELRQELSPRAGGKGPLSPRTSEAKPSNLGDGSRDSAHK

SEQ ID NO: 5826 - protein, 722 aa, Amborella trichopoda
MEESFVPFRGIKNDLSGRLKCYKQDWTGGFSAGFRILAPTTYIFFASAIPVISFGEQLERSTDGTLTAVQTLASTAVCGIIHSIIGGQPLLILGVAEPTVIMYTFMFNFAKDRADLGPKLFLAWAGWVCVWTAFLLFMLAILGGCSIINRFTRVAGELFGLLIAMLFMQQAITGVVEEFRIPRRENPRLTEFVPSWRFANGMFGLVLTFGLLLTALRSRKARSWRYGTGWLRSFIADYGVPLMVLVWTAVSYIPSGDVPKGIPRRLVSPNPWSPGAYSNWTVIKQMLDVPVLYILGAFIPATMIAVLYYFDHSVASQLAQQKEFNLRKPPSFHYDLLLLGFLTIICGLVGIPPSNGVIPQSPMHTKSLATLKHQLLRNRLVATARNCISKNSSLGQLYGNMQEAYQQMQTPLIYQEQSTRGLRELKESTIQLASSMGNIDAPVDESIFDVEKEIDDLLPVEVKEQRLSNLLQAFMVGGCVAAMPFIKMIPTSVLWGYFAFMAIESLPGNQFWERILLLFTAPSRRYKVLEEYHATFVETVPFKAIAFFTIFQLTYLLVCFGMTWIPIAGVLFPLMIMLLVPVRQYLLPKFFKGPHLQDLDAAEYEEAPALPFNVLALQEGESSGLGGMRGTPDDGEILDDIITRSRGEIRRTCSSKITSSTATPVTDHRGPFSPRFSEKEFSPRVSELRHESSPRVGGRRAFSPKTEAKPSNLGQSARNSPS

SEQ ID NO: 5827 - protein, 716 aa, Aquilegia formosa
MEETFVPFEGIKNDLKARLKCYKQDWTGGFSAGLRILAPTTYIFFASAIPVISFGEQLERDTDGVLTAVQTLASTALCGIIHSIIGGQPLLILGVAEPTVLMYTFMFKFAKDKPELGAKLFLAWSGWVCVWTAILLFFLAILGACSIINRFTRVAGELFGMLIAMLFMQQAIKGLVDEFRAPQRENLKQTEFLPPWRFANGMFALVLSFGLLLTGLKSRKARSWRYGSGMIRGLIADYGVPLMVLIWTGVSYIPSHSVPHGIPRRLFSPNPWSPGAYDNWTVIKDMLEVPILYIIGAFIPATMIAVLYYFDHSVASQLAQQKEFNLRKPPSFHYDLLLLGFLTLLCGLLGIPPSNGVIPQSPMHTKSLATLKHQLLRSRLVATARRSMGKNASLGQLYGNMQESYQQMQTPLIYQDASARGLKDLKDSTIQLASSMGNIDAPVDETVFDIEKEIDDLLPVEVKEQRLSNLLQSTMVGCCVAAMPLLKMIPTSVLWGYFAFMAIESLPGNQFWERILLLFTAPSRRYKVLEEYHATFVETVPFKTIATFTIFQTAYLLTCFGITWVPLAGVLFPLLIMLLVPVRQYLLPKFFKGAHLQDLDAAEYEEAPALPFNLACGGETGPFAESGEIMDEIVTRSRGEIRRVCSPKVTSSTSTPLKDSKSFQSPRHMDKAFSPRVSELRGEQSPQLGGRGPLSPRTGEARPSQLGKGTPDSTSK

SEQ ID NO: 5828 - protein, 743 aa, Secale cereale
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKDTHFEEYIIGPDDELADDGLAPDQDKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVGRTSSMQGGDAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAALSTISVIVYFCFFVMGFGPIPNILCAEIFPTSVRGICIAICALTFWIGDIIVTYTLPVMLNAIGLAGVFGIYAVVCILAFVFVYMKVPETKGMPLEVITEFFSVGAKQGKEATD

SEQ ID NO: 5829 - protein, 743 aa, Triticum aestivum
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQGLRGREDVSGEMALLVEGLGVGKDTHFEEYIIGPDDELADDGLAPDEEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDSLNSPLISRQATSVEGKEIAAPHGSIMGGVGRSSSMQGGEAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAALSTISVIVYFCFFVMGFGPIPNILCAEIFPTSVRGICIAICALTFWIGDIIVTYTLPVMLNAIGLAGVFGIYAVVCILAFVFVYMKVPETKGMPLEVITEFFSVGAKQGKEATD

SEQ ID NO: 5830 - protein, 743 aa, Triticum aestivum
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQGLRGREDVSGEMALLVEGLGVGKDTHFEEYIIGPDDELADDGLAPDEEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDSLNSPLISRQATSVEGKEIAAPHGSIMGGVGRSSSMQGGEAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAALSTISVIVYFCFFVMGFGPIPNILCAEIFPTSVRGICIAICALTFWIGDIIVTYTLPVMLNAIGLAGVFGIYAIVCVLAFVFVYMKVPETKGMPLEVITEFFSVGAKQGKEATD

SEQ ID NO: 5831 - protein, 741 aa, Brachypodium distachyon
MSGAVLVAIAASIGNLLQGWDNATIAGAVLYIKKEFSLESQPLIEGLIVAMSLIGATVITTFSGAVADAVGRRPLLIASAVLYFVSGLVMLWAPSVYVLLLARLIDGFGIGLAVTLVPLYISETAPTDIRGLLNTLPQFSGSGGMFLSYCMVFTMSLMPQPDWRIMLGVLSIPSLIYFALTVFYLPESPRWLVSKGRMAEAKRVLQRLRGREDVSGEMALLVEGLGVGKDTYIEEYIIGPDDELADEGLAPDPEKIKLYGPEEGLSWVARPVRGGSALGSALGLMSRHGSMVSQGKSLVDPLVTLFGSVHEKMPEVMGSMRSTLFPNFGSMFSVAEQQQAKADWEAESHRDDEDYASDHGGDDIEDSLQSPLISRQATSVEGKEIAAPHGSIMGAVGRSSSMQGGDAVSSMGIGGGWQLAWKWTEREGADGQKEGGFQRIYLHEEGVPSDRRGSILSMPGGDVPPGGEFIQAAALVSQPALYSKDLMEQQLAGPAMVHPSEAAAKGPKWADLFEPGVKHALFVGIGLQILQQFAGINGVLYYTPQILEQAGVGILLSNLGLSSSSASILISALTTLLMLPSIGIAMRLMDMSGRRFLLLTTIPILIVALAILVLVNILDVGTMVHAALSTISVIVYFCFFVMGFGPIPNILCAEIFPTSVRGICIAICALTFWIGDIIVTYTLPVMLNAIGLAGVFGIYAVVCILAFVFVYMKVPETKGMPLEVITEFFSVGAKQGKEARD

SEQ ID NO: 5832 - protein, 742 aa, Avena sativa
MSGAVLVAIAASIGNLLQGWDNATIAGAVLYIKKEFNLESQPLIEGLIVAMSLIGATFITTFSGAVADSVGRRPLLIASAVLYFISGLVMVWAPNVYVLLLARLIDGFGIGLAVTLVPLYISETAPTDIRGLLNTLPQFSGSGGMFLSYCMVFAMSLMPQPDWRIMLGVLSIPSLIYFALTVFYLPESPRWLVSKGRMAEAKRVLQRLRGREDVSGEMALLVEGLGVGKDTHFEEYIIGPDDELADEGLAPDPEKIKLYGPEEGLSWVARPVRGGQSALGSALGLMSRHGSMVSQGKSIVDPLVTLFGSVHEKMPEVMGSMRSTLFPNFGSMFSVAEQQQAKADWDNESHRDDEDYASDHGADDIEDNLNSPLISRQATSVEGKEIAVPHGSIMGAVGRSSSMQGGESVSSMGIGGGWQLAWKWTEREGADGQKEGGFQRIYLHEEGVQGDRRGSILSMPGGDVPPGSEYIQAAALVSQPALYSKDLVEQQLAGPAMVHPSEAATKGPKWAELFEPGVKHALFVGIGLQILQQFAGINGVLYYTPQILEQAGVGILLSNLGLSSLSASILISALTTLLMLPSIGIAMRLMDMSGRRFLLLSTIPVLIVALAILVLVNILDVGTMVHAALSTISVIVYFCFFVMGFGPIPNILCAEIFPTSVRGICIAICALTFWIGDIIVTYTLPVMLNAIGLAGVFGIYALVCILSLVFVYMKVPETKGMPLEVITEFFSVGAKQGKEATD

SEQ ID NO: 5833 - protein, 740 aa, Oryza sativa
MAGAVLVAIAASIGNLLQGWDNATIAGAVLYIKKEFNLQSEPLIEGLIVAMSLIGATIITTFSGAVADSFGRRPMLIASAVLYFVSGLVMLWAPNVYVLLLARLIDGFGIGLAVTLVPLYISETAPTDIRGLLNTLPQFSGSGGMFLSYCMVFGMSLMPQPDWRIMLGVLSIPSLIYFALTIFYLPESPRWLVSKGRMAEAKRVLQGLRGREDVSGEMALLVEGLGVGKDTKIEEYIIGPDDELADEGLAPDPEKIKLYGPEEGLSWVARPVHGQSALGSALGLISRHGSMVSQGKPLVDPVVTLFGSVHEKMPEIMGSMRSTLFPNFGSMFSVAEQQQAKGDWDAESQREGEDYGSDHGGDDIEDSLQSPLISRQATSVEGKEIAAPHGSIMGAVGRSSSLMQGGEAVSSMGIGGGWQLAWKWTEREGADGEKEGGFQRIYLHEEGVTGDRRGSILSLPGGDVPPGGEFVQAAALVSQPALYSKELMEQRLAGPAMVHPSQAVAKGPKWADLFEPGVKHALFVGIGIQILQQFAGINGVLYYTPQILEQAGVGVLLANIGLSSSSASILISGLTTLLMLPSIGIAMRLMDMSGRRFLLLATIPILIVALAILILVNILDVGTMVHASLSTVSVILYFCFFVMGFGPIPNILCAEIFPTTVRGICIAICALTFWIGDIIVTYTLPVMLNAIGLAGVFGIYAVVCILAFLFVFMKVPETKGMPLEVITEFFSVGAKQAKED

SEQ ID NO: 5834 - protein, 740 aa, Sorghum bicolor
MGGAVLVAIAASIGNLLQGWDNATIAGAVLYIKKEFNLQSEPLIEGLIVAMSLIGATVITTFSGAVADSVGRRPMLIASAILYFVSGLVMLWAPNVYVLLLARLIDGFGIGLAVTLVPLYISETAPTDIRGLLNTLPQFSGSGGMFLSYCMVFGMSLMPTPDWRLMLGVLSIPSLIYFGLTIFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMASQGKPLVDPVVTLFGSVHEKMPEIMGSMRSTLFPNFGSMFSVAEQQQVKADWDAESQREGDDYASDHGGDDIEDNLQSPLISRQATSVEGKEIAAPHGSIMGAVGRSSSLQGGEAVSSMGIGGGWQLAWKWTEREGEDGEKEGGFQRIYLHEEGVQGRGSILSLPGGDVPPGGEFVQAAALVSQPALYSKELLEQRAAGPAMMHPSEAVAKGPRWADLFEPGVKHALFVGIGIQILQQFAGINGVLYYTPQILEQAGVGVLLSNIGLSASSASILISALTTLLMLPSIGIAMRLMDMSGRRFLLLATIPILIVALAILVVVNIVDVGTMVHAALSTISVIVYFCFFVMGFGPIPNILCAEIFPTTVRGICIAICALTFWIGDIIVTYTLPVMLNAIGLAGVFGIYAVVCILALVFVFIKVPETKGMPLEVITEFFSVGAKQAKEARED

SEQ ID NO: 5835 - protein, 738 aa, Panicum virgatum
MGGAVLVAIAASIGNLLQGWDNATIAGAVLYIKKEFNLQSEPLIEGLIVAMSLFGATVVTTFSGAAADSIGRRPMLIASAVLYFVSGLVMLWAPSVYVLLLARLIDGLGIGLAVTLVPLYISETAPTDIRGLLNTLPQFSGSGGMFLSYCMVFGMSLLPKPDWRIMLGVLSIPSLIYLALTVFYLPESPRWLVSKGRMAEAKRVLQRLRGREDVSGEMALLVEGLGVGKDTRIEEYIIGPDDELADEGLAPDPEKIKLYGPEGLSWVARPVRGQSALGSAYGLISQHGSMVSQGKPLVDPVVTLFGSVHEKMPEIMGSMRSTLFPNFGSMFSVAEQQQAKADWDAESHREGDEYASDHGGDDIEDTLQSPLISRQATSVEGKEIAAPHGSIMGAVGRSSSLMQGGEAVSSMGIGGGWQLAWKWTEREGADGQKEGGFQRIYLHEEGVQGNRGSILSLPGGDVPPGGEFVQAAALVSQPALYSKELMEQRAAGPAMVHPSEAVAKGPKWADLLEPGVKHALFVGIGIQILQQFAGINGVLYYTPQILEQAGVGVLLSNIGLSSSSASILISALTTLLMLPSIGIAMRLMDMSGRRFLLLATIPILIVALLVLVVVNIVDMGTMVHAALSTISVILYFCFFVMGFGPIPNILCAEIFPTTVRGICIAICALTFWIGDIIVTYTLPVMLNAIGLAGVFGIYAVVCILALVFVYMKVPETKGMPLEVITEFFSVGAKQARED

SEQ ID NO: 5836 - protein, 739 aa, Setaria italica
MGGAVLVAIAASIGNLLQGWDNATIAGAVLYIKKEFNLQSEPLIEGLIVAMSLFGATVVTTFSGALADSIGRRPMLIASAVLYFVSGLFMLWAPSVYVLLLARLIDGLGIGLAVTLVPLYISETAPTDIRGLLNTLPQFSGSGGMFLSYCMVFGMSLLPKPDWRIMLGVLSIPSLIYFALTVFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSAYGLISQHGSMVSQGKPLVDPVVTLFGSVHEKMPEIMGSMRSTLFPNFGSMFSVAEQQQAKADWDAESQREGDEYASDHGGDDIEDNLQSPLISRQATSVEGKEIAAPHGSIMGAVGRSSGLMQGGEAVSSMGIGGGWQLAWKWTEREGADGQMEGGFQRIYLHEEGVQGNRGSILSLPGGDVPPGGEFVQAAALVSQPALYSKELLEQRAAGPAMVHPSEAVSKGPKWADLFEPGVKHALFVGIGIQILQQFAGINGVLYYTPQILEQAGVSVLLSNIGLSSSSASILISALTTLLMLPSIGIAMRLMDMSGRRFLLLATIPILIVALLVLVVVNIVDVGTMVHAALSTISVIVYFCFFVMGFGPVPNILCAEIFPTTVRGLCIAICALTFWIGDIIVTYTLPVMLNAIGLAGVFGIYAVVCILALVFVYMKVPETKGMPLEVITEFFSVGAKQAKED

SEQ ID NO: 5837 - protein, 747 aa, Zea mays
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVYILLLARLIDGFGIGLAVTLVPLYISETAPTDIRGLLNTLPQFSGSGGMFLSYCMVFGMSLMPKPDWRLMLGVLSIPSLIYFGLTVFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMAASQGKPLVDPMVTLFGSVHEKMPEIMGSMRSTLFPNFGSMFSVADQQQVKADWDAESQREGEDYASDHGGDDIEDNLQSPLISRQATSVEGKEIAAPHGSILGAVGRSSSLQGGEAVSSMGIGGGWQLAWKWTEREGEDGQKEGGFQRIYLHEEGVQGNRGSILSLPGGDVPPGGEFIQAAALVSQPALYSKELLEQRAAGPAMMHPSEAVTKGPRWADLFEPGVKHALFVGIGIQILQQFAGINGVLYYTPQILEQAGVGVLLSNLGLNASSASILISALTTLLMLPSIGIAMRLMDMSGRRFLLLATIPVLIVALLVLVVSNIVDVGDVAHAALSTASVIVYFCFFVMGFGPVPNILCAEIFPTTVRGVCIAICALAFWLGDIIVTYTLPVMLNVVGLAGVFGVYAVVCVLALAFVFVKVPETKGMPLEVITEFFSVGAKQAKEEEEEEAREG

SEQ ID NO: 5838 - protein, 148 aa, Secale cereale
VMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQGLRGREDVSGEMALLVEGLGVGKDTHLRNT

SEQ ID NO: 5839 - protein, 753 aa, Hordeum vulgare
MRRGGWRSWRGCRGWRARRSSRLRRGWRRRRAGAGAGARKDLAALQAEWKSLEEEELVMAAAAKLVFLASNVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKTHIEEYIIGPDDELADDGLAPDQEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGRKEGGAQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLGYISDRIGARAITAASFMYCSIPALFFYRRAILVLVNVLDVGTMVHAALSTISVIVYFCFFVMGPIPEGSTSSVKIDTDRANAASLAKALLTFWIGDIIVTYTLPVMLNAIGLAGVFGIYAVVCMIAFVFVYMKVPETKGMPLEVITEFFSVGAKQGKEATDEVAEKIAESRPSEECRSPVDYVQDHVMEV

SEQ ID NO: 5840 - protein, 692 aa, Secale cereale
MASAATAPPAGKRPATGGREGDQMVITPLGAGSEVGRSCVHMTFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDICIIESTYGVQQHQPRHVREKRFTDAIHNTVSQGGRVLIPAFALGRAQELLLILDEYWSNHPELHKIPIYYASPLAKKCMAVYQTYINSMNERIRNQFAQSNPFHFKHIDPLNSIDNFHDVGPSVVMASPGSLQSGLSRQLFDKWCTDKKNTCVIPGYAVEGSLAKTIINEPREVTLANGLTAPLNMQIFYISFSAHADFPQTSGFLEELRPPNIILVHGEANEMGRLKQKLITQFDGTNTKIVSPKNCQSVEMYFSSEKMAKTIGRLAEKVPEVGEAVSGLLVKKGFTYQIMAPEDLRVYTQLSTANITQRIAVPYSGSFEVIKYRLKQIYESVESSTEEDVPILTVHERVAIRLDSESYVTLQWSSDPISDMVSDSVVAMILNIGREGPKVVPIEEAVKTEEETEKMARKVVYSLMVSLFGDVKVAEEGKLVITVDGDIAHLDGRSGDVECENAGLKERIKTAFRRIQGAVRPIPLSAS

SEQ ID NO: 5841 - protein, 157 aa, Secale cereale
MASAATAPPAGKRPATGGREGDQMVITPLGAGSEVGRSCVHMTFKGRTVLFDCGIHPAYSGMAALPYFDEIDPSAIDVLLVTHFHLDHAASLPYFLEKTTFKGRVFMTHATKAIYRLLLSDYVKVSKVSVEACSSMSRTLSGHGQDRGHRLPPDIGN

SEQ ID NO: 5842 - protein, 692 aa, Triticum aestivum
MASVVMAPPAGKRPASGGREGDHMVITPLGAGGEVGRSCVHMSFKGRTVLFDCGIHPAYSGMAALPYFDEIDPSAIDVLLVTHFHLDHAASLPYFLEKTTFKGRVFMTHATKAIYRLLLSDYVKVSKFSVEDMLFDEQDIIRSMDKIEVIDFHQTLEVNGIRFWCYTAGHVLGAAMFMVDIAGVRILYTGDYSREEDRHLKAAEIPQFSPDICIIESTYGVQQHQPRHVREKRFTDAIHNTVSQGGRVLIPAFALGRAQELLLILDEYWSNHPELHKIPIYYASPLAKKCMAVYQTYINSMNERIRNQFAQSNPFHFKHIDPLNSIDNFHDVGPSVVMASPGSLQSGLSRQLFDKWCTDKKNTCVIPGYAVEGSLAKTIINEPREVTLANGLTAPLNMQIFYISFSAHADFPQTSGFLEELRPPNIILVHGEANEMGRLKQKLITQFDGTNTKIVSPKNCQSVEMYFSSEKMAKTIGRLAEKVPEVGDTVSGLLVKKGFTYQIMAPEDLRVYTQLSTANITQRIAVPYSGSFEVVKYRLKQIYESVESSTEEDVPVLTVHERVAIRLDSERYVTLQWSSDPISDMVSDSVVAMILNIGREGPKVVPIEEAVKTEEETEKVARKVVYSLMVSLFGDVKVAEEGKLVITVDGDVAHLDGRSGDVECENAGLKERIKTAFRRIQGAVRPIPLSAS

SEQ ID NO: 5843 - protein, 693 aa, Brachypodium distachyon
MASVATAPPAGKRPTSGGREGDQMVITPLGAGSEVGRSCVHMTFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDVCIVESTYGVQQHQPRHVREKRFTDAIHNTVSQGGRVLIPAFALGRAQELLLILDEYWSNHPELHKIPIYYASPLAKKCMAVYQTYINSMNERIRNQFAQSNPFHFKHIEPLNSIDNFHDVGPSVVMASPGTLQSGLSRQLFDKWCTDKKNTCVIPGFVIEGTLSKTIINEPREVTLANGLTAPLHMQIFYISFSAHADFPQTSAFLDELRPPNIILVHGEANEMGRLKQKLITQFDGTNIKIVSPKNCQSVEMYFSSEKMAKTIGRLAEKVPEVGESVSGLLVKKGFTYQIMAPEDLRVYTQLSTANITQRIAVPYSGSFEVIKYRLKQIYESVESCPEEPDVPTLIVHERVTIRLESESYVTLQWSSDPISDMVSDSVVAMILNIGREGPKVVPVEEAEKTQEETEKVARKVVYALMVSLFGDVKVAEGGKFVISVDGDVAHLDGSSGDVECENAALKERIKTAFRRIQGAVRPIPLSSS

SEQ ID NO: 5844 - protein, 693 aa, Hordeum vulgare
MASVATAPPAGKRPASGEREGDHMVVTPLGAGGEVGRSCVHMSFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDVIRSMDKIEVIDFHQTLEVNGIRFWCYTAGHVLGAAMFMVDIAGVRILYTGDYSREEDRHLKAAEVPQFSPDICIIESTYGVQQHQPRHVREKRFTDAIHNTVSQGGRVLIPAYALGRAQELLLILDEYWSNHPELHKIPIYYASPLAKKCMAVYQTYINSMNERIRNQFAQSNPFHFKHIEPLNSIDNFHDVGPSVVMASPGSLQSGLSRQLFDKWCTDKKNTCVIPGFAVEGSLVKTIINEPREVTLANGLTAPLHMQIFYISFSAHADFLQTSGFLDELRPPNIILVHGEANEMGRLKQKLTTQFDGTNTKIVSPKNCQSVEMYFSSEKMAKTIGRLAEKVPEVGESVSGLLVKKGFTYQIMAPEDLRVYTQLSTTNITQRISVPYSGSFEVIKYRLKRIYESVESSTKEPDVPTLIVHERVTIRLESEIHVTLQWSSDSISDMVSDSVVAMILNIGRQGPKVVPIEEAAKTEEETEKVAQKVVYALMASLFGDVKVAEEGELVISVDGDVAHLDGRSGDVECENAALKERISTAFRRIQGAVRPIPLSAS

SEQ ID NO: 5845 - protein, 690 aa, Brachypodium distachyon
MASVAPAGKRPASGGREGDQMVITPLGAGSEVGRSCVHMTFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDVCIVESTYGVQQHQPRHVREKRFTDAIHNTVSQGGRVLIPAFALGRAQELLLILDEYWSNHPELQKIPIYYASPLAKKCMAVYQTYINSMNERIRNQFAQSNPFHFKHIEPLNSIDNFHDVGPSVVMASPGSLQSGLSRQLFDKWCTDKKNTCVIPGYVIEGTLAKTIINEPREVTLANGLTAPLHMQIFYISFSAHADFPQTSGFLDELRPPNIILVHGEANEMGRLKQKLITQFDGTNIKIVSPKNCQSVEMYFSSEKMAKTIGRLAEKVPDVGEPVSGLLVKKGFTYQIMAPEDLRVYTQLSTANVTQQIAVPYSGSFEVIKYRLKQIYESVESCPEEPEVPTLIVHERVTIRLESESYVTLQWSSDPISDMVSDSVVAMILNIGREGPKVVPVEEAEKTQDETEKVARKVVYALMVSLFADVKVAEEGKLVISVDGDVAHLDGSSGDVECENAALKERIKTAFRRIQGAVRPIPLSSS

SEQ ID NO: 5846 - protein, 693 aa, Triticum aestivum
MASVATAPPAGKRPASGGREGDHMVVTPLGAGGEVGRSCVHMSFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEVPQFSPDICIIESTYGVQQHQPRHVREKRFTDAIHNTVSQGGRVLIPAYALGRAQELLLILDEYWSNHPELHKIPIYYASPLAKKCMAVYQTYINSMNERIRNQFAQSNPFHFRHIEPLNNIDNFHDVGPSVVMASPGSLQSGLSRQLFDKWCTDKKNACVISGFAVEGSLVKTIINEPREVTLANGLTAPLHMQIFYISFSAHADFPQTSGFLDELRPPNIILVHGEANEMGRLKQKLITQFDGTNTKIVSPKNCQSVEMYFSSEKMAKIVGRLAEKVPEAEESVSGLLVKKGFTYQIMAPEDLRVYTQLSTTNITQRISVPYSGSFEVIKYRLKQIYESVESSTKEPDVPTLIVHERVTIRLESESYVTLQWSSDSISDMVSDSVVATILNIGREGPKAVPIEAAAKTEEETEKVVQKVVYALMVSLFGDVKFAEEGKLVISVDGDVAHLDGRSGDVECENAALKERVSTAFRRIQGAVRPIPLSAS

SEQ ID NO: 5847 - protein, 647 aa, Triticum aestivum
GRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDICIIESTYGVQQHQPRHVREKRFTDAIHNTVSQGGRVLIPAFALGRAQELLLILDEYWSNHPELHKIPIYYASPLAKKCMAVYQTYINSMNERIRNQFAQSNPFHFKHIDPLNSIDNFHDVGPSVVMASPGSLQSGLSRQLFDKWCTDKKNTCVIPGYAVEGSLAKTIINEPREVTLANGLTAPLNMQIFYISFSAHADFPQTSGFLEELRPPNIILVHGEANEMGRLKQKLITQFDGTNTKIVSPKNCQSVEMYFSSEKMAKTIGRLAEKVPEVGETVSGLLVKKGFTYQIMAPEDLRVYTQLSTANITQRIAVPYSGSFEVIKYRLKQIYESVESSTEEDVPVLTVHERVAIRLDSESYVTLQWSSDPISDMVSDSVVAMILNIGREGPKVVPIEEAVKTEEETEKVARKVVYSLMVSLFGDVKVAEEGKLVITVDGDVAHLDGRSGDVESENAGLKERIKTAFRRIQGAVRPIPLSAS

SEQ ID NO: 5848 - protein, 128 aa, Secale cereale
MAVYQTYINSMNERIRNQFAQSNPFHFKHIEPLNSIDNFHDVGPLVVMASPGSLQSGLSRQLFDKWCTDKRNACVISGFAVEGSLVKTIINEPREVTLANGLTAPLHMQIFYISFSAHADFHRRAALG

SEQ ID NO: 5849 - protein, 670 aa, Triticum aestivum
MVVTPLGAGGEAGRSCVHMSFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGSAMFMVDIAGVRILYTGDYSREEDRHLKAAEVPQFSPDICIIESTYGVQQHQPRHVREKRFTDAIHNTVSQGGRVLIPAYALGRAQELLLILDEYWSNHPELHKIPIYYASPLAKKCMAVYQTYINSMNERIRNQFAQSNPFHFKHIEPLNSIDNFHDVGPSVVMASPGSLQSGLSRQLFDKWCTDKKNTCVIPGFAVEGSLVKAIISEPREVTLANGLTAPLHMQIFYISFSAHADFLQTSGFLDELRPPNIILVHGEANEMGRLKQKLITQFDGTNTKIVSPKNCQSVEMYFSSEKMAKIVGRLAEKVPEAEESVSGLLVKKGFTYQIMAPEDLRVYTQLSTTNITQRISVPYSGSFEVIKYRLKQIYESVESSTEEPDVPTLIVHERVTIRLESESYVTLQWSSDSISDMVSDSVVATILNIGREGPKAVPIEAAAKTEEETEKVAQKVVYALMVSLFGDVKVAEEGKLVISVDGDIAHLDGRSGDVECENAALKERISTAFRRIQGAVRPIPLSAS

SEQ ID NO: 5850 - protein, 697 aa, Zea mays
MASSAAAPSGAPPAAKRPASSGREGDQMVVTPLGAGSEVGRSCVHMTFKGRTVLFDCGIHPAYSGMAALPYFDEIDPSAIDVLLITHFHLDHAASLPYFLEKTTFKGRVFMTHATKAIYKLLLSDYVKVSKVSVEDMLYDESDIARSMDKIEVIDFHQTLEVNGIRFWCYTAGHVLGAAMFMVDIAGVRILYTGDYSREEDRHLRAAELPQFSPDICIIESTYGVQQHQPRIIREKRFTEVIHNTVSQGGRVLIPAFALGRAQELLLILDEYWSKHPELHKIPIYYASPLAKRCMAVYQTYINSMNERIRNQFAQSNPFHFKHIESLNSIDNFHDVGPSVVMASPGGLQSGLSRQLFDKWCTDKKNACVIPGYVVEGTLAKTIINEPREVTLANGLTAPLHMSVHYISFSAHADFPQTSNFLDELRPPNIILVHGEANEMSRLKQKLITQFDGTNTKIVSPKNCQSVEMYFTCEKMAKTIGRLAEQVPEGGESSSGLLVKKGFTYQIMAPEDLRVFTQLSTANIIQRIAVPYSGSFEVIRYRLKQIYESVESATEESDVPTLIVHERVTVRLDSESYVTLQWSSDPISDMVSDSVVAMVLNIGREGPKVVPVEEAVKTKEETEKAALKVVYALMTSLFGDVKVAEEGKFVISVDGNVAHLDGRSGDVECENATLKERIKTAFRRIQGAVRPIPLSAS

SEQ ID NO: 5851 - protein, 700 aa, Oryza sativa
MASSVAAAAAPTAGGPPGKRQASGGREGDQLIITPLGAGNEVGRSCVYMSFKGRTVLFDCGIHPAYSGMAALPYFDEIDPSTIDVLLITHFHLDHAASLPYFLEKTTFKGRVFMTHATKAIYRLLLSDYVKVSKVSVEDMLFDEQDILRSMDKIEVIDFHQTLEVNGIRFWCYTAGHVLGAAMFMVDIAGVRVLYTGDYSREEDRHLKAAELPQFSPDICIIESTYGVQQHQPRHVREKRFTDVIHTTVSQGGRVLIPAFALGRAQELLLILDEYWANHPELHKIPIYYASPLAKKCMAVYQTYINSMNERIRNQFAQSNPFHFKHIESLNSIDNFHDVGPSVVMASPGGLQSGLSRQLFDKWCTDKKNSCVIPGYVVEGTLAKTIINEPREVTLANGLTAPLHMQVHYISFSAHADFPQTSTFLDELQPPNIVLVHGEANEMSRLKQKLISQFDGTNIKVVNPKNCQSVEMYFSSEKMAKTIGRLAEKVPEAGESVNGLLVKKGFTYQIMAPEDLRVYTQLSTANITQRIAVPYSGSFEVIKYRLKQIYESVESSTEESDVPTLIVHERVTIRLESESYVTLQWSSDPISDMVSDSVVAMVLNIGREGPKVVPVEEAVKTQEETERVAQKVVYALMVSLFGDVKVAEEGKLVISVDGQVAHLDGRSGGVECENATLRERIKTAFRRIQGAVRPIPLISS

SEQ ID NO: 5852 - protein, 695 aa, Sorghum bicolor
MASSAAAPSGAPPAGKRPASSGREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYRLLLSDYVKVSKVSVEDMLYDENDIARSMEKIEVIDFHQTLEVNGIRFWCYTAGHVLGAAMFMVDIAGVRILYTGDYSREEDRHLRAAELPQFSPDICIIESTYGVQQHQPRIVREKRFTEVIHNTVSQGGRVLIPAFALGRAQELLLILDEYWSKHPELHKIPIYYASPLAKRCMAVYQTYINSMNERIRNQFAQSNPFHFKHIESLNSIDNFHDVGPSVVMASPGGLQSGLSRQLFDKWCTDKKNACVIPGYVVEGTLAKTIINEPREVTLANGLTAPLHMSVHYISFSAHADFPQTSNFLDELRPPNIILVHGEANEMSRLKQKLKTQFDGTNIVSPKNCQSVEMYFTCEKMAKTIGRLAEKVPEGGESSGGLLVKKGFTYQIMAPEDLRVFTQLSTANITQRIAVPYSGSFEVIKYRLKQIYESVESATEESDVPALIVHERVTVRLDSESYVTLQWSSDPISDMVSDSVVAMILNIGREGPKVVPVEEAVKTKEETEKVAQKVVYALMTSLFGDVKVTAEGKFVISVDGNVAHLDGMSGDVKCENATLKERIKTAFRRIQSAVRPIPLSAS

SEQ ID NO: 5853 - protein, 695 aa, Panicum virgatum
MASVAAPSSSLAGKRPASGGREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYKLLLTDYVKVSKVSVEDMLYNENDIARSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIHNTVSQGGRVLIPAFALGRAQELLLILDEYWSKHPELHKIPIYYASPLAKRCMAVYQTYINSMNERIRNQFAQSNPFVFKHIESLNSIENFHDVGPSVVMASPGGLQSGLSRQLFDKWCTDKKNACVIPGYVVEGTLAKTIINEPREVTLANGLTAPLHMQVHYISFSAHADFPQTSNFLDELRPPNIILVHGEANEMSRLKQKLISQFDGTNTKIVSPKNCQSVEMYFTCEKMAKTIGRLAENMPEGGESSGGLLVKKGFTYQIMAPEDLRVFTQLSTANITQRIAVPYSGSFEVIKYRLKQIYESVESATEESDVPTLIVHERVTVRLESESYVTLQWSSDPISDMVSDSVVAVVLNIGREGPKLVPVEEAAKTKEDTERVALKVVYSLMASLFGDVKVGEEGEFVISVDGDVAHLDGRSGDVECENATLKERIKTAFRRIQGAVRPIPLSAS

SEQ ID NO: 5854 - protein, 695 aa, Setaria italica
MASVAAPSASQAGKRPATGGREGDQMVVTPLGAGSEVGRSCVHLTFKGRTVLFDCGIHPAYSGMAALPYFDEIDPSTIDVLLITHFHLDHAASLPYFLEKTTFKGRVFMTHATKAIYKLLLMDYVKVSKVSVEDMLYNESDIGRSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIHNTVSQGGRVLIPAFALGRAQELLLILDEYWSKHPELHKIPIYYASPLAKRCMSVYQTYINSMNDRIRNQFAQSNPFIFKHIESLNSIENFHDVGPSVVMASPGGLQSGLSRQLFDKWCTDKKNACVIPGYVVEGTLAKTIINEPREVTLANGLTAPLHMQVHYISFSAHADFPQTSNFLDELRPPNIILVHGEANEMSRLKQKLISQFDGTNTKIVSPKNCQSVEMYFTCEKMAKTIGRLAENVPGGGESSGGLLVKKGFTYQIMAPEDLRVFTQLSTANITQRIAVPYSGSFEVIKYRLNQIYESVESATEESDVPALIVHERVTVRLDSESYVTLQWSSDPISDMVSDSVVSMILNIGREGPKVVPVEEAAKTKEDTERVALKVVYSLMASLFGDVKVGDEGKFVISVDGDVAHLDGRSGDVECVNGTLKERIKTAFRRIQGAVRPIPLSAS

SEQ ID NO: 5855 - protein, 695 aa, Panicum virgatum
MASVAAPTASLAGKRPTSGAREGDQMVITPLGAGSEVGRSCVHMTFKGRTVLFDCGIHPAYSGMAALPYFDEIDPSTIDVLLITHFHLDHAASLPYFLEKTTFQGRVFMTHATKAIYKLLLTDYVKVSKVSVEDMLYNENDIARSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIHNTVSHGGRVLIPAFALGRAQELLLILDEYWSKHPELHKIPIYYASPLAKRCMAVYQTYINSMNERIRNQLAQSNPFVFKHIESLNSIENFHDVGPSVVMASPGGLQSGLSRQLFDKWCTDKKNACVIPGYVVEGTLAKTIINEPREVTLANGLTAPLHMQVHYISFSAHADFPQTSNFLDELRPPNIILVHGEANEMSRLKQKLISQFDGTNTKIVSPKNCQSVEMYFTCEKMAKTIGRLAESVPEGGESSGGLLVKKGFTYQIMAPEDLRVFTQLSTANITQRIAVPYSGSFEVIKYRLKQIYESVESATEESDVPTLIVHERVTVRQESESYVTLQWSSDPISDMVSDSVVAVVLNIGREGPKVVPVEEAAKTKEDTERVALKVVYSLMVSLFGDVKVGEEGKFVISVDGDVAHLDGRSGDVECENATLKERIKTAFRRIQGAVRPIPLLAS

SEQ ID NO: 5856 - protein, 695 aa, Panicum virgatum
MASVAAPSGSLAGKRPTSGVREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYKLMLTDYVKVSKVSVEDMLYNENDIALSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIHNTVSQGGRVLIPAFALGRAQELLLILDEYWSKHPELHKIPIYYASPLAKRCMAVYQTYINSMNERIRNQFAQSNPFVFKHIESLNSIENFHDVGPSVVMASPGGLQSGLSRQLFDKWCTDKKNACVIPGYVVEGTLAKTIINEPREVMLANGLTAPLHMQVHYISFSAHADFPQTSNFLDELQPPNIILVHGEANEMSRLKQKLISQFDGTNTKIVSPKNCQSVEMYFPCEKMAKTIGRLAENVPEGGESSGGLLVKKGFTYQIMAPEDLRVFTQLSTANITQRIAVPYSGSFEVIKYRLKQIYESVESATEEFDVPTLIVHERVTVRLESESYVTLQWSSDPISDMVSDSVVAVVLNIGREGPKLVPVEEAAKTKEDTERVALKVVYSLMASLFGDVKVGEEGKFVISVDGDVAQLDGRSGDVECENATLKERIKTAFRRIQGAVRPIPLSAS

SEQ ID NO: 5857 - protein, 695 aa, Pennisetum glaucum
MASVAAPSASQAGKRPASGGREGDQMVITPLGAGSEVGRSCVHLTFKGRTVLFDCGIHPAYSGMAALPYFDEIDPSTIDVLLITHFHLDHAASLPYFLEKTTFKGRVFMTHATKAIYKLLLMDYVKVSKVSVEDMLYNESDIGRSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIYNTVTHGGRVLIPAFALGRAQELLLILDEYWSKHPELHKIPIYYASPLAKRCMSVYQTYINSMNDRIRNQFAQSNPFVFKHIESLNSIENFHDVGPSVVMASPGGLQSGLSRQLFDKWCTDKKNACVIPGYVVEGTLAKTIINEPREVTLANGLTAPLHMQVHYISFSAHADFPQTSNFLDELRPPNIILVHGEANEMSRLKQKLISQFDGTNTKIVSPKNCQSVEMYFTCEKMAKTIGRLAENVPEGGESSGGLLVKKGFTYQIMAPEDLRVFTQLSTANITQRIAVPYSGSFEVIKYRLNQIYESVESATEEPDVPALIVHERVTVRLDSESYVTLQWSSDPISDMVSDSVVSMILNIGREGPKVVPVEEATKAKEDTERVALKVVYSLMASLFGDVKVGEEGKFVISVDGDVAHLDGRSGDVECENATLKERIKIAFRRIQGAVRPIPLSAS

SEQ ID NO: 5858 - protein, 694 aa, Zea mays
MAASAAAPSGAPPAGKRPASSGREGDQMVITPLGAGSEVGRSCVHMTFKGRTVLFDCGIHPAYTGMAALPYFDEIDPSAIDVLLITHFHLDHAASLPYFLEKTTFKGRVFMTHATKAIYKLLLSDYVKVSKVSVEDMLFDESDIARSMEKIEVIDFHQTLEVNGIRFWCYTAGHVLGAAMFMVDIAGVRILYTGDYSREEDRHLRAAELPQFSPDICIIESTYGVQQHQPRIVREKRFTEVIHNTVSQGGRVLIPAFALGRAQELLLILDEYWSKHPELHKIPIYYASPLAKRCMAVYQTYINSMNERIRNQFAQSNPFHFKHIESLNSIDNFHDVGPSVVMASPSGLQSGLSRQLFDKWCTDKRNACVIPGYVVEGTLAKTIINEPREVALANGLTAPLHMSVHYISFSAHADFPQTSNFLDELRPPNIILVHGEANEMSRLKQKLITQFDGTNTKIVSPKNCQSVEMYFTCEKMAKTIGRLAEKVPEAGESSGGLLVKKGFTYQIMAPEDLRVFTQLSTANIMQRIAVPYCGSFEVIRYRLEQIYESVEPAAEESDVPALIVHGRVTVRLDSESYVTLQWLSDPISDMVSDSVVAMILNVGREGPKVVPVEGAVKTKEETAQKVVYALMASLFGDVKVVEEGRLVISVDGNVAHLDGRSGYVECENATLKERIKTAFRRIQGAVRPIPLASS

SEQ ID NO: 5859 - protein, 565 aa, Panicum virgatum
MASVAAPTTSLAGKRPTSGAREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYKLLLTDYVKVSKVSVEDMLYNENDIARSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIHNTVSHGGRVLIPAFALGRAQELLLILDEYWSKHPELHKIPIYYASPLAKRCMAVYQTYINSMNERIRNQFAQSNPFVFKHIESLNSIENFHDVGPSVVMASPGGLQSGLSRQLFDKWCTDKKNACVIPGYVVEGTLAKTIINEPREVTLANGLTAPLHMQVHYISFSAHADFPQTSNFLDELRPPNIILVHGEANEMSRLKQKLISQFDGTNTKIVSPKNCQSVEMYFTCEKMAKTIGRLAENIPEGGESSGGLLVKKGFTYQIMAPEDLRVFTQLSTANITQRIAVPYSGSFEVIKYRLKQYTRAWSQQLKNLMFQHLLCMKE

SEQ ID NO: 5860 - protein, 696 aa, Elaeis guineensis
MASAMTGVQGSALKRRESTATREGDRLTITPLGAGNEVGRSCVYMSYKGKTILFDCGIHPAYSGMAALPYFDEIDPSTIDVLLVTHFHLDHAASLPYFLEKTTFKGRVFMTHATKAIYRLLLSDYVKVSKVSVEDMLYDEQDILRSMDKIEVIDFHQTLEVNGIRFWCYTAGHVLGAAMFMVDIAGVRVLYTGDYSREEDRHLRAAEIPQFSPDICIIESTYGVQLHQPRLIREKRFTDVIHSTISQGGRVLIPAFALGRAQELLLILDEYWSNHPELHNIPIYYASPLAKRCMAVYQTYINAMNERIRNQFANSNPFDFKHISPLKSIENFDDVGPSVVMASPSGLQSGLSRQLFDKWCTDKKNACVIPGYVVEGTLAKTIINEPKEVTLMNGLTAPLNMQVYYISFSAHADFAQTSTFLKELMPPNIILVHGEANEMARLKQKLITQFADGNTKIISPKNCQSVEMYFSSEKMAKTIGRLAEKTPEVGETVSGLLVKKGFTYQIMAPDDLHVFSQLSTANITQRISIPYSGAFGVIKHRLKQIYESVESPSEEPDVPTLTVHERVTIRQESENYVTLQWSSDPISDMVSDSVVAMILNISREGPKVTAVVEANKTEEETEKMAQKVIYALFVSLFGDVKIAEEGKLVVTVDGDVARLDGKNGEVECENEGLKERVKTAFRRIQSAVRPIPLSAS

SEQ ID NO: 5861 - protein, 151 aa, Triticum aestivum
RTVLFDCGIHPAYLGMASLPFFDEIDPAAVDVLLITHFHLDHAASLPYFLEKTTFKGRVFMTHATKAIYRLLLSDYVKVSKVSAENMLFDEQDIISSMEKIEVIDFHQTLEVNGIRFWCYTAGHVLGAAMFMVDIAGVRILYTGDYPVTGT

SEQ ID NO: 5862 - protein, 658 aa, Secale cereale
SAAPASTCPSRAAPSSSTAASTRPTPAWRRCPTSTRSTPPPSTSSWSPTSTWTTPPRCPTSSRRRRSRAVCSSTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDICIIESTYGVQQHQPRHVREKRFTDAIHNTVSQGGRVLIPAFALGRAQELLLILDEYWSNHPELHKIPIYYASPLAKKCMAVYQTYINSMNERIRNQFAQSNPFHFKHIDPLNSIDNFHDVGPSVVMASPGSLQSGLSRQLFDKWCTDKKNTCVIPGYAVEGSLAKTIINEPREVTLANGLTAPLNMQIFYISFSAHADFPQTSGFLEELRPPNIILVHGEANEMGRLKQKLISQFDGTNTKIVSPKNCQSVEMYFSSEKMAKTIGRLAEKVPELGEAVSGLLVKKGFTYQIMAPEDLRVYTQLSTANITQRIAVPYSGSFEVIKYRLKQIYESVESSTEEDVPILTVHERVAIRLDSESYVTLQWSSDPISDMVSDSVVAMILNIGREGPKVVPIEEAVKTEEETEKMARKVVYSLMVSLFGDVKVAEEGKLVITVDGDIAHLDGRSGDVECENAGLKERIKTAFRRIQGAVRPIPLSAS

SEQ ID NO: 5863 - protein, 695 aa, Musa acuminata
MTGQTSSLKRRDTTAATAGPREGDQLIVTPLGAGSEVGRSCVYMSYRGKIVLFDCGIHPAYSGMAALPYFDEIDPSTIDVLLVTHFHLDHAASLPYFLEKTTFKGRVFMTHATKAIYKLLLSDYVKVSKVSVEDMLYDEQDILRTMDKIEVIDFHQTVEVNGIRFWCYTAGHVLGAAMFMVDIAGVRVLYTGDYSREEDRHLRAAEIPQFSPDICIIESTYGVQLHQPRLIREKRFTDVIHSTISQGGRVLIPAFALGRAQELLLILDEYWSNHPEFHNIPIYYASPLAKRCMAVYQTYINAMNERIRNQFANSNPFDFKHISPLKSIENFDDVGPSVVMASPGSLQSGLSRQLFDKWCSDKKNACVLPGYVVEGTLAKTILNEPKEVTLMNGLTAPLNMQVYYNSFSAHADFAQTSAFLNELMPPNIILVHGEANEMGRLKQKLIGQFADKNTKIMTPKNCQSVELYFTSEKMAKTIGRLAEKTPEVGETVSGLLVKKGFTYQIMAPDDLHVFSQLSTANITQRISIPYSGAFSVIKHRLKQIYESVEAPIEEPDVPTLIVHDRVTIRQETEKYVTMQWPSDPISDMVSDSVVAMILNISREGPKVTAVAEAEKTQEEMEKMAHKVIYSLLVSLFGDVKVGEEGKLIVTVDGDVARLDGKNGEVECDNEGLKERVKTAFRRIQSAVRPIPLSAS

SEQ ID NO: 5864 - protein, 216 aa, Phalaenopsis aphrodite
MASGVTSHASALKRKDSAPTREGDQLIITPLGAGNEVGRSCVYMSYRGKTVLFDCGIHPAYSGMAALPYFDEIDPSTIDILLVTHFHLDHAASLPYFLEKTTFKGRVFMTHATKAIYRLLLSDYVKVSKVSVEDMLYDEQDILRSMDKIEVIDFHQTVEVNGIVFGATQLVMSLELPCSWWTLLASEFFILVTILVKKTAISVLLKSHNSLLIYAS

SEQ ID NO: 5865 - protein, 694 aa, Vitis vinifera
MASTGPPQSLKRPDSSLTREGDQLIITPLGAGNEVGRSCVYMSYKGKTILFDCGIHPAYSGMAALPYFDEIDPSTIDVLLVTHFHLDHAASLPYFLEKTTFKGRVFMTHATKAIYKLLLSDYVKVSKVSVEDMLYDEQDILRSMDKIEVIDFHQTLEVNGIRFWCYTAGHVLGAAMFMVDIAGVRVLYTGDYSREEDRHLRAAEIPQFSPDICIIESTYGVQLHQPRHVREKRFTDVIHSTISQGGRVLIPAFALGRAQELLLILDEYWSNHPELHNIPIYYASPLAKRCMAVYQTYINSMNERIRNQFANSNPFDFKHISPLKSIENFNDVGPSVVMASPSGLQSGLSRQLFDMWCSDKKNACVIPGYVVEGTLAKTIINEPKEVTLMNGLTAPLNMQVHYISFSAHADFAQTSTFLKELMPPNIILVHGEANEMGRLKQKLITQFADRNTKIISPKNCQSVEMYFNSEKMAKTIGRLAEKTPGVGETVSGLLVKKGFTYQIMAPDDLHVFSQLSTANVTQRITIPYTGAFGVIKHRLKQIYESVESLPDEESEVPAFRVHERVTVKHESEKHISLHWTSDPISDMVSDSIVALVLNISREIPKVVVESEAIKTEEENGKKAEKVIHALLVSLFGDVKLGENGNLVISVDGNVAHLDKQSGNVESENEGLKERVRVAFQRIQNAVKPIPLSVS

SEQ ID NO: 5866 - protein, 675 aa, Secale cereale
MARHAVLLTVATVAVLLARRAAAEYPWPVCSSTGSFAANDTTYLSSINAIAATLPRNASASPGGLYATARAGQVRALGLCRGDASATACSDCLAQGFQDLPSACAYSKEATMYYDPCFLHYSDADSRASDDTALGSAFSTAYSANATAEPARFHRVVAALLNATADYAAYNSSATRLYASGAVPFDREIPEVYSWAQCTPDLTPARCRDCLANMIQELGTPLYSVGARVLGIRCGVRYENRPFLDGPVLLRLPATGAPAPSPTPAPAPAPDVVPNVVTPVAAVGGGRKYSVPGMVLIVVLPSLAAANLLAGLFIWRRRRRSPAQGKQPYSSYSTEAKDTESVDSMLMDISTLRAATGDFAESNKLGEGGFGAVYKGTLPDGEEIAVKRLSKSSTQGVEELKNELALVAKLKHKNLVRLVGVCLEQQERLLVYEFIPNRSLDQILFDPEKQDQLDWGKRQRIIRGIARGLQYLHEDSQLKVVHRDLKASNVLLDADMNPKISDFGLARLFGRGQTQGVTNRVIGTYGYMAPEYLMRGNYSVKSDVFSFGVMVLEIVTGRKNSDMSQSEDLLTTIWEHWSARTLLEMMDPCMNNIFSESDARRCIQVGLLCVQENPVDRPVMSAVGMMLGSDTVSLGAPSKPAPTFYARNPSADSGNGFSISTISLNDDPKDHYSMT

SEQ ID NO: 5867 - protein, 675 aa, Secale cereale
MARHAVLLTVAIVAVLLARRAAAEYPWPVCGSTGSFAANDSTYLASISAIAATLPRNASASPGGLYATARAGQVRAVGLCRGDANATACSDCLAQGFQDLPSACAYSKEATMYYDPCFLHYSDADSRASDDTALGSAFSTAYSANATAEPARFHRVVAALLNATADYAAYNSSATRLYASGAVPFDREIPEVYSWAQCTPDLTPARCRDCLANMIQELGTPLYSVGARVLGIRCGVRYENRPFLDGPVLLHLPAIGAPAPSPTPAPAPAPDVVPNVVTPVAAVGGGRKYSVPGMVLIVVLPSLAAANLLVGLFIWRRRRRSPAQAKKPYSSYSTEAKDTESVDSMLMDISTLRAATGDFAESNKLGEGGFGAVYKGTLPDGEEIAVKRLSRSSTQGVEELKNELALVAKLKHKNLVRLVGVCLEQQERLLIYEFIPNRSLDQILFDPEKQDQLDWGKRQRIIRGIARGLQYLHEDSQLKVVHRDLKASNVLLDADMNPKISDFGLARLFGRGQTQGVTNRVIGTYGYMAPEYLMRGNYSVKSDVFSFGVMVLEILTGRKNSDMSQSEDLLTTIWEHWSARTLLEMMDPCMNNIFSESDARRCIQIGLLCVQENPVDRPVMSVVGMMLGSDTVSLGAPSKPAPTFYARNPSADSGNGFSISTISLNDDPKDHYSMT

SEQ ID NO: 5868 - protein, 280 aa, Triticum aestivum
MAGAEAVERAHELYRGGRHREALELYSAALAAARGPAQRIALHSNRAACYLKLHDFHKAAEECTSVLELDTEHAGALMLRAQTLVTLKDYQSALFDVNRLIEINPSSEVYRNLHARLKTQLSLAPIPESEEESLYTEEDKEDLPPKDNTKNETVVVKSDQPSAKVILENKPVTKALKVEVPPNLPSKPEGGGTIQKPKGHSELDYKEPLTEAPKVQVSPSLPSKPECRGTIQKPKGHSGLDYSKWDKVEDDSSEDDEDDDEDDLPRYKFKVRTIGVRTVK

SEQ ID NO: 5869 - protein, 744 aa, Secale cereale
MGSGRACSVVASVVLLWLGVAAAQGDSPWKTLSGKAPAIIAKGGFSGLFPDSSEFAYQFAMIASSPDTVLYCDVRLTKDGLGVCLPEIKMDNCTNIPDFYPKGKKSYLVNGVSTTGWFSVDYNGTELSQVSLKQSIFSRTPRFDPSFFPLLAVEDVASKFKPPGMWLNIQHDGFYSQFNMSMRKYILSVSRRVIVDYISSPEASFLTSISGRVSNNTKLVFRFLDEATLEPSTKETYGSMLKNLTFIKTFASGILVPKKYIWPVSPDNYLQPYTSIVDDAHKAGLEIYAADFANDFVLSYNHSYDPLAESLSFIDNGAFSVDGILTDFPVTPSEAIGCFANLNKSNTDHGKPLIISHNGASGDYPGCTDLAYQKAVDDGADVIDCPVQVTKDGIPVCMGSINLMDSTTVAKSPFASQAAVMKDIESVLGVFTFNLTWDDIVKNLKPKISTPLSTFSLDRNPRYRNAGNFMRLSDFLDFSKDKDLSGIMISIEHAAFLAEELGFDMVDAVIKALDDSGYSKQTAQKVMIQSTNSSVLVKLKQQTKYDLVYMINEDVSDAAPSSLAGIKKFADAVSVETSSVFPENRHFTSHQTDLVESLQTAGLSVYAYTLMNEFVAQPYDFFSDATAEIIAYVQGAGVDGLITDFPATARRYKSNTCMNMGNKTPSFMAPPRPGDLLQLISKPAQPPALAPMPLLMDSDVSEPPLPPARLNNATTAPAPSSARRMQTRIPFLVTLAMLCAWATV

SEQ ID NO: 5870 - protein, 744 aa, Triticum aestivum
MGSGRVCSVVASVVLLWLGVAAAQGDSPWKTLSGNAPAIIAKGGFSGLFPDSSEFAYQFAMIASSPDTILYCDVRLTKDGLGVCLPDIKMDNCTNIPDFYPKGKKSYLVNGVSTTGWFSVDYNGTELSQVSLKQSIFSRTPRFDPSFFPLLAVEDVASKFKPPGMWLNIQHDGFYSQFNMSMRKYILSVSRRVIVDYISSPEASFLTSISGRVSNNTKLVFRFLDEATLEPSTKETYASMLKNLTFIKTFASGILVPKKYIWPVSPDNYLQPYTSIVDDAHKAGLEIYAADFANDFTLSYNHSYDPLTESLSFIDNGAFSVDGILTDFPVTPSEAIGCFANLNKSNTDHGKPLIISHNGASGDYPGCTDLAYQKAVDDGADVIDCPVQVTKDGIPVCMGSINLMDSTTVAKSPFASQAAVMKDIESVLGVFTFNLTWDDIVKNLKPKISTPLSTFSLDRNPRYRNAGNFMRLSDFLDFSKDKDLSGIMISIEHAAFLAEELGFDMVDAVIKALDDSGYNKQTAQKVMIQSTNSSVLVKFKQETKYDLVYMINEDVSDAAPSSLAGIKKFADAVSVETSSVYPENRHFTSHQTDLVESLQTAGLSVYAYNLMNEFVSQPYDFFSDATAQIITYVQGAGVDGLITDFPATARRYKSNTCMNMGNKTPSFMAPPRPGDLLQLISKPAQPPALAPMPLLMDSDVSEPPLPPARLNNATTAPAPSSAPRMQTRIPFLVTLAMLSAWVAV

SEQ ID NO: 5871 - protein, 720 aa, Triticum aestivum
GDSPWKTLSGNAPAIIAKGGFSGLFPDSSEFAYQFAMIASSPDTILYCDVRLTKDGLGVCLPEIKMDNCTNIPDFYPKGKKSYLVNGVSTTGWFSVDYNGTELSQVSLKQSIFSRTPRFDPSFFPLLAVEDVASKFKPPGMWLNIQHDGFYSQFNMSMRKYILSVSRRVIVDYISSPEASFLTSISGRVSNNTKLVFRFLDEATLEPSTKETYGSMLKNLTFIKTFASGILVPKKYIWPVSPDNYLQPYTSIVDDAHKAGLEIYAADFANDFALSYNHSYDPLAESLSFIDNGAFSVDGMLTDFPVTPSEAVGCFANLNKSNTDHGKPLIISHNGASGDYPGCTDLAYQKAVDDGADVIDCPVQVTKDGIPVCMGSINLMDSTTVAKSPFASQAAVMKDIESVLGVFTFNLTWDDIVKNLKPKISTPLSTFSLDRNPRYRNAGNFMRLSDFLDFSKDKDLSGIMISIEHAAFLAEELGFDMVDAVIKALDDSGYNKQTAQKVMIQSTNSSVLVKFKQETKYDLVYMINEDVSDAAPSSLAGIKKFADAVSVETSSVFPENRHFTSHQTDLVESLQTAGLSVYAYNLMNEFVSQPYDFFSDATAQIIAYVQGAGVDGLITDFPATARRYKSNTCVNMGNKTPSFMAPPRPGDLLQLISKPAQPPALAPMPLLMDSDVSEPPLPPARLNNGTTAPAPSSAPRMHTRIPFLVTLAMLCAWATV

SEQ ID NO: 5872 - protein, 744 aa, Brachypodium distachyon
MRSGNHVCSAVASFVLLWLGVAAAQGASSWKTLSGDAPAIIAKGGFSGLFPDSSEFAYQFALIASSPDTILYCDVRLTKDGLGVCLPDIKLDNCTNIPEFYADGKKSYLVNGVSTTGWFSVDYNGTELSQVSLKQSIYSRTPRFDPSFFPLLAVEDVASKFKSPGIWLNIQHDSFYSQFNMSMRNYILSVTKRVVVDYISSPEASFLTSISGRVSNKTKLVFRFLDEATLEPSTKQTYGSMLKNLTFVKTFASGILVPKKYIWPVSPDNYLQPYTSIVDDAHKAGLEIYAADFANDFTLSYNHSYDPLTESLSFIDNGAFSVDGILTDFPVTPSEAIGCFANLNKSNTDHGKPLIISHNGASGDYPGCTDLAYQKAVDDGADVIDCPVQITKDGIPVCMGSINLMDGTTVAKSPFASQIAVMKDIQSVLGVFTFNLTWEDIVKNLKPKISTPLSTFALDRNPRYRNAGNFMRLSDFLDFSKDKDLSGIMISIEHAAFLAEELGFDMVDAVIKALDASGYNKQTAQKIMIQSTNSSVLVKFKQQTKYDLVYMINEDVRDAAPSSLADIKKFASAVSVDTGSIFPENHHFLTSPSGLVQSLKTANLSIYAYTLMNEFLSQPYDFFSDATAQINAYVQGAKVDGLITDYPATARRYKLNACKNMGKKAPSFMAPARPGDLLQIISKPAQPPALAPMPLLVDSDVTEPPLPAARSNNGTAPAPSFAWRMETRVPILVTLAVLCASVLI

SEQ ID NO: 5873 - protein, 740 aa, Oryza sativa
MRGSHVCSLVSSLVFLWLGVAAAQKASSWKTLSGNAPAIIAKGGFSGIFPDSSEFAYQFALIASSPDTILYCDVRLTKDGLGICLPDIKMDNCTNIPDFYQQGRKSYLVNGVSTAGWFSVDYNGTELGQVSLKQSIFSRSPRFDPSFFPILAVEDIASKFKPPGMWLNVQHDSFYSQFNLSMSNYIFSVSKRVIVDYISSPEVSFLTKVSGKLSNNTRLVFRFLDESTIEPSTKQTYGSMLKNLTFVKTFASGIIVPKKYIWPVSPDNYLEPHTSVVDDAHKAGLEIYAADFANDFMFSYNHSYDPLAEYLSFIDNGAFSVDGVLTDFPVTPSEAIGCFTNLKKSKTDHGKPLIISHNGASGDYPACTDLAYQKAVDDGADVIDCPVQLTKDGIPICMSSINLMDDTTVAKSQFASQTAVIKDIESVLGVFTFNLTWDDIVKNLRPKISTPFSSFKLDRNPRYRNAGNFMRLSDFLDFTKDKDLSGIMISVEHAAFVAEELGFDMVDSVIKTLDAAGYSNQTAQKVMIQSSNSSVLVKFKQQTKYDLVYMINEEVKDAAPSSLAAIKKFADAVSVEGNSIFPENRHFTTYQTNLVESLQNAGLPVYVYTLMNEFASQPYDFFSDATAQINAYVQGAGVNGVITDFPATARRYKLNTCMHMGNNTPSFMAPARPGDLLQIISKPAQPPAMSPMPLLTGSDVAEPPLPPARTAQAPSLASRMQAHAAIVVTLAMLLACHPLV

SEQ ID NO: 5874 - protein, 218 aa, Triticum aestivum
MEWAYSGGGHSSSGTKSPAAGGREEGSYMTVSSAPPKRRAGRTKVRETRHPVYKGVRSRNPGRWVCEVREPHGKQRLWLGTFDTAEMAARAHDVAALALRGRAACLNFADSPRTLRVPPQGAGHEEIRRAAVEAAELFRPEPGQRNAATTEAPAASPADAGNAELVANSPYHLMDGLEFEMQGYLDMAHGMLIEPPPMAGPSTWIEEDYDCEVSLWNY

SEQ ID NO: 5875 - protein, 184 aa, Secale cereale
MEWAYCGSDYSSSGAQSPLAGGREEGSYMTVSSAPPKRRAGRTKVRETRHPVYKGVRSREPPDGGSARCASRTGSRGYGSAPSTPPRWRRARTTSPPWRSAAAQRASTSRTRRARSGCRPKGAGHDEIRRAAVEAAELFRRRLGSPCSYRGAGCFAGGIGERGARRKLSLLPHGWTGIRNAGLS

SEQ ID NO: 5876 - protein, 219 aa, Oryza sativa
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 5877 - protein, 346 aa, Secale cereale
MDDDGSLSIRNWGFYETMKGNLGLQLMPSVAGGHRDTKPLLPNGTFLPHHNAPHHPPHSHHPRDYGNGEPSGGMPTDPPAIHMDFVRNEAWMHPSQHQHQHHHQNQHQQQHQHQHQHQHSREQKVLHAVPLGPAGHIGHPGHAVHHHPTGFGMMPDARGAHTLQMMQPQEPPVPEEEKITPPLVEEHSVVGSKPPVKKRQQGRQPKLPKPKKPKKVATPGEDGAPKARAPRSRGPLKPVEMVINGIDFDISRIPTPVCSCTGAPQQCYRWGAGGWQSACCTTSISTYPLPMNTKRRGARIAGRKMSQGAFKKVLEKLAGEGYNLNNPIDLKTFWAKHGTNKFVTIR

SEQ ID NO: 5878 - protein, 349 aa, Triticum aestivum
MDDDGSLSIRNWGFYETMKGNLGLQLMPSVAGAGHRDTKPLLPNGTFLQHHNAPHHPPHSHHPRDYGNGEPSGGMPTEPPAIHMDFVRNEAWMHPSQHQHQHQHQHHHQNQHQQQHQHQHQHSREQKVLHAVPLGPPGHIGHPGHAVHHHPTDFGMMPDARGAHTLQMMQPQEPPVPEEEKIAPPLVEEHSVVGSKPLVKKRQQGRQPKLPKPKKPKKVATPGEDGAPKARAPRSRGPLKPVEMVINGIDFDISRIPTPVCSCTGAPQQCYRWGAGGWQSACCTTSISTYPLPMNTKRRGARIAGRKMSQGAFKKVLEKLAGEGYNLNNPIDLKTFWAKHGTNKFVTIR

SEQ ID NO: 5879 - protein, 288 aa, Leymus cinereus x Leymus triticoides
MRELVSSSSSTAGNAALRGWWEDVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLVLFWAEIYHQARSLPNDKLRIIYLAVNSILYVIQVCIWVYLGINDNPLVELVSKIFIVSVSAVALLGFAVYGGRLFVLLRRFPIESKGRKKKLYEVGTVTTICCTCFLIRCIVVAVSAFDADVSLEVLDHPILDFFYYMLTEILPSALVLFILRKLPPKRVSAQYHPIN

SEQ ID NO: 5880 - protein, 295 aa, Triticum aestivum
MRELVSSSTSSPTAALVAAGNAALRGWWEEVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLVLFWAEIYHQARSLPTDKLRIIYLAVNSIVYAIQICIWVYLGINDNALVELVSKIFIVSVSAVALLGFAVYGGRLFVLLRRFPIESKGRKKKLYEVGTVTTICCTCFLIRCIVVAVSAFDADVSLEVLDHPILDFFYYMLTEILPSALVLFILRKLPPKRVSAQYHPIN

SEQ ID NO: 5881 - protein, 295 aa, Triticum aestivum
MRELVSSSTSSPIAALVAAGHAALRGWWEEVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLVLFWAEIYHQARSLPTDKLRIIYLAVNSIVYAIQICIWVYLGINDNALVELVSKIFIVSVSAVALLGFAVYGGRLFVLLRRFPIESKGRKKKLYEVGTVTTICCTCFLIRCIVVAVSAFDADVSLEVLDHPILDFFYYMLTEILPSALVLFILRKLPPKRASAQYHPIN

SEQ ID NO: 5882 - protein, 295 aa, Secale cereale
MRELVSSSSSSPTAVLLAAGNAALRGWWEDVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLVLFWAEIYHQARSLPTDKLRIIYLAVNSIVYAIQVCIWVYLGINDNPLVELVSKIFIVSVSAVALLGFAVYGGRLFVLLRRFPIESKGRKKKLYEVGTVTTICCTCFLIRCIVVAVSAFDADVSLEVLDHPVLDFFYYMLTEILPSALVLFILRKLPPKRVSAQYHPIN

SEQ ID NO: 5883 - protein, 295 aa, Secale cereale
MRELVSSSSSSPTAVLLAAGNAALRGWWEDVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLALFWAEIYHQARSLPTDKLRIIYLAVNSIVYAIQVCIWVYLGINDNPLVELVSKIFIVSVSAVALLGFAVYGGRLFVLLRRFPIESKGRKKKLYEVGTVTTICCTCFLIRCIVVAVSAFDADVSLEVLDHPVLDFFYYMLTEILPSALVLFILRKLPPKRVSAQYHPIN

SEQ ID NO: 5884 - protein, 298 aa, Hordeum vulgare
MRELVSSSSSSSSSPTAVLVAAANAVLRGWWEDVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLVLFWAEIYHQARSLPTDKLRIIYVAVNSIVYAIQVCIWVYLGINDNPLVELVSKIFIVSVSAVALLGFAVYGGRLFVLLRRFPIESKGRKKKLYEVGTVTTICCTCFLIRCIVVAISAFDADVSLEVLDHPILDFFYYMLTEILPSALVLFILRKLPPKRATAQYHPIN

SEQ ID NO: 5885 - protein, 286 aa, Oryza sativa
MREPVVVAASSAAALRGFWEEVNESPAWQDGAFFSLSAAYALVSAVALIQLIRIQRRVPEFGWTTQKVFHLMNFLVNGVRALVFGFHLHVFLLSAKVYKLVLLDLPGLLFFSTYTLLVLFWAEIYHQARSLPTDKLRIIYIAVNAIIYTIQVCIWVYLGINDNPLVELVSKIFIVVVSFVALLGFSVYGGRLFFLLRRFPIESKGRKKKLYEVGTVTAICCACFLIRCIVVAISAFDSDVSLEVLDHPILDFFYYMLTEILPSALVLFILRKLPPKRVSAQYHPIN

SEQ ID NO: 5886 - protein, 293 aa, Zea mays
MRRDLASSFATAASSSSAADALRGWWDDVNESPQCQDAAFFSLAAAYALVSAVALIQLVRIQRRVPEFGWTTQKVFHLMNFLVNGVRALVFGFHVHVFLLRAKVYKLVLLDLPGLLFFSTYTLLVLFWAEIYHQARSLPTDKLRPAYIAVNTIIYVVQVCIWIYLGINDNAVVELASKIFIVAVSFVALLGFSVYGGRLFVLLRRFPIESKGRQKKLYEVGTVTAICVTCFLIRCVVVALSAFDADVSLEVLDHPVLDFFYYMLAEILPSALVLFVLRKLPPKRVSAQYHPIN

SEQ ID NO: 5887 - protein, 298 aa, Zea mays
MRRELASPLATAAAATAGASFSAAASLRGWWDDVNESPQWQDGAFFSLAAAYALVSAVALIQLVRIQRRVPEFGWTTQKVFHLMNFLVNGVRALVFGFHVHVFLLRTKVYKLVLLDLPGLLFFSTYTLLVLFWAEIYHQARSLPTDKLRPAYIAVNAIIYVVQLCIWIYLGINDNAAVELASKIFIVAVSFVALLGFSVYGGRLFVLLRRFPIESKGRQKKLYEVGTVTAICVTCFLIRCVVVALSAFDADVSLEVLDHPVLDFFYYMFAEILPSALVLFVLRKLPPKRVSAQYHPIN

SEQ ID NO: 5888 - protein, 297 aa, Sorghum bicolor
MRRELASSFATAAATAGASSSAADALRGWWDDVNESPQWQDAAFFSLAAAYALVSAVALIQLIRIQRRVPEFGWTTQKVFHLMNFLVNGVRALVFGFHAHVFLLHTKVYKLVLLDLPGLLFFSTYTLLVLFWAEIYHQARSLPTDKLRPAYIAVNTIIYVVQVCIWIYLGINDNAVIELASKIFIVAVSFIALLGFSVYGGRLFVLLRRFPIESKGRQKKLYEVGTVTAICVTCFLIRCVVVALSAFDADVSLEVLDHPILDFFYYMFAEILPSALVLFVLRKLPPKRVSAQYHPIN

SEQ ID NO: 5889 - protein, 297 aa, Saccharum officinarum
MRRELASSFATAAATAGASSSAADALRGWWDDVNESPQWQDAAFFSLAAAYALVSAVALIQLIRIQRRVPEFGWTTQKVFHLMNFLVNGVRALVFGFHVHVFLLRTKVYKLVLLDLPGLLFFSTYTLLVLFWAEIYHQARSLPTDKLRPAYIAVNTIIYVVQVCIWIYLGINDNAVVELASKIFIVAVSFIALLGFSVYGGRLFVLLRRFPIESKGRQKKLYEVGTVTAICVTCFLIRCVVVALSAFDADVSLEVLDHPILDFFYYMFAEILPSALVLFVLRKLPPKRVSAQYHPIN

SEQ ID NO: 5890 - protein, 295 aa, Panicum virgatum
MRKLASFAAATSGAYSSASAALRVRGWWDDVNESRQWQDGVFFSLAAAYALVSAVALIQLIRIQRRVPELGWTTQKIFHLMNFLVNGVRALVFGFHVHVFLLHTKVYKLVLLDLPGLLFFSTYTLLVLFWAEIYHQARSLPTDKLRPAYIAVNSIIYVVQVCIWIYLGINDNAAVELASKIFIVAVSFVALLGFSVYGGRLFFLLRRFPIESKGRQKKLYEVGTVTAICVTCFLIRCVVVALSAFDPDVSLEVLDHPILDLFYYTLTEILPSALVLFVLRKLPPKRVSAQYHPIN

SEQ ID NO: 5891 - protein, 294 aa, Setaria italica
MRELASSFAAAASASSSASAPLLGGWWNDVNESPEWQHAAFFSLSAAYALVSAVALIQLIRIQRRVPELGWTTQKIFHLMNFLVNGVRALVFGFHVHVFLLRTKVYKLVLLDLPGLLFFSTYTLLVLFWAEIYHQARSLPTDKLRPAYIAVNSIIYVVQVCIWIYLGINDNAAVELASKLFIVAVSFVALLGFSVYGGRLFFLLRRFPIESKGRQKKLYEVGTVTAICVTCFLIRCVVVALSAFDRDVSLEVLDHPILDLFYYTLTEILPSALVLFVLRKLPPKRVSAQYHPIN

SEQ ID NO: 5892 - protein, 294 aa, Panicum virgatum
MRELASSLAATGAYSSSSASSALRGWWVDVNESRQWQDGAFFSLAAAYALVSAVALIQLIRIQRRVPELGWTTQKIFHLMNFLVNGVRALVFGFHVHVFLLRTKVYKLVLLDLPGLLFFSTYTLLVLFWAEIYHQARSLPTDKLRPAYIAVNTIIYVLQVCIWIYLGINDNAAVELASKIFIVAVSFIALLGFSVYGGRLFFLLRRFPIESKGRQKKLYEVGTVTAICVTCFLIRCVVVASSAFDPDVSLEVLDHPILDLFYYTLTEILPSALVLFVLRKLPPKRVSAQYHPIN

SEQ ID NO: 5893 - protein, 223 aa, Hordeum vulgare
MDAATDGEQRRLLSIPKEGERVIAPTRRPDGTLRKEIRIRAGYVPQDEVAIYQSKGALMKKTGPDVPPGYDPALDAKPKTKAAKRNERRKEKRHQGGSTNDKGKSLDIDEPDAGETDKVHSSKTKQRDTVDSVTEHISGIAISESPVMATPSTNAADNLQTESSVPEIDKKIRALKKKIRLAEAQVQGDPEKLKPEQLEKTKKIEGWREELKLLESTRVHSAS

SEQ ID NO: 5894 - protein, 223 aa, Secale cereale
MDAATDGEQRRLLSIPKEGERVIAPTRRPDGTLRKEIRIRAGYVPQDEVAIYQSKGALMKKSGPDVTPGYDPALDAKPKTKAAKRNERRKEKRNQGGSTNDKGKSLDIEEADAGEPDKVHSSKTKQRDTVDSITEQISGIAISESPATATPSTNAANNLQTESSVTEIDKKIRALKKKIRLAEAQVQGDPEKLKPEQLEKTKKIEGWREELKLLESTRGNAAS

SEQ ID NO: 5895 - protein, 223 aa, Triticum aestivum
MDAATDGEQRRLLSIPKEGERVIAPTRRPDGTLRKEIRIRAGYVPQDEVAIYQSKGALMKKSGPDVTPGYDPALDAKPKTKAAKRNERRKEKRHQGGSTNDKGKSLDIEEADAGEPDKVHSSKTKQRNTVDSITEQISGIAISESPATATPSTNAANNLQTESSVTEIDKKIRALKKKIRLAEAQVQGDPEKLKPEQLEKTKKIEGWREELKLLESTRGHAAS

SEQ ID NO: 5896 - protein, 622 aa, Triticum aestivum
HPCRRPRFRLEASLSASTPAPAPATADDGAAAGPCPVVRFDMADFTVADRVSVGLHGRSDEMIFEATVRDPSSELYGSTVVLRQLTSSQAKRRGRRALEVLKKLARRQMMYHSYAMQVHGYVTPSKAMEEGDSPLVLVHGYHGSYSLRHWLQLSDWLPTLEATLALDEEQVRRVGDDSVGGPAVTRQLRLIRILMRDLLIGVNYLHSHGMAHTELRLENVHVSPVDKHVKVGILGNAVDFHDNDPSNSAVASNNERRKMMIAFDMRCVGFIMAKMVLRELMDSSTFQKFKSFLNKGNDPSCLREFLLPILSQNSPSGNIGLQMLDRHWGAGWNLLALLLATKSDKRISCVDALRHPFLCGPKWRISPTVNVVRWGLGSTAVRLAEDYIYGHHQRRRLAYFIELMEVLNPNSSTENWLRLLPGRWCLLYCTGRHIGLTLRQPTPRVLINDAFLTFAEAPESVDPILSLTSDIGFKIMPESDWPHDKSGTEGNLSVTTSARITPGRIYTNAEDGKESSSRITSSRYLGGKWGKAAKMKELPASLPTASVNVDEDDVDVSMSCGSTLNVKSARNVLQEVRTQTPPEMFDLSKIVCGTYIDSRLMVLRGVNGSALLFVRSNRTSDP

SEQ ID NO: 5897 - protein, 648 aa, Panicum virgatum
MPLAAAAAAAGACPIPVGLGRPLCRVHAHPRRRWGFRLEASSSAPAPAPAPAAADEGAGAGPCPVVRFDMDDFAIADRVSVGLHGRSDETIFEATVRDPSSELYGSTVVLRQLKSSQAKRRGRRALEVLKKLARRQMMYHSYALQVHGYIAPGNAVEQEDIPFVLVHGYHGSYSLRHWLQLSDWLPTLEATLALDEEQVRRVGDDSVGGPAVSRQLRLIRILMRDLLIGVNYLHSHGLAHTELRLENVHVSPIDKHVKVGILGNAADFHDNDPSSSTVASNNERRKMMIAFDIRCVGFIMAKMVLRELMDSSTFFKFKSFLTKGNDPSCLREFLLPILCQNSPSGNIGLQMLDRQWGAGWNLLALLLATKPEKRISCLDALRHPFLCGPKWRINPSTSIIRWGLGSTAVRMAEDYIYGSHQRRRLAYFVELMEVLNPNLRTENWLQLLHGRWRLLYCTGRHIGLTLRQPSPRILIIDVFLTVSSDSADPVFSLTSDIGFRIMPESNWPHDKSGTEGVLSVTTSARIAAGRIYINEQDSKESRAASSRSSRRYNRGKWRTASKMKELPASLPSVNIAMDEVDVSMSCNSTLNVNSAQKVLQEIRTQTPPEMFDLSKIVCGTYIDARLMVLRGVNGSALLFVRSNPMIDS

SEQ ID NO: 5898 - protein, 643 aa, Setaria italica
MPLAAAAAVAACPSPVGLARPLCRAYAHPRRPRGFRLEASSSAPAPAAADEGAGAGPCPVVRFDMDNFAIADRVSVGLHGRSDEMIFEATVRDPSSELYGSTVVLRQLKSSQAKRRGRRAIEVLKKLARRQVMYHSYALQVHGYIAPGNAVEQEDVPLVLVHGYHGSYSLRHWLQLSDWLPTLEATLALDEEQVRRVGDDSVGGPAVTRQLRLIRILMRDLLIGVNYLHSHGLAHTELRLENVHVSPIDKHVKVGILGNAADFHDNDPSSSTVASNGERRKMMIAFDMRCVGFIMAKMVLRELMDSSTFFKFKSFLTKGNDPYCLREFLLPILCQNSPSGNIGLQILDRQWGAGWNLLALLLATKPDKRISCVDALRHPFLCGPKWRINPSTSIIRWGLGSTAVRMAEDYIYGHHQRRRLVYFIELMEVLNPNLRTENWLQFLPGRWRLLYCTGRHIGLTLRQPSPRILISDVYLTVSSESIDPVFSLTSDIGFRIMPESDWPHDKSGTEGVLSVTTSARIAAGRIYIHEQDNKETRVTSSRSSRRYLGGKWRKVAKMKELPASLPSVNIATDEVDVSMSCNSALNVNSAQKVLQEIRTQTPPEMFDLSKIVCGTYIDARLMVLRGVNGSALLFTRSNPTTDS

SEQ ID NO: 5899 - protein, 650 aa, Oryza sativa
MPVVAAAAAAVAARPTGAGPARPLRGGVSARPCRRRGFRAEASSSASTPAPVAADEGAGAGPCPVVRFEMGDFDVADRVSVGLHGRSDEMIFEATVRDPSSELYGSTVVLRQLMSFQAKRRGRRALEVLKKLARRQMMYHSYAMQVHGYVTPGNDVEQDDGSFILVHGYHGSYSLRHWLQLSDWLPTLEATLALDEEQVRRVGDDSVGGPAVTRQLRLIRILMRDLLIGVNYLHSHGLAHTELRLENVHVSPIDKHVKVGILGNAVDFHDNDPRNSTLASNDERRKMMIAFDMRCVGFIMAKMVLRELMDSSTFLKFKSFLTKGDDPACLREFLLPILCRNSPSGNIGLQMLDRQWGAGWNLLALLLATKPDKRISCVDALRHPFLCGPKWRINPSVDVIRWGLGSTAVRMAEDYIYGQHQRRRLAYFVELMEVLNPNPRTENWLNILPGHWRLLYCTGRHIGLTLRQPSPRILITDVFLTFAQTSDSIDPVFSLTSDIGFKIMAESDWPHDKSGSEGTLSVTSSARIATGRIYIHEQDGDDSRVASSRSSRRYLRGKWRKVSKMKELPASLPTVNITMDELDVSMSCSSTLNVSSAQKVLQEIRTQTPPEMFDLSKIVCGTYVDARLMILRGVNGSALFFTRSNSRADS

SEQ ID NO: 5900 - protein, 647 aa, Sorghum bicolor
MPLAAAAAAVAACPSPIGLTRPLCRIEAHPRRRRRFRSEASSSASAPAPAAVDEGGGAGPCPVVRFDMADFTVADRVNVGLHGRSDEMIFEATVCDPSSELYGSTVVLRQLKSLQAKRRGRRALEVLKKLARRQMMYHSYALQVHGYIAPCNAVEEEDVPLVLVHGYHGSHSLRHWLQLSDWLPTLEATLALDEEQVRRVGDDSVGGPAVTRQLRLIRILMRDLLIGVNYLHSHGLAHTELRLENVHVSPIDKHVKVGILGNAADFHDNDPSSSTTAINNDRRKMMIAFDMRCVGFIMAKMVLRELMDSSTFFKFKSFLTKGNDPSCLREFLLPTLCQNSTSGNIGLQMLDRQWGAGWNLLALLLATKPEERISCVDALRHPFLCGPKWRINPSANLIRWSLGSTAVRMAEDYIYGHHQRRRLAYFVELMEVLNPNLRTQNWIHLLPGRWRLLYCTGRHIGLTLRQPSPRVLISDVYLTVSSESVDPVFSLTSDTGFRIMPESNWPHDKSGTEGLLFVTTSARIAAGRIYIKEQDSEESRVTSSRSSRRYLHGKWGKVSQMKELPSSLPTVSIAAMDEIDVSMSCDSSLNVNSAQNVLQEIRTQTPPEMFDLTKIVCGTYIDARLMILRGVNGSALLFTRANPTSDP

SEQ ID NO: 5901 - protein, 395 aa, Panicum virgatum
MSLSPQAASRAAARVAEHGGGGRLFAGLAAATSRIASLGRAGDAAAARAVFDAMPRRDAVAWNAMLTAYARAGRPRDALALFTRAPAPDAFSLTAALAAAAALRCHAAGAQLHARLLRIGLRAPLPVGNALVAMYAKCARADDAERAFREMHDRNALSWCSLLHAYVASGHLRLAQDLFDEMPSRNNVAWNTLLMGYSRSGNARQCLILFSKMWMAGLTCDDATLCILVDACTELAHPSTGFAVHKIVVQSGWDAMAEVSNSLISLYTKFSLLDDAVRIFESMEVRTIVSWNSLIDAYMKLGYMEQAASLFRTVPEPNVISWTAMIGGLARNGCADEALRLFVEMLAHDHIRPDDFTFGAVLHACATSVSLASGRAVHGRVFQTGFASYLYVANS

SEQ ID NO: 5902 - protein, 630 aa, Sorghum bicolor
MAAGGGPFAGLVAATSRIASLGRAGDAASARAVFDAMPRRDAVAWNAMLTAYARAGQPRDALALFSRAPAPDAFSLTAALSAAAALRSPTAGAQLHARLLRVGLRALLPVGNSLISMYAKCARAEDAARAFGEMRERNALSWCSLLDAYVASDDLRLAQELFDEMPNRNNVAWNTLLMGYSRSGNANHCLLLFNKMRMAGLTCDDATLCILVDACTELANPSAGSAIHKIVVQSGWNAMAEVSNSLISLYTKFSLLDDAVRIFESMEVQTIVSWNSLIDAYMKLGCVEKATSLFGSVPETNVISWTAMIGGLARNGLADEALILFVEMLAHEHIHPDDFTFGAVLHACATAASLASGRMVHCRVFQSGFVSYLYVANSLIDMYAKCGDLEGGTNVFSTIVNKDLVSWNTMLFGFAINGLPNEALVVYDSMKSHDVCPDEVTFTGLLTACSHSGLLEHGKTFFELMVSVHGIQPKPEHLSCILDMYARSGNITKAMEMLDRYSEMIQTHNSDIREALLSACSLEHLNFSVARKAVKDMVATKSAGDVGYVMLSNLFCATGQWNQAERVRIAMAEYGIKKSPGCSWIEVQGAVKVFVSGAQDLDHSGWDVISLLDGEMRDIMFFDVQSYRSS

SEQ ID NO: 5903 - protein, 427 aa, Panicum virgatum
MGTIGFPVTRTSRSLVAPSSATPQETLHLSVIDRVAGLRHLVRSLHVFDGRRGEAAVRTPAETLRAALGKALVDYYPLAGRFVEEDGEVRVACTAGGAWFVEAAAACTLEEVKHLDHPMVIPKEDLLPEPAPDVNPLDMPLMMQVTEFACGGFVVGLISVHTIADGLGAGQFINAVADYARGLPRPRVLPVWARDVIPAPSRIVSPPPRFDLLDLRYFTVDLSPEHIAKVKSSFFEATGQRCSAFDVCVAKTWQSRVRALRLDGDDPARPVHVCFFANTRHLLPQLAPGFYGNCFYTVRATRPCGEVAAAGVVEVVRAIRDAKARLGADFARWAAGGFERDPYELTFSYDSLFVSDWTRLGFLEADYGWGAPAHVVPFSYHPFMAVAVIGAPPAPKPGARVMTMCVTEKHLPEFQEQMNAFAAGNHQ

SEQ ID NO: 5904 - protein, 427 aa, Panicum virgatum
MGTIGFPVTRTSRSLVAPSSATPQETLHLSVIDRVAGLRHLVRSLHVFDGRRGEAAVRTPAETLRAALGKALVDYYPLAGRFVEEDGEVRVACTAGGAWFVEAAAACTLEEVKHLDHPMVIPKEDLLPEPAPDVNPLDMPLMMQVTEFACGGFVVGLISVHTIADGLGAGQFINAVADYARGLPRPRVLPVWARDVIPAPSRIVSPPPRFDLLDLRYFTVDLSPEHIAKVKSSFFEATGQRCSAFDVCVAKTWQSRVRALRLDGDDPARPIHVCFFANTRHLLPQLAPGFYGNCFYTVRATRPCGEVAAAGVVEVVRAIRDAKARLGADFARWAAGGFERDPYELTFSYDSLFVSDWTRLGFLEADYGWGAPAHVVPFSYHPFMAVAVIGAPPAPKPGARVMTMCVTEKHLPEFQEQMNAFAAGNHQ

SEQ ID NO: 5905 - protein, 438 aa, Panicum virgatum
MGTIGFPVTRRSRSLVAPSSATPQETLRLSVIDRVAGLRHLVRSLHVFDGRRGGEAVVNNNKTPAPAPAETVREALGKALVDYYPLAGRFVEEDGEVRVACTAEGAWFVEAEAACTLEEVKHLDHPMLIPKEDLLPEPPAPDVDPLDMPLMMQVTEFACGGFVVGLISVHTIADGLGAGQFLNAVADYARGLPRPRVSPVWARDLIPAPSRIVSPPPRFELLDLRYFTVDLSPEHIAKVKSIFFEATGQRCSAFDVCVAKTWQSRVRALRLDGGDPARPVHVCFFANTRHLLPQLSAPGGFYGNCFYTVRATRPCGEVAGAGVVEVVRAVRDAKARLAADFARWAAGGFERDPYELTFSYDSLFVSDWTRLGFLEADYGWGAPAHVVPFSYHPFMAVAVIGAPPAPKPGARVMTMCVTEKHLPEFQDQMNAFAAGNHQ

SEQ ID NO: 5906 - protein, 373 aa, Pennisetum glaucum
APSPSPARTLREALGKALVDYYPFAGRFVTEEDGEVRVACTAEGAWFVEAAAECSLEEVKHLDHPMLIPKEDLLPEPEPDVNPLDMPLMMQVTEFTCGGFVVGLISVHTIADGLGAGQFINAVADYARGLPKPRVAPVWARDVIPAPSQIASEPPRFELFDLRYFTVDLGPDHIAKVKSSFFEATGQRCSAFDVCVAKTWQSRVRALRLDADDPSRPVHVCFFANTRHLLPPTPGFYGNCFYTVKATRPCGEVAAAGVVEVVRAIRDAKARLGADFARWAAGGFERERDPYQLTFTYDSLFVSDWTRLGFLEADYGWGTPAHVLPFSYHPFMAVAVIGAPPAPKQGARVMTMCVTEKHLPEFQEQMNAFAAGN

SEQ ID NO: 5907 - protein, 432 aa, Saccharum officinarum
MGTIDDTAGLFSVMRTSRSLVPPSSATPRETLHLSVIDRVAGLRHLVRSLHVFENKKAAGTTPAAPKPAKALREALGKALVDYYPFAGRFEEEDGETRVACTGEGAWFVEAAAACSLEEVRHLDHPMLIPKEELLPEPAPGVNPLDMPLMMQVTEFTCGGFVVGLISVHTIADGLGAGQFINAVADYARGVTKPRITPIWARDVIPDPPKMPAPPPRLDLLDLVYFTTDLSPDHIAKVKSRYLEATGQRCSAFDVCVARTWQARVRALAIPDPAAPVHVCFFANTRHLLPATAAPASGFYGNCFYTVKATRPSGEVAAADVVEVVRAVRDAKARLAADFARWAAGGFDRDPYELTFTYDSLFVSDWTRLGFLEADYGWGTPTHVVPFSYHPFMAVAVIGAPPAPKPGARIMTMCVQEQHLPEFQEQMNQPSW

SEQ ID NO: 5908 - protein, 290 aa, Cenchrus ciliaris
  misc_feature (135)..(135): Xaa can be any naturally occurring amino acid
MAATPPPPAAALEQLSSNKMFGGRNLRFRHQSATLGCPMTFSVYLPPSPASSIPVLYWLSGLTCTDENFIIKAGAQRAAAAHGIALVAPDTSPRGLNIEGESDSYDFGVGAGFYLNATNEKWKNWRMYDYVVKEXPKVLSDHFEQFNTTQASIFGHSMGGHGALTIYLKNTDKYKSVSAFAPIANPINCPWGQKAFSNYLGSTKSDWEEYDATCLVKKNNKVSSPILIDQGEDDKFLAEQLLPRNFEEACKAVGVPLILRMQPGYDHSYFFIATFVDDHIAHHAQFLKSA

SEQ ID NO: 5909 - protein, 290 aa, Panicum virgatum
MAATHPAYPAEVEQLSSNKMFGGRNLRLRHQSATLGCPMTFSVYLPPSPASNVPVLYWLSGLTCTDENFIIKAGAQRAAAAHGIALVAPDTSPRGLNIEGESDSYDFGVGAGFYLNATNEKWKNWRMYDYVVKELPKVLNEHFVLLNTKQASIFGHSMGGHGALTIYLKNTNKYKSVSAFAPIVNPINCPWGQKAFSNYLGSSKSDWEEYDATCLIKKNNKVSTPILIDQGEDDKFLAEQLLPYNFEEACKAAGVPLVLRMQPGYDHSYFFIATFIDDHIAHHAQFLKSA

SEQ ID NO: 5910 - protein, 288 aa, Panicum virgatum
MAARPPTTEVELLSTNKMFGGHNLRYRHQSATLGCPMTFTVYLPPSPASNVPVLYWLSGLTCTDENFIIKAGAQRAAAAHGIALVAPDTSPRGLNIEGESDSYDFGVGAGFYLNATNEKWKNWRMYDYVVKELPKVLSDHFEQLNISQASISGHSMGGHGALTIYSKNTDKYKSVSAFAPIVNPINCPWGQKAFSNYLGSTKSDWEEYDATCLIKKNSKVSTPILIDQGEDDKFLAEQLLPRNFEEACKAAGVPLILRMQPGYDHSYFFVATFIDDHIAHHAQFLKSA

SEQ ID NO: 5911 - protein, 290 aa, Panicum virgatum
MAATPPAYTTEVEQLSTNKMFGGHNLRLRHQSATLGCPMTFSVYLPPSPASNVPVLYWLSGLTCTDENFIIKAGAQRAAAAHGIALVAPDTSPRGLNIEGESDSYDFGVGAGFYLNATNEKWKNWRMYDYVVKELPKVLNEHFVLLNTKQASIFGHSMGGHGALTIYLKNTNKYKSVSAFAPIVNPINCPWGQKAFSNYLGSSKSDWEEYDATCLIKKNNKVSTPILIDQGEDDKFLAEQLLPYNFEEACKAAGVPLVLRMQPGYDHSYFFIATFIDDHIAHHAQFLKSA

SEQ ID NO: 5912 - protein, 273 aa, Pennisetum glaucum
NKMFGGRNLRFRHQSATLGCPMTFSVYLPPSPASSIPVLYWLSGLTCTDENFVIKAGAQRAAAAHGIALVAPDTSPRGLNIEGESDSYDFGVGAGFYLNATNEKWKNWRMYDYVVKELPKVLSDHFEQLNTTQASIFGHSMGGHGALTIYLKNTDKYKSVSAFAPIVNPINCPWGQKAFSNYLGSSKSDWEEYDATCLVKKNSKVLAPILIDQGEDDKFLAEQLLPRNFEEACKAVGVPLVLRMQPGYDHSYFFIATFVDDHIAHHAQFLKSA

SEQ ID NO: 5913 - protein, 290 aa, Zea mays
MAVAPPTAAALEQLSSSKMFDGFNLRFRHQSATLGCAMTFSIYLPPSPASNLPVLYWLSGLTCTDENFIIKSGAQRAAAAHGIALVAPDTSPRGLNIEGESDSYDFGVGAGFYLNATNEKWKNWRMYDYIVKELPKVLSDNFEQLNTSQASIFGHSMGGHGALTIYLKNTDKYKSVSAFAPIANPINCPWGQKAFSNYLGSTKSDWEEYDATCLIKKNSKVPTTILIDQGEADKFLAEQQLLPHKFEEACKAAGAALTLRMQPGYDHSYYFIATFVDDHIAHHAQFLKSA

SEQ ID NO: 5914 - protein, 284 aa, Saccharum officinarum
MAAALEQLSSSKMFDGFNLRFRHQSATLGCAMTFSIYMPPSPASNIPVLYWLSGLTCTDENFIMKSGAQRAAAAHGIALVVPDTSPRGLNIEGESDSYDFGVGAGFYLNATNEKWKNWRMYDYVVKELPKVLSGNFEQLNTSQASIFGHSMGGHGALTIYLKNTDKYKSVSAFAPIANPINCPWGQKAFSNYLGSTKSDWEEYDATCLIKKNNNVSTPILIDQGDADKFLAEQQLLPHNFEEACKAVGATLILRMQPGYDHSYYFIATFMDDHIAHHAQFLKSA

SEQ ID NO: 5915 - protein, 290 aa, Avena sativa
MAAAAPPPAAALEQLSKTRMFGGHNLRFRHQSATLGCPMTSSLFLPASPASKLPVLYWLSGLTCTDENFIIKSGVQRAAAAHGIAIVAPDTSPRGLNVEGEADSWDFGVGAGFYLNATNEKWKNWRMYDYVVKELPNVLSDNFEQLNTSCASISGHSMGGHGALTIYLKNTDKYKSVSAFAPIANPISCPWGQKAFSNYLGSAKSEWEEYDATCLIKKSNGVSTSILIDQGDDDKFLAEQLLPGNFEEACKAAGVPLTLRMQPGYDHSFFFIATFVDDHIAHHAQFLKSA

SEQ ID NO: 5916 - protein, 290 aa, Triticum aestivum
MAAAAPPPAAALEQLSKTKMFGGHNLRFRHQSASLGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPKVLTDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNFEEACKAAGAPLILRMQPGYDHSFFFIATFIDDHIAHHAQFLKSG

SEQ ID NO: 5917 - protein, 290 aa, Secale cereale
MAAAAPLPAAALEQLSKTKMFGGHNLRFRHQSAALGCPMTFSLFLPASPPSKLPVLYWLSGLTCTDENFIIKSGAQRAAAAHGVALVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNLEEACKAVGAPLTLRMQPGYDHSFFFIATFIDDHIAHHAQFLKSG

SEQ ID NO: 5918 - protein, 284 aa, Sorghum bicolor
MAAALEQLSRSKMFDGFNLRFRHQSATLGCAMTFSIYMPPSPASNIPVLYWLSGLTCTDENFIMKSGAQRAAAAHGIALVSPDTSPRGLNIEGESDSYDFGVGAGFYLNATNEKWKNWRMYDYVVKELPKVLSDNFEQLNTSQASIFGHSMGGHGALTIYLKNTDKYKSVSAFAPIANPINCPWGQKAFSNYLGPTKSDWEEYDATCLIKKNSNVPTPILIDQGDADKFLAEQQLLPHNFEEACKAVGATLILRMQPRYDHSYYFIATFMDDHIAHHAKFLKSA

SEQ ID NO: 5919 - protein, 282 aa, Festuca arundinacea
AAVLEQLSKTKMFGGHNLRFRHQSATLGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPEVLSDNFEQLNMSCASIFGHSMGGHGALTIYLKNTDKYKSVSAFAPIANPINCPWGQKAFSNYLGSAKSEWEEYDATCLIKKSNGVSTSILIDQGEDDKFLAEQLLAGNFEEACKAAGVPLNLRMQPGYDHSFFFIATFIDDHIAHHAQFLKSA

SEQ ID NO: 5920 - protein, 284 aa, Leymus cinereus x Leymus triticoides
  misc_feature (283)..(283): Xaa can be any naturally occurring amino acid
PPAAALEQLSKTKMFGGHNLRFRHQSASLGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATFLVKKCNTLSTSILIDQGEDDKFLAEQLLAGNFEEACKAAGAPLILRMQPGYDHSFFFIATFIDDHIAHHAQFLKXA

SEQ ID NO: 5921 - protein, 284 aa, Pseudoroegneria spicata
PPAAALEQLSKTKMFGGHNLRFRHQSAALGCPMTFSLFLPASPASKLPVLYWLSGLTCTDENFIIKSGAQRAAAAHGVVLVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNFEEACKAAGAPLILRMQPGYDHSFFFIATFIDDHIAHHAQFLKSA

SEQ ID NO: 5922 - protein, 291 aa, Brachypodium distachyon
MAAAAPPPPAAAPAQLSKSKMFGGHILRFRHHSAALGCPMTFSLFVPASPASNLPVLYFLSGLTCNDENFVIKSGAQRAAAAHGIALVAPDTSPRGLNIEGEADSWDFGVGAGFYLNATNEKWKNWRMYDYVVKELPKVLSDNFEQLNTSRASIFGHSMGGHGALTIYLKNTDKYKSVSAFAPIANPINCPWGQKAFTNYLGTTKSEWEDYDATCLIKKCNGVSTPILIDQGDDDKFLAEQLLPGNFEEACKAAGVPLTLRMQPGYDHSFFFIATFIDDHIAHHAQFLKSA

SEQ ID NO: 5923 - protein, 283 aa, Secale cereale
PAAALEQLSKTKMFGGHNLRFRHQSASLGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPKVLNDNFEQLNTACASIFGHSMGGHGALTIYLKNTDKYKSVSAFAPIANPINCPWGQKAFSNYLGTTKSEWEEYDATLLVKKCNTLSTPILVDQGEDDKFLAEQLLAGNLEEACKAAGAPLVLRMQPGYDHSFFFIATFIDDHIAHHAQFLKSA

SEQ ID NO: 5924 - protein, 289 aa, Secale cereale
MAAAAPLPRRARAAEQDQDVRGHNLRFRHQSASLGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNLEEACKAAGAPLVLRMQPGYDHSFFFIATFIDDHIAHHAQFLKSG

SEQ ID NO: 5925 - protein, 271 aa, Secale cereale
MFGGHNLRFRHQSAALGCPMTFSLFLPASPPSKLPVLYWLSGLTCTDENFIIKSGAQRAAAAHGVALVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNFEEACKAAGAPLTLRMQPGYDHSFFFIATFIDDHIAHHAQFLKSG

SEQ ID NO: 5926 - protein, 284 aa, Pennisetum glaucum
MEPGAGTALYPLHRCKTIYLVRHAQGIHNVAGEKDFSAYKSYDLFDAQLTPLGWSQVDGLREHVKKSGLAKKIELVITSPLLRTMQTAVGVFGGENYTDGVNAPPLMVENAGHSGRQAVSSLNCPPFLAVETCREHLGVHPCDKRRSITEYRPLFPAIDFSLIENDEDVLWEPDVREENEAVGLRGMKFIDWLWTREEKEIAIVSHSGFLYHTLNMYSKECHPTIRDEVGKHFANCELRSMVLVDRSMLGSDSPSFNYPGKIPAGLDLPSDVADEKHLEETQKN

SEQ ID NO: 5927 - protein, 284 aa, Panicum virgatum
MEPIAGTALYPLHRCKTIYLVRHAQGIHNVAGEKDFNAYMSQDLFDAQLTPLGWSQVDGLREHVKKSGLAKKIELVITSPLLRTMQTAVGVFGGENYTDGVSAPPLMVENAGHSGRPAVSSLNCPPFLAVETCREHLGVHPCDKRRSITEYRPLFPAIDFSLIENDEDVLWEPDVREANESVTLRGMKFFDWLWTREEKEIAIVSHSGFLYHTLSTYSKECHPTIRDEVGKHFANCELRSMVLVDRSMLGSDSSSFNYPGKIPAGLDLPSDVADKKHVEEAQKN

SEQ ID NO: 5928 - protein, 284 aa, Sorghum bicolor
MEPGATTALYPLHRCKTIYLVRHAQGIHNVAGEKDFGAYMSHDLFDAQLTPLGWSQVDGLREHVKKSGLAEKIELVISSPLLRTMQTAVGVFGGEKYTDGVNAPPLMVENAGHSGRPAVSSLNCPPFIAVETCREHLGVHPCDKRRSITEYRPLFPAIDFSLIENDEDVLWEPDVREANEAVALRGMKFMDWLWTREEKEIAIVSHSGFLFHTLSMYSKECHPTIRDEVSKHFANCELRSMVLVDRSMLGSYSPRFNYPGKIPAGLDLPSDIADKKLVEEAEKN

SEQ ID NO: 5929 - protein, 284 aa, Zea mays
MELGATTALYPLHRCKTIYLVRHAQGIHNVAGEKDFGAYMSHELFDAQLTPLGWNQVDGLREHVKKSGLAEKIELVITSPLLRTMQTAVGVFGGEKYTDGVNAPPLMVENAGHSGRPAVSSLNCPPFIAVETCREHLGVHPCDKRRSITEYRPLFPAIDFSLIENDGDVLWEPDVRETNEAVALRGMKFMDWLWTREEKEIAIVSHSGFLFHTLSMYSKECHPTIRDEVSKHFANCELRSMVLVDRSMLGSYSSRFNYAGKNPTGLDVPSDIADKKQVDEAQKN

SEQ ID NO: 5930 - protein, 284 aa, Zea mays
MELGATTALYPLHRCKTIYLVRHAQGIHNVAGEKDFGAYMSHELFDAQLTPLGWNQVDGLREHVKKSGLAEKIELVISSPLLRTMQTAVGVFGGEKYTDGVNAPPLMVENARHSGRPAVSSLNCPPFIAVETCREHLGVHPCDKRRSITEYRPLFPAIDFSLIENDEDVLWEPDVREPNEAVALRGMKFMDWLWTREEKEIAIVSHSGFLFHTLSMYSKECHPTISDEVSKHFANCELRSMVLVDRSMLGSYSSRFNYAGKNPTGLDVPSDIADKKQVDEAQKN

SEQ ID NO: 5931 - protein, 284 aa, Triticum aestivum
MEAGAGTALYPAHRCKTIYLVRHAQGIHNVEGEKDFAAYKSHALLDAQLTPLGWSQVDTLREHVTKSGLAKKIELVIVSPLLRTMQTAVGVFGGGNYTDGASASPLMVEGAGNSGRQPISSLNCPPFLAVEACREHLGVHPCDKRSSITKYRTLFPAIDFSLIENDEDVLWEPDVRETNESVALRGMKFFDWLWTREEKEIAIVSHSGFLYHTLNMYGKECHPTIAEELGKHFANCELRSMVLVDRSNLGSDASKYNFAGKIPTGLDMPSDVADEKEAEEASKN

SEQ ID NO: 5932 - protein, 284 aa, Hordeum vulgare
MEASAGTALYPAHRCKTIYLVRHAQGIHNVEGEKDFAAYKSHALLDAQLTPLGWSQVDTLREHVTKSGLAKKIELVVVSPLLRTLQTAVGVFGGGNYTDGASASPLMVEGAGNSGRQPISSLNCPPFLAVEACREHLGVHPCDKRSSITKYRTLFPAIDFSLIENDEDVLWEPDVRETNESVALRGMKFFDWLWTRKEKEIAIVSHSGFLYHTLNMYGKECHPTIAEELGKHFANCELRSMVLVDRSNLGSDSSTYNFAGKIPAGLDMPSDVADEKHAEEASKN

SEQ ID NO: 5933 - protein, 284 aa, Brachypodium distachyon
MAATAGTAIYPLHRSKTIHLVRHAQGIHNVEGEKDHAAYMSPALLDAHLTPLGWSQVDSLREHVTKCGLAKKIELVITSPLMRTMQTAVGVFGGGNYADGVSVSPLMVEGAGHSGREAISSLNCPPFLAVETCREHLGVHPCDKRSSVTEYRSLFPAIDFSLIENDEDVLWEPDVREANESVAARGMKFFDWLWTREEKEIAIVSHSGFLYHTLNMYGKECHPTITEELGKHFANCELRSMVLVDRSMLGSHSPTCNFPGKTPAGLDLPSDVADKKHLEEAQKN

SEQ ID NO: 5934 - protein, 284 aa, Secale cereale
MEASAGTALYPAHRCKTIYLVRHAQGIHNVEGEKDFAAYKSHALLDAQLTPLGWSQVDTLRDHVTKCGLAKKIELVIVSPLLRTMQTAVGVFGGGNYTDGASATPLMVEGAGNSERQLISSLNCPPFLAVEACREHLGVHPCDKRSSITKYRTLFPAIDFSLIENDEDVLWEPDVRETNESVALRGMKFFDWLWTREEKEIAIVSHSGFLYHTLNKYGKECHPTIAEELGKHFANCELRSMVLVDRSNLGSDTSTYNFAGKIPTGLDMPSDVADEKQAEEASKN

SEQ ID NO: 5935 - protein, 284 aa, Secale cereale
MEASAGTALYPAHRCKTIYLVRHAQGIHNVEGEKDFAAYKSHALLDAQLTPLGWSQVDTLRDHVTKCGLLKKIELVIVSPLLRTMQTAVGVFGGGNYTDGASASPLMVEGAGNSGRQPISSLNCPPFLAVEACREHLGVHPCDKRSSITKYRTLFPAIDFSLIENDEDVLWEPDVRETNEAVALRGMKFFDWLWTREEKEIAIVSHSGFLYHTLNKYGKECHPTIAEELGKHFANCELRSMVLVDRSNLGSDSSTYNFAGKIPTGLDMPSDVADEKQAEEASKN

SEQ ID NO: 5936 - protein, 284 aa, Triticum aestivum
MEAGAGTALYPAHRCKTIYLVRHAQGIHNVEGEKDFAAYKSHALLDAQLTPLGWSQVDTLRDHVTKCGLAKKIELVIVSPLLRTIQTAVGVFGGGNYIDGASASPLMVEGAGNSERQPISSLNCPPFLAVEACREHLGVHPCDKRSSITKYRTLFPAIDFSLIENDEDVLWEPDVRETNESVALRGMKFFDWLWTREEKEIAIVSHSGFLYHTLNMYGKECHPTIAEELGKHFANCELRSMVLVDRSNLGSDASKYNFAGKIPTGLDMPSDVADEKQAEEASKN

SEQ ID NO: 5937 - protein, 284 aa, Triticum aestivum
MEAGAGTALYPAHRCKTIYLVRHAQGVHNVEGEKDFAAYKSQALLDAQLTPLGWSQVDTLRDHVTKCGLAKKIELVIVSPLLRTMQTAVGVFGGGSYTDGASASPLMVEGAGNSGRQPISSLNCPPFLAVEACREHLGVHPCDKRSSVTKYRTLFPAIDFSLIENDEDVLWEPDVRETNESVALRGMKFFDWLWTREEKEIAIVSHSGFLYHTLNMYGKECHPTIAEELGKHFANCELRSMVLVDRSNLGSDTSKYNFAGKIPTGLDMPSDVADEKEAEEASKN

SEQ ID NO: 5938 - protein, 284 aa, Secale cereale
MEASAGTALYPAHRCKTVYLVRHAQGIHNVEGEKDFAAYKSHALLDAQLTPLGWSQVDTLRDHVTKCELSKKIELVIVSPLLRTMQTAVGVFGGGNYTDGASATPLMVEGAGNSERQPISSLNCPPFLAVEACREHLGVHPCDKRSSITKYRTLFPAIDFSLIENDEDVLWEPDVRETNESVALRGMKFFDWLWTREEKEIAIVSHSGFLYHTLNKYGKECHPTIAEELGKHFANCELRSMVLVDRSNLGSDSSTYNFAGKIPTGLDMPSDIADEKHAEEASKN

SEQ ID NO: 5939 - protein, 284 aa, Secale cereale
MEASAGTALYPAHRCKTVYLVRHAQGIHNVEGEKDFAAYKSHALLDAQLTPLGWSQVDTLRDHVTKCGLSKKIELVIVSPLLRTMQTAVGVFGGGNYTDGASASPLMVEGAGNSERQPISSLNCPPFLAVEACREHLGVHPCDKRSSITKYRTLFPAIDFSLIENDEDVLWEPDVRETNESVALRGMKFFDWLWTREEKEIAIVSHSGFLYHTLNKYGKECHPTIAEELGKHFANCELRSMVLVDRSNLGSDTSTYNFAGKIPTGLDMPSDVADEKEAEEASKN

SEQ ID NO: 5940 - protein, 275 aa, Oryza sativa
MDANPPTTAMYPLHRCKTIYLVRHAQGVHNVEGEKDHSAYMSPQLFDAHLTPLGWNQVDCLREHVKKSGLAQKIELVITSPLLRTMQTAVGVFGGENSVDGVSAPPLMVENAGHSSRPAISSLNCPPFLAFEACREHLGVHPCDKRRSITEYRALFPAIDFSLIENDEDVLWEPNVREANSSVAARGMKFIDWLWTREEKEIAIVSHSGFLYHTLSMYSRECHPTIREEVGKHFANCELRSMVLVDTSMLGSDSPSYNYPGSIPAGLDLPSDAAP

SEQ ID NO: 5941 - protein, 245 aa, Panicum virgatum
GSQDLFDAQLTPLGWSQVDGLREHVKKSGLAKKIELVITSPLLRTMQTAVGVFGGENYTDGVSAPPLMVENAGHSGRPAVSSLNCPPFLAVETCREHLGVHPCDKRRSITEYRPLFPAIDFSLIENDEDVLWEPDVREANESVALRGMKFFDWLWTREEKEIAIVSHSGFLYHTLSTYSKECHPTVRDEVGKHFANCELRSMVLVDRSMLGSDSPSFNYPGKIPAGLDLPSDVADKKHVEEAQKN

SEQ ID NO: 5942 - protein, 277 aa, Triticum aestivum
ALYPAHRCKTIYLVRHAQGVHNVEGEKDFAAYKSQALLDAQLTPLGWSQVDTLRDHVTKCGLAKKIELVIVSPLLRTMQTAVGVFGGGSYTDGASASPLMVEGAGNSGRQPISSLNCPPFLAVEACREHLGVHPCDKRSSITKYRTLFPAIDFSLIENDEDVLWEPDVRETNESVALRGMKFFDWLWTREEKEIAIVSHSGFLYHTLNMYGKECHPTIAEELGKHFANCELRSMVLVDRSNLGSDASRYNFAGKIPTGLDMPSDVADEKQAEEASKN

SEQ ID NO: 5943 - protein, 289 aa, Panicum virgatum
MELSAGTAIYPLHRCKTIHLVRHAQGVHNVEGDKDHSAYMKPEFFDACVTPLGWNQVDCLREHVKKSGLAEKIELVICSPLLRTMQTAVGVFGGENYTNGISAPPLMVENAADSGRPAISNLNCPPFLAVETCRERLGANPCDKRRSITEYRTLFPAIDFSLIENDEDVLWVPDVRETFESLGERGRKFIDWLWTREEKEIAIVTHSGLLWHTLRMDSKECHPTVRHEVSKYFANCELRSLVLVDRSMLGSDSPSYNYPGKIPDGVDLPSDVADKKQLEEEAQERTEPV

SEQ ID NO: 5944 - protein, 249 aa, Saccharum officinarum
MELGASTALYPLHRCKTIYLVRHAQGIHNVAGEKDFSAYMSHDMFDAQLTPLGWSQVDGLREHVKKSGLAEKIELVISSPLLRTMQTAVGVFGGEKYTDGVNSPPLMVENAGHSGRPAVSSLNCPPFIAVEACREHLGVHPCDKRRSITEYRPLFPAIDFSLIENDEDVLWEPDVRETNEAVALRGMKFLDWLWTREEKEIAIVSHSGFLFHTLSMYSKECHPTVRDEVSKHFANCELRSMVLVDRSML

SEQ ID NO: 5945 - protein, 424 aa, Pennisetum glaucum
MAEARQLRSFVEVPAGSHFPIQNLPFGVFRRRGSSQPRPAVAIGDFALDLAAVADAGLFDGPALAGSTCFHQETLNVFLGMGRPAWKEARATLQKILSADEPVLRDNEALRKKCLVPISDIEMIMPITVGGYTDFFCSVHHARNCGFIFRGPQTPVNPNWFHLPIGYNGRASSVVVSGTDVIRPRGQGHPTGNSAPYFGPSRKLDFELEMAAIVGPGNELGKPIDINDAEEHIFGLALMNDWSARDIQAWETIPLGPFLGKSFSTTISPWIVTLDALKPFTCEAPKQEPEPLPYLAEKNHINYDIPLEVWIKPKDQSDASIVSKTNFKHLYWTVTQQLAHHTINGCNMRPGDIFATGTLSGPEPESLGCLLELTWNGQKDIAVGNSTRKFLEDGDEVILTGCCKGEGYNIGFGTCTGKVLPALP

SEQ ID NO: 5946 - protein, 426 aa, Panicum virgatum
MAGAEQQLRSFVEVPAGSHFPIQNLPFGVVRRRGSRAPPRPAVAIGDLALDLAAVADAGLFDGPALAGSPCFHQETLNMFLGMGRPAWKEARATLQKILSADEPVLRDNEALRSKCLVPMSDIEMVLPITVGGYTDFFCSVHHARNCGFIFRGPQTPVNPNWFHLPIGYNGRASSVVVSGTDVIRPRGQGHPTGNSSPYFGPSQKLDFELEMAAIVGPGNELGKPIDINNAEDHIFGLALMNDWSARDIQAWETIPLGPFLGKSFSTTISPWIVTLDALKPFTCEAPKQEPEPLPYLAEKNHVNYDIPLEVWIKPKDQSDASIVAKTNFKHLYWTVTQQLAHHTINGCNMRPGDIFATGTLSGPEPESLGCLLELTWNGQKEIPVGNSTRKFLEDGDEVILTGCCKGEGYNIGFGTCTGKVLPALP

SEQ ID NO: 5947 - protein, 425 aa, Panicum virgatum
MAGAGQLRSFVEVPAGSHFPIQNLPFGVFRRRGSRAPPRPAVAIGDLALDLAAVADAGLFDGPALAGSPCFHQETLNMFLGMGRPAWKEARATLQKILSADEPVLRDNEALRSKCLVPMSDIEMVLPITVGGYTDFFCSVHHARNCGFIFRGPQTPVNPNWFHLPIGYNGRASSVVVSGTDVIRPRGQGHPTRNSGPYFGPSQKLDFELEMAAIVGPGNELGKPIDINNAEDHIFGLALMNDWSARDIQAWETIPLGPFLGKSFSTIISPWIVTLDALKPFTCEAPKQEPEPLPYLAEKNHVNYDIPLEVWIKPKDQSDASIVAKTNFKHLYWTVTQQLAHHTINGCNMRPGDIFATGTLSGPEPESLGCLLELTWNGQKEIPVGNSTRKFLEDGDEVILTGCCKGEGYNIGFGTCTGKVLPALP

SEQ ID NO: 5948 - protein, 427 aa, Zea mays
MAEPSQQLRSFVEVPAGSHFPIQNLPFGVFRRRGVQAQAPRPAVAIGDFALDLAAVADAGLFDGPALSGSPCFHQETLNMFLGMGRPAWREARATLQKILSADEPVLRDNEALRNKCLVPMSDIEMVLPITVGGYTDFFCSVHHAMNCGFIFRGPQTPVNPNWFYLPVGYNGRASSIVVSGTNVIRPRGQGHPTGNSAPYFGPSQKLDFELEMAAIVGPGNELGKPIDINDAEEHIFGLTLMNDWSARDIQAWETIPLGPFLGKSFSTTVSPWIVTLDALKPFMCDAPKQEPEPLPYLAEKNHINYDIPLEAWIKPKDQNDASIVTKTNFKHLYWTLTQQLAHHTINGCNMRPGDIFATGTLSGPEPDSLGCLLELTWNGQKEIPVGNLTRKFLEDGDEVILTGCCKGEGYNIGFGTCTGKVLPALP

SEQ ID NO: 5949 - protein, 428 aa, Zea mays
MAEPGQQLLRSFVEVAAGSHFPIQNLPFGVFRRRGSPPQAPLPPVAIGDFALDLATVADAGLFDGPALSGSPCFHQETLNMFLGMGRPAWREARATLQKILSADEPVLRDNEALRNKCLIPMSDIEMVLPITVGGYTDFFCSVHHARNCGFIFRGPQTPVNPNWFYLPIGYNGRASSIVVSGTDVIRPRGQGHPTGNSAPYFGPSQKLDFELEMAAIVGPGNELGKPIDINDAEEHIFGLTLMNDWSARDIQAWETIPLGPFLGKSFSTTISPWIVTLDALKPFMCEAPKQEPEPLPYLAEKNHINYDIPLEVLIKPKDQNVALIVTKTNFKHLYWTVTQQLTHHTINGCNMRPGDIFATGTLSGPEPDSLGCLLELTWNGQKEIPVGNLTRKFLEDGDEVILTGCCKGEGYNIGFGTCTGKVLPALP

SEQ ID NO: 5950 - protein, 432 aa, Sorghum bicolor
MAEPSQQLLRSFVEVPAGSHFPIQNLPFGVFRRQGSAQAQAQAPRPAVAIGDFALDLAAVADAGLFDGPVLSGSPCFHQETLNMFLGMGRPAWREARATLQKILSADEPVLRDNEALRNKCLVPMSDIEMVLPITVGGYTDFFCSVHHARNCGFIFRGPQTPVMPNWFYLPIGYNGRASSIVVSGTDVIRPRGQGHPTGNSSAPYFGPSQKLDFELEMAAIVGPGNELGKPIDINDAEEHIFGLTLMNDWSARDIQAWETIPLGPFLGKSFSTTISPWIVTLDALKPFMCDAPKQEPEPLPYLAEKNHINYDIPLEVWVKPKGQNDASVVTKTNFKHLYWTVTQQLTHHTINGCNMSPGDIFATGTLSGPEPESLGCLLELTWNGQNEIPVGNSTRKYLEDGDEVILTGCCKGEGYNVGFGTCTGKVLPALP

SEQ ID NO: 5951 - protein, 430 aa, Saccharum officinarum
MAEPSQEQLLRSFVEVPAGSHFPIQNLPFGVFRRRGSQAQAPRPAVAIGDFALDLAAVADAGLFDGPVLSGSPCFHQETLNMFLGMGRPAWREARATLQKILSADEPVLRDNKALRNKCLVPMSDIEMVLPITVGGYTDFFCSVHHARNCGFIFRGPQTPVMPNWFYLPIAYNGRASSIVVSGTDVIRPRGQGHPTGNSSAPYFGPSQKLDFELEMAAIVGPGNELGKPIDINDAEEHIFGLTLMNDWSARDIQAWETIPLGPFLGKSFSTTISPWIVTLDALKPFMCDAPKQEPEPLPYLAEKNHINYDIPLEVWVKPKGQNDASIVTKTNFKHLYWTVTQQLTHHTINGCNMSPGDIFATGTLSGPEPDSLGCLLELTWNGQNEIPVGNSTRKYLEDGDEVILTGCCKGEGYNVGFGTCTGKVLPALP

SEQ ID NO: 5952 - protein, 429 aa, Oryza sativa
MAEGSRSPLRSFVEVAPGSHFPIQNLPFGVFRRRGSPEPEPPRPAVAIGDFALDLAAVSDAGLFHGPLLSASPCFRQETLNMFLGMGRPAWKEARATLQKILSADEPVLRDNEALKKKCLVPMSDTEMLLPITVGDYTDFFCSVHHARNCGFIFRGPQTPVNPNWFQLPVGYHGRASSVIVSGTDIIRPKGQGHPTGDSRPYFGPSKKLDFELEMAAIVGPGNELGKPIDINDAEEHIFGLMIMNDWSARDIQAWETIPLGPFLGKSFSTTVSPWIVTMDALKPFTCEAPKQEPEPLPYLAEKNHVNYDIPLEVWIKPKEQSEPSMVAKSNFKHLYWTLTQQLAHHTVNGCNLRPGDMFATGTLSGPETESLGCLLELTWNGQKEISVGNSTRKFLEDGDEVILTACCKGEGYNVGFGTCTGKVLPALP

SEQ ID NO: 5953 - protein, 426 aa, Hordeum vulgare
MAEAKLLRSFVEVPRDSHFPIQNLPFGVFRRRGQPEDPPRPATAIGDFALDLAAVSAAGLFDGPLLSASPCFRQETLNMFLGLGRPAWKEARATLQKILSADEPVLRDNEALRKNCLVPMSDVEMLLPITVGDYTDFFCSVHHARNCGFIFRGPQTPVNPNWFHLPVGYHGRASSVIISGTDIIRPRGQGHPTGSSQPYFGPSQKLDFELEMAAIVGPGNELGKPIDIADAEDHIFGLVVMNDWSARDIQAWETIPLGPFLGKSFSTSVSPWIVTLDALKPFACEAPKQEPEPLPYLAEKDHINYDIPLEAWIKPKEQSDASIVTKTNFKHMYWTVTQQLAHHTVNGCNLRPGDMFATGTLSGPEPDSLGCLLEITWNGQKEISVGNSTRKFLQDGDEVILTACCKGEDYNVGFGTCTGKIVPSLP

SEQ ID NO: 5954 - protein, 425 aa, Secale cereale
MAEGKLRSFVEVPRESHFPIQNLPFGVFRRRGQPEGPPRPATAIGDFALDLAAVSAAGLFDGPLLSASPCFHQETLNMFLGLGRPAWKEARATLQKILSADEPVLRDNEALRKNCLVPMSDVEMLLPITVGDYTDFFCSVHHARNCGFIFRGPQTPVNPNWFHLPVGYHGRASSVIISGTDIIRPRGQGHPTGSSQPYFGPSQKLDFELEMAAIVGPGNELGKPIDIADAEDHIFGLVVMNDWSARDIQAWETIPLGPFLGKSFSTSVSPWIVTLDALKPFACEAPKQEPEPLPYLAEKNHINYDIPLEAWIKPKEQSDASVVTKTNFKHMYWTVTQQLAHHTVNGCNLRPGDMFATGTLSGPEPDSLGCLLEITWNGQKEISVGNSVRKFLQDGDEVILTACCKGEDYNVGFGTCTGKILPPLP

SEQ ID NO: 5955 - protein, 427 aa, Triticum aestivum
MAEGKLLLRSFVEVPRDSHFPIQNLPFGVFRRRGQPEGPPRPATAIGDFALDLAAVSAAGLFDGPLLSASPCFHQETLNMFLGLGRPAWKEARATLQKILSADEPVLRDNEALRKNCLVPMSDVEMLLPITVGDYTDFFCSVHHARNCGFIFRGPQTPVNPNWFHLPVGYHGRASSVIISGTDIIRPRGQGHPTGSSQPYFGPSQKLDFELEMAAIVGPGNELGKPIDIADAEDHIFGLVVMNDWSARDIQAWETIPLGPFLGKSFSTSVSPWIVTLDALKPFACEAPKQEPEPLPYLAEKNHINYDIPLEAWIKPKEQSDASIVTKTNFKHMYWTVTQQLAHHTVNGCNLRPGDMFATGTLSGPEPDSLGCLLEITWNGQKEISVGNSIRKFLQDGDEVILTACCKGEDYNVGFGTCTGKILPSLP

SEQ ID NO: 5956 - protein, 426 aa, Avena sativa
MAEAKLLRSFVEVARDSHFPIQNLPFGVFRRRGQPADPPRPAVAIGDFALDLAAVSAAGLFDGPVLSGSPCFNQETLNMFLGMGRPAWKEARATLQKILSENEPVLRDNEALRKSCLVPMSDAEMLLPITVGDYTDFFCSVHHARNCGFIFRGPQTPVNPNWFHLPVGYHGRASSVIVSGTDIIRPRGQSHPIGSSQPSFGPSQKLDFELEMAAIVGPGNELGKPIGIDDAEDHIFGLVVMNDWSARDIQAWETIPLGPFLGKSFSTSVSPWIVTLDALKPFACEAPKQEPEPLPYLAEKNHINYDIPLEAWIKPKEQSDPSVVTKTNFKHMYWTVTQQLAHHTVNGCNLRPGDMFATGTLSGPEPDSLGCLLEITWNGQKEIPVGNSIRKFLEDGDEVILTACCKGEDYNVGFGSCTGKVLPALP

SEQ ID NO: 5957 - protein, 425 aa, Brachypodium distachyon
MAEAKLRSFVEVPRDSHFPIQNLPFGVFRRKSQPEDPPRPAVAIGGFALDLASVSAAGLFDGPVLSGSPCFRQETLNMFLGMGRPAWKEARATLQKILSADEPVLRDNEALRKNCLVPMSDAEMLLPITVGDYTDFFCSVHHARNCGFIFRGPQTPVNPNWFHLPVGYHGRASSVIISGTDIIRPRGQSHPTASSQPSFGPSKKLDFELEMAAIVGPGNELGKPISIDNAEDHIFGLVVMNDWSARDIQAWETIPLGPFLGKSFSTSVSPWIVTLDALKPFACEAPKQEPEPLPYLAEKNHINYDIPLEAWIKPKEQSDPSVVTKTNFKHMYWTVTQQLAHHTVNGCNLRPGDMFATGTLSGPEPDSLGCLLEITWNGQKEISVGNSIRKFLEDGDEVILTACCKGEDYNVGFGTCTGKILPALP

SEQ ID NO: 5958 - protein, 245 aa, Pennisetum glaucum
MGTSPSRHEASSDSSRAGDGRAVAVSTSSAASGTGSSSNHAQSKRAPAPHMFHEIVAQEKTATAAELEDQVLSGGIYLAGKTKKYWVHEKTRCNCFMLFPRGLSITWSEDPKYWSWHPLKETSDSEIEAVSLQNVCWLEIHGKLELSHLTPGVTYDVVFEAMLTEPAYGWTAPVNLRLKLPDGAVQEQKEKLQEKPRNQWLELKAGEVKSQPGQKGEVEISMFEYDGGQWKRGLLVKGIKIVPKE

SEQ ID NO: 5959 - protein, 245 aa, Panicum virgatum
MGASPSRHETSSDSPRAGEGRAVAVAASSAASGTGSNSNQAQSKRAPAPHMFHEIVAQEKAATAAELEDQVHGAGIYLAGKTKKYWVHEKTRCNCFMLFPRGLSITWSEDPRYWSWHPLKETSDSEVEAASLQNVCWLEIHGKLELSHLTPGVSYDVAFEVMLTEPAYGWTAPVNLRLKLPDGTVQERKEKMQERPRNQWMELKAGELKAQPGQKGEVEISLFEYDGGQWKRGLLVKGIKVVPKE

SEQ ID NO: 5960 - protein, 245 aa, Panicum virgatum
  misc_feature (186)..(186): Xaa can be any naturally occurring amino acid
MGASPSRHETSSDSSRAGEGRAVAVAASSAASGTGSNSNQAQSKRAPAPHMFHEIVAQEKAATAAELEDQVHGAGIYLAGKTKKYWVHEKTRCNCFMLFPRGLSITWSEDPRYWSWHPLKETSDSEVEAASLQNVCWLEIHGKLELSHLTPGVSYDVAFEVMLTEPADGWTAPVNLRLKLPDGTVXERKEKMQERPRNQWMELKAGELKAQPGQKGEVEISLFEYDGGQWKRGLLVKGIKVVPKE

SEQ ID NO: 5961 - protein, 608 aa, Panicum virgatum
MMAAELVKQYSNITLVEDSEICDIKHELKALRKKILSLDFDNSVHVHDPQDSFEYLEVLYKIRRLSERLRSLDPCGEAKQLDELTVYANDLSEMAMARLEEEFVYLLTHYKQPLEQEVLSFRSTEDGSVEDFSSSSFSEEQSEGKATPNDVTGGPEHFVPDLIQPGALSAVKSIAKFMFLNGYDKECCQAYINSRQNAIDEYFGSLRLDKLSIEELMNTSWNKLNTLIRRWNRAMRVFIRVYLVSEKRLSNHVFGELTDSTADLCFYEISFNSVMQLLSFYVSVAIGAPKTEKLFRLLDMYEVLNDLLPEAESLFESGYDDMILNEYHEALLQLGESARKTFAEFKYAIQSYSSSNAVPRGEVHPLTKYVMNYIRALTAYSKTLDSLLKDTDRRHLHLASDIQLMANACPSFTATALHLQSVAAILEANLEAGSRLYRDDRLQNIFMMNNIHYMVQKVKNSDLKSFLGDDWIRIHNRKFQQQATGYERASWNNVLSYLSDDGLCAAGDAASRKTIREKIKNFNLSFEEVYRVQTAWSVPDDQLRDDVRISISLKVIQAYRTFVGRYSSFLDGSRHRDRYIKYRPEDLETLLLDLFEGTQKSLQHSCRV

SEQ ID NO: 5962 - protein, 608 aa, Panicum virgatum
MMAAELVKQYPNITLGEDSEICDIKHALKALRKKILTLDFDNSVHVHDPQDSFEYLEVLYKIRRLSERLRGLDPCGEAKQLDELTVYANDLSEMAMARLEEEFVYLLTHYKQPLEQEVLSFRSTEDGSVEDFSSSSFSEEQSEGKAAPNDIIGGPEHFVPDLIQPGALSAVKSIAKFMFLNGYDKECCQAYINSRQNAIDEYFGSLRLNKLSIEELMNTSWYKLNTLIRRWNRAMRVFIRVYLVSEKRLSNHVFGELTDSTADSCFYEISFNSVMQHLSFYVSVAIGPPKTEKLFRLLDMYEVLNDLLPEAESLFESGYDDIILNEYHEVLLQLGESARKTFAEFKYAIQSYSSSNAVARGEVHPLTKYVMNYIRALTAYSKPLDSLLKDTDRRHLHLASDIQVMANTCPNFTATALHLQSVAAILEANLEAGSRLYRDDRLQNIFMMNNIHYMVQKVKNSDLKSFLGDDWIRIHNRKFQQQAMRYERASWNNVLSYLSDDGLCAAGDAASRKTIREKIKNFNLSFEEVYRVQTAWSVPDDQLRDDVRISISLKVIQAYRTFVGRYSSLLDGSRHRDRYIKYRAEDLETLLLDLFEGTQKSLQHSCRV

SEQ ID NO: 5963 - protein, 606 aa, Sorghum bicolor
MMAAELVKQFSNITLGEDNEICDVKQALKALRKKILGLDFDNSMHVHDPQDSFQYLEVLSKIKQLSEKLRTLDPGGEAKQLDELTVYAYDLSEMAMARLEEEFVYLLTHYKQPLEQEVLSFRSTEDGSAEDFSSSSFSEEQSEGKETPNDISGGPEYFVPDLIQPGALSAVKSIAKFMFLNGYDKECCQAYINSRQSAIDEYFGSLRLEKLSIEELVNTSWNKLNSLIKRWNRAMRVFIRVYLASEKRLSKHIFGELTDSTADLCFSEISFNSVIQLLSFYVSVAIGPPKTEKLFRLLDMYEVLDDLLPEAESLFESGYDDMILNEYHEALLQLGESARKTFAEFKYAIQSYTSSSAVARGEVHPLTKYVMNYIKALTAYSKTLDSLLKDMDRRCLASDIQLMANSYPNFTATALHLQSVTAVLEANLEAGSRLYRDDRLQNIFMMNNIHYMVQKVKNSDLKSFLGDDWIRIHNRKFQQQAMRYERASWNHVLSYLSDDGLCAAGDAASRKTIREKIKNFNLSFEDVYRVQTAWSIPDDQLRDDVRISISLKVIQAYRTFEGRYSGFLDGTRHRDRYVKYRPEDLETLLLDLFEGNQKTLQHSCRV

SEQ ID NO: 5964 - protein, 606 aa, Zea mays
MMAAELVKQYSNITLGEDNKICDIKQALKALRKKILSLDFDNSMHVHDPQDSFEYLEVLRKIKQLSEKLRTLDPGGEAKQLDELTVYAYEISEMAMARLEEEFIYLLTHFKQPLEQEVLSFRSTEDGSVEDFSSSSFSEEPSDGKATPNDISGGPEYFVPDLIQPGALSAVKSIAKFMFLNGYDKECLQAYINSRQTAIDEYFGSLRLEKLSIEELMNTSWNKLNSLIKRWNRAMRGFIRVYLVSEKRLSNHVFSELTDSTADLCFSEISFNSVVQLLSFYVSVAIGPPKTEKLFRLLDMYEVLDDLLPEVESLFEPKYGDMILNEYHEALLQLGESARKTFAEFKCAIQSYTSSNAVARGEVHPLTKYVMNYIKALTAYSKPLDSLLKDTDRRCLTSDIQLMANTYPNFTATALHLQSVTAVLEANLEAGSRLYRDDRLQNIFMLNNTHYMVQKVKNSDLKSFLGDDWIRIHNRKFQQQAMRYERASWNNVLSYLSDDGLCASGDAASRKTIREKIKNFNLSFEEVYRVQTAWSVPDDQLRDDVRISISLKVIQAYRTFVGRYSGFLDGSRHRDRYVKYRAEDLETLLLDLFEGTQKTLQHSCRV

SEQ ID NO: 5965 - protein, 134 aa, Panicum virgatum
MAVRDSLEVVDGRCGCDDDGRRPRRAGTAWTCAAHVITAVIGSGVLSLAWSVAQLGWVVGPACMLCFALVTYASAALLADCYRRGDPGKGLPRNPLLHRRRPRLPRQEAHLGLRLAAVREPVRLRRRLYHHHRH

SEQ ID NO: 5966 - protein, 458 aa, Zea mays
MAVHHALEVLDGRCDDDGHPRRTGTAWTCAAHIITAVIGSGVLSLAWSVAQLGWVVGPACMFCFALVTYVSAALLADCYRRGDPGNGPRNRSYMDAVRVYLGKKHTWACGSLQYVSMYGCGVAYTITTATSIRAILKANCYHEHGHGAHCEYGGSYYMLIFGGAQLLLSFIPEFHDMAWLSIVAAVMSFSYSFIGIGLGLATTIANGTIKGSITGVRMRTPMQKVWRVSQAVGDIAFSYPYSLILLEIQDTLKSPPAENKTMKRASIGSILVTTFFYLCCGCFGYAAFGSDSPGNLLTGFGFYEPYWLIDFANACIILHLLGGYQVYSQPIFQFADRFFAERFPDSGFVNDFHTVRVACLPACRVNLLRVCFRALYVASTTAVAVAFPYFNEVLALLGALNFWPLAIYFPVEMYFVQRNVPRWSTRWVVLQTFSVVCLLVSTFALVGSIEGLITQKLG

SEQ ID NO: 5967 - protein, 466 aa, Oryza sativa
MAVHHSLEVAAAGGDGGGGRCYDDDGHPARTGTVWTCVAHIITAVIGSGVLSLAWSVAKLGWVGGPACMACFALVTYVSAALLSDCYRRGDDDKGPRSRSYMDAVRAFLGKKHTWACGLLQYASLYGCGVAYTITTATSMRAILRSNCYHTHGHDAPCKYGGSYYMLMFGAAQLFLSFIPDFHDMAWLSVLAAVMSFSYSFIGLGLGLANTIANGTIKGSITGAPTRTPVQKVWHVSQAIGDIAFAYPYSLILLEIQDTLKAPPAENKTMKKASIISIVVTTFFYLCCGCFGYAAFGSDAPGNLLTGFGFYEPYWLIDFANACIILHLLGGYQVYSQPIYQFADRFFAERYPASRFVNDFHTVKLPLLPPCRVNLLRVCFRTVYVASTTAVALAFPYFNEVLALLGALNFWPLAIYFPVEMYFIQRHVPRWSPRWVVLQSFSVLCLLVSAFALVGSIQGLISQKLG

SEQ ID NO: 5968 - protein, 466 aa, Sorghum bicolor
MALGEGRDHGAALPLIADQAKHGAGGIVRSGSMWTAAAHVITAVIGSGVLSLAWSIAQLGWVAGPGAMLVFAAVTALQSTLFADCYRSPDPEHGPHRNRTYAKAVDRNLGSSSSWVCMLLQHTALFGYGIAYTITASISCRAILKANCYHKHGHDAHCDYGGSYYMLVFGAAQLLLSFIPDFHDMAWLSVVAAVMSFSYAFIGFGLGLATTIANGTIKGSITGVQMRTPMQKVWRVSQAIGDIAFAYPYSLILLEIQDTLKSPPAENKTMKRASMISILVTTFFYLCCGCFGYAAFGSDAPGNLLTGFGFYEPYWLIDFANACIILHLLGGYQVYSQPIFQFADRFFAERFPDSGFVNDFHTVRLGCLPACRVNLLRVCFRTLYVASTTAVAVAFPYFNEVLALLGALNFWPLAIYFPVEMYFIQRNVPRWSARWVVLQTFSVVCLLVSAFALVGSIEGLITQKLG

SEQ ID NO: 5969 - protein, 460 aa, Panicum virgatum
GGDRGAAAPLIADAGKHAGGIVRSGSMWTAAAHVITAVIGSGVLSLAWSIAQLGWVAGPAAMLVFAGVTALQSTLFADCYRSPDPEHGPHRNRTYAGAVDRNLGSSSSWVCMLLQHTALFGYGIAYTITASISCRAILKANCYHKHGYNAPCSYDGSYYMLVFGAAQLFLSFIPDFHDMAWLSVVAAVMSFSYAFIGLGLGLATTITNGTIKGSTTGVPMRTPVQKIWRVSQAIGDIAFAYPYSLILLEIQDTLKSPPAENKTMKRASMISILVTTFFYLCCGCFGYAAFGSDAPGNLLTGFGFYEPYWLIDFANACIILHLLGGYQVYSQPIFQFADRFFAERFPDSGFVNDFHTVRVPCLPPWRLNLLRVCFRTLYVASTTAVAVAFPYFNEVLALLGALNFWPLAIYFPVEMYFIQRNVARWSARWLVLQAFSVVCLLVSAFALVGSIEGLVTQKLG

SEQ ID NO: 5970 - protein, 577 aa, Pennisetum glaucum
MDRRAGAILVCLLFVLIQDVSAVAETEVGNVRLVQEAPVRKLEGTGRQDGGKVGRVSVSTVAWSTLIMAAATGLGAVPFFFMELEAQWAGLCNGLAAGVMLAASFDLVQEGQVYGSGSWVVFGILSGGIFIWLCKKFLEQYGEVSMLDIKGADASKVILVVGIMTLHSFGEGSGVGVSFAGSKGFSQGLLVTIAIAVHNIPEGLAVSMVLSSRGVTPQKAMIWSIITSLPQPIVAVPAFLCADAFQKVLPFCTGFAAGCMIWIVIAEVLPDAFKEATPSQVASAGTLAVAFMETLSTVLLGFTDGNNSEDASGFLVSLVFGLGPLVGGIILVTFSLAFSMPHPLLTGVASGIAFRLAAWRPVQLLMSSKMGLFTTLFLLIVGFLVCHAATSSILRVVNRKRSSVNIITSSPGFSLSVLTLQSLLACGSIFLHAYTEGLVLGVAARKAYGLGRYMVLPASLHGLPRGAAVASCVYGATDSWRGALAAAALTGLAGPSAAISAILARIDYDGLDYWMVIACGALIPSFGRVFRRSLRLDMRKSIVGLLIGVAFASVCLMSTRFICLHTPYCNSAPEAVT

SEQ ID NO: 5971 - protein, 578 aa, Setaria italica
MDRRAGAILLCLLFVLVVRDVSAVAETEAGNVRLVQEAPHRELEGTGRQDGAKVGRVSVSTVAWSTLVMAAATGLGAVPFFFMELEAQWAGICNGLAAGVMLAASFDLVQEGQVYGSGSWVVFGILSGGIFIWLCKKFLEQYGEVSMLDIKGADASKVILVVGIMTLHSFGEGSGVGVSFAGSKGFSQGLLVTIAIAVHNIPEGLAVSMVLSSRGVSPQKAMIWSIITSLPQPIVAVPSFLCADAFQKVLPFCTGFAAGCMIWIVIAEVLPDAFKEATPSQVASAGTLAVAFMETLSTVLLGFTDGNNSEDASGFLVSLVFGLGPLIGGIILVTFSLAFSMPHPLLTGVASGIAFRLAAWRPVQLLMSSKMGLFTTLFLIIGGSLVYHAATSSILRVVNRKRSSVNVITSSSGFSLSVLTLQSLLACGAVFLHAYAEGLVLGVAARKAYGLGRYMVLPASLHGLPRGAAVASCVYGATDSWRGALAAAALTGFAGPSAAISAILARIDYDGLDYWMVIACGALIPSFGRVFRRSLRLDMRKSIAGLLIGIGFASVCLMSTRFICLHTPYCNSAPEAVT

SEQ ID NO: 5972 - protein, 572 aa, Panicum virgatum
MDRRAGAILVCLLFVLVRDASAVAETEAGNARLVQEAPHRKLDGTGKVGRVSVSTVAWSTLLMAAATGLGAVPFFFMELEAQWAGLCNGMAAGVMLAASFDLVQEGQVYGSGSWVVFGILSGGLFIWLCKKFLEQYGEVSMLDIKGADASKVILVVGIMTLHSFGEGSGVGVSFAGSKGFSQGLLVTIAIAVHNIPEGLAVSMVLSSRGVSPQKAMIWSIITSLPQPIVAVPAFLCADAFQKVLPFCTGFAAGCMIWIVIAEVLPDAFKEATPSQVASAGTLAVAFMETLSTMLLGFTDGNNPEDASGFLVSLVFGLGPLIGGIILVTFSLAFSMPHPLLTGVASGIAFRLAAWRPVQLLMSSKMGLFTTLFLLIGGSLVYHVATSSILRVVNRKKSSINVITSSSGFSLSVLTLQSLLSCGAVFLHAYAEGLVLGVAARKAYGLGRYMVLPASLHGLPRGVAVASCVYGATDSWRGALAAAVLTGFAGPSAAISAILARIDYDGLDYWMVIACGALIPSFGRVFRRSLRLDMRKSIAGLLIGIAFASVCLMSNRFICLHTPYCNSAPEAVT

SEQ ID NO: 5973 - protein, 577 aa, Panicum virgatum
MDTRAGAILVCLLFVLVRDVSAVAETEPGNARLVQEAPHRKLDGAGRQDGGRVGRVSVSTVAWSTLVMAAATGLGAVPFFFMELEAQWAGLCNGMAAGVMLAASFDLVQEGQVYGSGSWVVFGILSGGVFIWLCKKLLEQYGEVSMLDIKGADASKVILVVGIMTLHSFGEGSGVGVSFAGSKGFSQGLLVTIAIAVHNIPEGLAVSMVLSSRGVSPQKAMIWSIITSLPQPIVAVPAFLCADAFQKVLPFCTGFAAGCMIWIVIAEVLPDAFKEATPSQVASAGTLAVAFMETLSTVLLGFTDGNNLEDASGFLVSLVFGLGPLIGGIILVTFSLAFSMPHPLLTGVASGIAFRLAAWRPVQLLMSSKMGLFTTLFLLIGGSLVYHVATSSILRVVNRKKSSVNVITSSSGFSLSVLTVQSLLSCGAVFIHAYTEGLVLGVAARKAYGLGRYMVLPASLHGLPRGAAVASCVFGATDSWRGALAAAVLTGVAGPSAAISAILARIDYDGLDHWMVIACGALIPSFGRVFRRSLRLDMRKSIVGLLIGIAFASVCLMSNRFICLHTPYCNSAPEAVT

SEQ ID NO: 5974 - protein, 576 aa, Sorghum bicolor
MDRRSGAILACLLVVVVLVRDAAAVAETEPGSVRLVQEAPHRKVVEDGSAKAGRVPVSTVAWSTLAMAAATGLGAVPFFFMELEAQWAGLCNGMAAGVMLAASFDLVQEGQVYGSGSWVVFGILGGGIFIWLCKKFLEQYGEVSMLDIKGADASKVILVVGIMTLHSFGEGSGVGVSFAGSKGISQGLLVTIAIAVHNIPEGLAVSMVLASRGVSPQKAMIWSIITSLPQPIVAVPAFLCADAFQKVLPFCTGFAAGCMIWIVIAEVLPDAFKEATPSQVASAGTLAVAFMETLSTVLLGFTDGNNSEDASGFLVSLVFGLGPLIGGIILVTFSLGFSMPHPLLTGVASGIAFRLAAWRPVQLLMSSKMGLFTTLFLLIGGSLVYHAATSSILRVFNRKRSSANVITSSSGLSLSVLTIQSLLACGAVFLHAYAEGLALGVAARKAYGLGRYMVLPASLHGLPRGAAAASCVYGATDSWRGALAAAALTGFAAPSAAISAILAKIDYDGLDYWMVIACGALIPSFGRVFRRSLRLDMRKSIVGLLIGIAFASVCLMSTRFICLHTPYCNSAPEAVT

SEQ ID NO: 5975 - protein, 573 aa, Zea mays
MDRRAGAILVFLLVVLVWDVAAVAETEPGSVRLVQEAPHRKVVEDGAKAGRVPVSTVAWSTLAMAAATGLGAVPFFFMELEAQWAGLCNGLAAGVMLAASFDLVQEGQVYGSGSWVVFGILSGGIFIWLCKKFLEQYGEVSMLDIKGADASKVILVVGIMTLHSFGEGSGVGVSFAGSKGFSQGLLVTIAIAVHNIPEGLAVSMVLASRGVSPQKAMMWSIITSLPQPIVAVPAFLCADAFQKVLPFCTGFAAGCMIWIVIAEVLPDAFKEATPSQVASAGTLAVAFMETLSTVLLGFTDGNNVEDASGFLVSLVFGLGPLIGGIILVTFSLGFSMPHPLLTGVASGIAFRLAAWRPVQLLMTSKMGLFTTLFLLIGGSLAYHAATSSILRLFNRKRSSVNVIASSSGLSLSALTVQSLLACGAVFLHAYAEGLALGVAARKAYGLGRYMVLPASLHGLPRGAAAASCVYGATDSWRGALAAAALTGLAAPSAAISAILAKIDYDGLDYWMVIACGALIPSFGRVFRRSLRLDVRKSVVGLLVGVAFASVCLMSTRFICLHTPYCNSAPEAVT

SEQ ID NO: 5976 - protein, 391 aa, Brachypodium distachyon
MGRRAGVVLVFLLFILIGEVSAVAETEIGDVRLAREAPHGKLEAAARKDGLKSGRVSVSTIAWSTLAMAAATGLGALPFFFLELEAQWAGLCNGLAAGVMMAASFDLVQEGQMYGSGSWVVFGILSGGIFIWLCKKLLEQYGEVSMLDIKGADASKVILVVGIMTLHSFGEGSGVGVSFAGSKGFSQGLLVTIAIAVHNIPEGLAVSMVLSSRGVSPQKAMLWSIITSLPQPIVAVPAFLCADAFQKVLPFCTGFAAGCMIWIVIAEVLPDAFKEATPSQVASAGTLAVAFMETLGTVLQGFTDGQGYIRLFGITCIWTWSTFWRNYTCCILACLQHAAPSSYWCSIWHSLPSCCMEAITTNNINKDGYIHHFNPPDRRFHLLPCRHSKHP

SEQ ID NO: 5977 - protein, 577 aa, Hordeum vulgare
MDRKAGVVLVCLLFLLIGEVSAVAQTEIGHVRVTREAPDVKLEDAGRQDASKGGRVSVYVVAWSTLAMAAATGLGAVPFFFLELEAEWAGLCNGLAAGVMLAASFDLVQEGQMYGSGRWVVFGILSGGIFIWLCKKILEQHGEVSMLDIKGADASKVILVVGIMTLHSFGEGSGVGVSFVGSKGLSQGLLVTIAIAVHNIPEGLAVSMVLSSRGVSPQKAMLWSIITSLPQPIVAVPAFLCADAFQKVLPFCTGFAAGCMIWIVIAEVLPDAFKEATPSQVASAGTLAVAFMETLSTVLQGFTDGHGLEDTSGFLVSLVFGLGPLFGGIILVAFSLAFNMPHPLLTGVASGIAFRLASWRPLQLVMSLKMGLFTTLFLLLGGSVFYHLAEASILMVVKHKKSSVNVITSSSGLSLSVLTQQSLLACVCVFLHAYAEGLALGVAARKAYGLGRYMVLPVSLHGLPRGAAVASCVYGATDSWRGALAAAALTGLAGPSAAISAILAKIGYDGLDYWMVIACGALIPSFGRVFRRSLRLDVRKSICGLLIGFGFAWVCLMSTRFICLHTPYCNSAPEAVT

SEQ ID NO: 5978 - protein, 571 aa, Brachypodium distachyon
MGSRVGLVLVCLLFLLIWEVSAIAETEVGDVRLAREAPHGKPEVAGKRVSVYTVAWSTLAMAAATGLGALPFFFLELEAQWAGLCNGMAAGVMLAASFDLVQEGQMYGSGGSWVVFGILSGGIFIWLCKKLLEQYGEVSMLDIKGADASKVILVVGIMTLHSFGEGSGVGVSFAGSKGFSQGLLVTIAIAVHNIPEGLAVSMVLSSRGVSPQKAMLWSIITSLPQPIVAVPSFLCADAFQKVLPFCTGFAAGCMIWIVIAEVLPDAFKEATPAQVASAGTLAVAFMETLSTVLQGLTDGQGSEDTSGFLVSLVFGLGPLFGGIILVAFSFAFSMPHSLLTGVASGIAFRLATWRPLQLVMSSKMGLFTTLILLIGGSVFYHVATSSILRVVNRKKSSVSVITSSSGLSLSFLTLQSLLACGSVFLHAYAEGLALGVAARKAYGLGRYMVLPVSLHGLPRGAAVASCVYGATDSWRGALAAAALTGLAGPSAAISAILAKIDYDGLDYWMVIACGALIPSFGRVFRRSLRLDIRKSVCGLLIGFGFASLCLMSTRFICLHTPYCNSAPEAVT

SEQ ID NO: 5979 - protein, 379 aa, Secale cereale
MDRKVGVGLVCLLFLLIGKVSAVAQTEIGHVRVAQEAPDVKLEDAGTNDASKGGIVSVYVVAWSTLAMAAATGLGAVPFFFLELETQWAGLCNGLAAGVMLAASFDLVQEGQMYGSGSWVVFGILSGGIFIWLCKKILEQHGEVSMLDIKGADASKVILVVGIMTLHSFGEGSGVGVSFVGSKGLSQGLLVTIAIAVHNIPEGLAVSMVLSSRGVSPQKAMLWSIITSLPQPIVAVPAFLCADAFQKVLPFCTGFAAGCMIWIVIAEVLPDAFKEATPSQVASAGTLAVAFMETLSTVLQGFTDGHGLEDTSGFLVSLVFGLGPLFGGIILVAFSLAFNMPHPLLTGVASGIAFRLASWRPLQLVMSLRWVSSPPCSSC

SEQ ID NO: 5980 - protein, 577 aa, Triticum aestivum
MDRKVGVVLVCLLFLLIGEVSAVAQTEVGHVRVTQEAPDLKLEDAGRHDVSQSGRVSVYVVAWSTLAMAAATGLGAVPFFFLELEAQWAGLCNGLAAGVMLAASFDLVQEGQMYGSGSWVVFGILSGGIFIWLCKKILEQHGEVSMLDIKGADASKVILVVGIMTLHSFGEGSGVGVSFVGSKGLSQGLLVTIAIAVHNIPEGLAVSMVLSSRGVSPQKAMLWSIITSLPQPIVAVPAFLCADAFQKVLPFCTGFAAGCMIWIVIAEVLPDAFKEATPSQVASAGTLAVAFMETLSTVLQGFTDGHGLEDTSGFLVSLVFGLGPLFGGIILVAFSLAFNMPHPLLTGVASGIAFRLASWRPLQLVMSLKMGLFTTLFLLLGGSVFYHLVEASILMVAKHKKSSVNVITSSSGLSLSVLTQQSLLACGCVFLHAYAEGLALGVAARKASGLGRYMVLPVSLHGLPRGAAVASCVYGATDSWRGALAAAALTGFAGPSAAIGAILAKIGYDGLDYWMVIACGALIPSFGRVFRRSLRLDARNSVCGLLIGFGFAWVCLMSTRFICLHTPYCNSAPEAVT

SEQ ID NO: 5981 - protein, 577 aa, Triticum aestivum
MDRKVGVVLVCLLFLLIGEVSAVAQTEVGHVRVTQEAPDLKLEDAGRHDVSQSGRVSVYVVAWSTLAMAAATGLGALPFFFLELEAQWAGLCNGLAAGVMLAASFDLVQEGQMYGSGSWVVFGILSGGIFIWLCKKILEQHGEVSMLDIKGADASKVILVVGIMTLHSFGEGSGVGVSFVGSKGLSQGLLVTIAIAVHNIPEGLAVSMVLSSRGVSPQKAMLWSIITSLPQPIVAVPAFLCADAFQKVLPFCTGFAAGCMIWIVIAEVLPDAFKEATPSQVASAGTLAVAFMETLSTVLQGFTDGHGLEDTSGFLVSLVFGLGPLFGGIILVAFSLAFNMPHPLLTGVASGIAFRLASWRPLQLVMSLKMGLFTTLFLLLGGSVFYHLVEASILMVAKHNKSSVNVITSSSRLSLSVLTQQSLLACGCVFLHAYAEGLALGVAARKASGLGRYMVLPVSLHGLPRGAAVASCVYGATDSWRGALAAAALTGFAGPSAAIGAILAKIGYDGLDYWMVIACGALIPSFGRVFRRSLRLDARKSVCGILIGFGFAWVCLMSTRFICLHTPYCNSAPEAVT

SEQ ID NO: 5982 - protein, 504 aa, Saccharum officinarum
LGAVPFFFMELEAQWAGLCNGMAAGVMLAASFDLVQEGQVYGSGSWVVFGILGGGIFIWLCKKFLEQYGEVSMMDIKGADASKVILVVGIMTLHSFGEGSGVGVSFAGSKGFSQGLLVTIAIAVHNIPEGLAVSMVLASRGVSPQKAMIWSIITSLPQPLVAVPAFLCADAFQKVLPFCTGFAAGCMIWIVIAEVLPDAFKEATPSQVASAGTLAVAFMETLSTVLLGFTDGNNSEDASGFLVSLVFGLGPLIGGIILVTFSLGFSMPHPLLTGVASGIAFRLAAWRPVQLLMSSKMGLFTTLGLLLGGSMVYHAATSSILRVFNRKRSSANVIMSSSGVSLSVLTMQSLLACGAVFLHAYAEGLALGVAARKAYGLGRYMVLPASLHGLPRGAAAASCVYGATDSWRGALAAAALTGFAAPSAAISAILAKIDYDGLDYWMVIACGALIPSFGRVFRRSLRLDMRKSIVGLLIGIAFASVCLMSTRFICLHTPYCNSAPEAVT

SEQ ID NO: 5983 - protein, 581 aa, Triticum aestivum
MDRKVGVVLVCLLFLLIGEVSAVAQTEVGHVRVTQEAPDLKLEDAGRHDVSQSGRVSVYVVAWSTLAMAAATGLGAVPFFFLELEAQWAGLCNGLAAGVMLAASFDLVQEGQMYGSGSWVVFGILSGGIFIWLCKKILEQHGEVSMLDIKGADASKVILVVGIMTLHSFGEGSGVGVSFVGSKGLSQGLLVTVAIAVHNIPEGLAVSMVLSSRGVSPQKAMLWSIITSLPQPIVAVPAFLCADAFQKVLPFCTGFAAGCMIWIVIAEVLPDAFKEATPSQVASAGTLAVAFMETLSTVLQGFTDGHGLEDTSGFLVSLVFGLGPLFGGIILVAFSLAFNMPHPLLTGVASGIAFRLASWRPLQLVMSLKMGLFTTLFLLLGGSVFYHLVEASILMVAKHKKSSVNVITSSSGLSLSVLTQQSLLACGCVFLHAYAEGLALGVAARKASGLGRYMVLPVSLHGLPRGAAVASCVYGATDSWRGALAAAALTGFAGPSAAIGAILAKIGYDGLDYWMVIACGALIPSFGRVFRRSLRLDARKSVCGILIGFGFALGVFDVHQIHLLAHPLLQFSSRSGHMMCS

SEQ ID NO: 5984 - protein, 501 aa, Panicum virgatum
MAASMASPRGRSIRETVLETVAAYHNQQRMRRKLRKSLTYAGELSSAGRARGDGASSSASVSSLCGPEDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHTTSPRWIHCFYLAALASFYAKKVEAGLKKYKPDIIISVHPLMQHIPLWVLKWQGLQNRVVFVTVITDLNTCHPTWFHANVNRCYCPSEEVAKRAALDDLQPSQIRVFGLPIRPSFCRAVLVKDELRKELELDPELPAVLLMGGGEGMGPVKKTAKALGESLFDKEQGKPIGQLIVICGRNKTLSSSLQALEWKIPVKIRGFETQMEKWMGACDCIITKAGPGTIAEALIRGLPIILNDFIPGQEVGNVPYVVDNGAGVFSKSPKETASLVARWFGPDSEELKKMSENALKLAQPEAVFDIVRDIHELSREQGVISQISSSLTSSFFIPSPETTPLQLI

SEQ ID NO: 5985 - protein, 501 aa, Panicum virgatum
MAASMASPRGRSIRETVLETVAAYHNQQRMRRKLRKSLTYAGELSSAGRARGDGASSSALVSSLCGPEDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHTTSPRWVHCFYLAALASFYAKKVEAGLKKYKPDIIISVHPLMQHIPLWVLKWQGLQNRVVFVTVITDLNTCHPTWFHANVNRCYCPSEEVAKRAALDDLQPSQIRVFGLPIRPSFCRAVLVKDELRKELELDPELPAVLLMGGGEGMGPVKKTAKALGESLFDKEQGKPIGQLIVICGRNKTLSSSLQALEWKIPVKIRGFETQMEKWMGACDCIITKAGPGTIAEALIRGLPIILNDFIPGQEVGNVPYVVDNGAGVFSKSPKEIASLVARWFGPDSEELKKMSENALKLAQPEAVFDIVRDIHELSREQGVMSQISSSLTSSFFISSPETTPLQLI

SEQ ID NO: 5986 - protein, 501 aa, Panicum virgatum
MAASMASPRGRSIREAVLETVAAYHNQQRMRRKLRKSLTYAGELSSAGRPRGDGASSSASVSSLCGAEDDDEPFWEEEEGTVELVQLGANRAKNVLILMSDTGGGHRASAEAIKDAFRIEFGDEYRVFVQDLCKDHAGWPLNNMESSYKFMVKHVQLWKVAFHSTSPRWVHCFYLAALASFYAKKVEAGLKKYKPDIIISVHPLMQHIPLWVLKWQGLQNRVVFVTVITDLNTCHPTWFHANVNRCYCPSEEVAKRAALDDLQPSQIRVFGLPIRPSFCRAVLVKDELRKELELDPELPAVLLMGGGEGMGPVKKTAKALGESLFDKEQGKPIGQLIVICGRNKTLSSSLQALEWKIPVKIRGFETQMEKWMGACDCIITKAGPGTIAEALIRGLPIILNDFIPGQEVGNVPYVVDNGAGVFSKSPKEIASLVARWFGPDSEELKKMSENALKLAQPEAVFDIVRDIHELSREQGVMSQISSSLTSSFFISSPETTPLQLI

SEQ ID NO: 5987 - protein, 501 aa, Sorghum bicolor
MAASMASPRGRSIRETVLETVAAYHHQQRARRKLRKSLTYAGGELSSAGRARGDASASTSVSSFCGPDDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHSTSPRWVHNFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRRELELDPELPAVLLMGGGEGMGPVKKTARALGESLFDKELGKPIGQLIVICGRNKTLSSSLQALEWKIPVKVRGFETQMEKWMGACDCIITKAGPGTIAEALIRGLPIILNDFIPGQEVGNVPYVVDNGAGVFSKSPKETANLVARWFGPDSEELKKMSENALKLAQPEAVFDIVRDIHGLSQEQGVISQISSSLTSSFFIPSPETTPLQLI

SEQ ID NO: 5988 - protein, 501 aa, Saccharum officinarum
MAASMASPRGRSIRETVLETVAAYHQQQRARRRLRKSLTYAGGELSSAGRARGDGPASTSVSSLCGPDDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHTTSPRWVHNFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRRELELDPELPAVLLMGGGEGMGPVKKTARALGESLFDKELGKPIGQLIVICGRNKTLSSSLQALEWKIPVKVRGFETQMEKWMGACDCIITKAGPGTIAEALIRGLPIILNDFIPGQEVGNVPYVVDNGAGVFSKSPKETANLVARWFGPDSAELKKMSENALKLAQPEAVFDIVRDIHGLSQEQGVISQISSSLTSSFFIPSPETTPLQLI

SEQ ID NO: 5989 - protein, 501 aa, Zea mays
MAASMASPRGRSIRETVLETVAAYHQQQRAKGKLRKSLTYAGGELSSAGRARGDGPASTSVSSLCGPDDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHSTSPRWVHNFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRRELELDPELPAVLLMGGGEGMGPVKKTARALGESLFDKELGKPIGQLIVICGRNKTLSSSLQAVEWKIPVKVRGFETQMEKWMGACDCIITKAGPGTIAEALIRGLPIILNDFIPGQEVGNVPYVVDNGAGVFSKSPKETASLVARWFGPDSEELKKMSEKALKLAQPEAVFDIVKDMHELSQEQGVISQISSSLTSSFFLPSPESTPLQLI

SEQ ID NO: 5990 - protein, 403 aa, Pennisetum glaucum
MSDTGGGHRASAEAIKDAFRIEFGDEYRVFVKDLCKDHAGWPLNNMESSYKFMVKHVQLWKVAFHTTSPRWVHCFYLAGLASFYAKKVEAGLKKYKPDIIISVHPLMQHIPLWVLKWQGLQNRVVFVTVITDLNTCHPTWFHANVNRCYCPSEEVAKRAAVDGLQPSQIRVFGLPIRPSFCRAVLVKDELRKELELDPELPAVLLMGGGEGMGPVKKTAKALGESLFDKEHGKPIGQLIVICGRNKTLSSSLQALEWRIPVKVRGFETQMEKWMGACDCIITKAGPGTIAEALIRGLPIILNDFIPGQEVGNVPYVVDNGAGVFSKSPKETASLVARWFGEDSEELKRMSENALKLAQPEAVFDIVRDIHELSREQGVISQISSSLTSSFFIPSPETTPLQLM

SEQ ID NO: 5991 - protein, 508 aa, Oryza sativa
MAASSSSSSSMASPRGRSIRETVLETVAAYHQQQRMRRKFRKSLSYAGELSSAGRARGEGGASSSASTTSLCGPDEDDEPFWEEEEGTVELVQLGANRAKNVLILMSDTGGGHRASAEAIKDAFRIEFGDDYRVFVKDLCKDHAGWPLNNMESSYKFMVKHVQLWKVAFHTTSPRWVHCFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRKELELDPELPAVLLMGGGEGMGPVKKTAKALGESLFDKELGKPIGQLIVICGRNKTLSSSLQALEWKIPIKVRGFETQMEKWMGACDCIITKAGPGTIAEALIRGLPIILNDFIPGQEVGNVPYVVDNGAGVFSKSSRETAKLVARWFGPDSDELKRMSEKALKLAQPEAVFDIVRDIHELSREQGVISQISSSLTSSFFIPSPETTPIQLM

SEQ ID NO: 5992 - protein, 504 aa, Brachypodium distachyon
MAASMASPRGRSIRETVLESVAAYQQQQRMRRRFRKSLSYAGELSSAGRAGGGDGPSSSSSASVSSLCGPEEDDEPFWEEEEGTVELVQLGANRAKNVLILMSDTGGGHRASAEAIKDAFRIEFGDDYRVFVKDLCKDHAGWPLNNMESSYKFMVKHVQLWKVAFHTTSPRWVHCLYLGSLASFYAKKVEAGLKKYKPDIIISVHPLMQHIPLWVLKWQGLQNRVVFTTVITDLNTCHPTWFHADVNRCYCPSEEVAKRAEMDELKPSQIRVFGLPIRPSFCRAVLVKDDLRRELEMDPELPAVLLMGGGEGMGPVKKTAKALGEALFDKELGKPIGQLVVICGRNKTLSSSLQSLEWKMPVKIRGFETQMEKWMGACDCIITKAGPGTIAEALIRGLPIILNDFIPGQEVGNVPYVVDNGAGVFSKSPKETAALVASWFGPGLEERKRMSENALKLAQPEAVFDIVRDIHALSQEQGVISQISSSLTSSFFIQSPETTPIQLM

SEQ ID NO: 5993 - protein, 506 aa, Hordeum vulgare
MEASTASPRVRSIRETVLESVAAYHHQQRMRRRFRKSLSYAGELSSAGRASSSSSSPSASLASLAGPEDDDEPFWEEEEGTVELVQLGANRAKNVLILMSDTGGGHRASAEAIKDAFRIEFGDDYRVFVKDLCKDHAGWPLNNMESSYKFMVKHVQLWKVAFHGTSPRWVHNFYLAALASFYAKKVEAGLKKYKPDIIISVHPLMQHIPLWVLKWQGLQNRVVFATVITDLNTCHPTWFHADVNRCYCPSEEVAKRAELDDLKTSQIRVFGLPIRPSFCRAVLVKDDLRKELELDPELPAVLLMGGGEGMGPVKKTAKALGDVLFDKELGKPIGQLVVICGRNKTLSSSLQALEWKMPIKIRGFETQMEKWMGACDCIITKAGPGTIAEALIRGLPIILNDFIPGQEVGNVPYVVDNGAGVFSKSPKETAELVAHWFGPGSEDRKRMSENALKLAQPEAVFDIVRDIHELSQEQGVKAQISSSLTSSFFIPSPEASSHCPSPIPLV

SEQ ID NO: 5994 - protein, 571 aa, Secale cereale
PTPARPVPQPPKKFHVRTSALRPPSLPPSPRHAPPAPPLRPSAIPSRPLANFKRSPAASGDPGPGAMEAPAASSPRVRSIRETVLESVAAYHQQQRMRRRFRKSLSYAGELSSAGRASSSSPSASLASLAGPEDNDDEPFWEEEEGTVELVQLGANRAKNVLILMSDTGGGHRASAEAIKDAFRIEFADDYRVFVKDLCKDHAGWPLNNMESSYKFMVKHVQLWKVAFHGTSPRWVHNFYLAALASFYAKKVEAGLKKYKPDIIISVHPLMQHIPLWVLKWQGLQNRVVFATVITDLNTCHPTWFHADVNRCYCPSEVVAKRAELDDLKSSQIRVFGLPIRPSFCRAVLVKDDLRKELELDPELPAVLLMGGGEGMGPVKKTAKALGDALFDKELGKPIGQLVVICGRNKTLSSSLQALEWKMPIKIRGFETQMEKWMGACDCIITKAGPGTIAEALIRGLPIILNDFIPGQEVGNVPYVVDNGAGVFSKSPKETAELVARWFGPGAEERKRMSENALKLAQPEAVFDIVRDIHELSQEQGVKAQISSSLTSSFFIPSPEASHCPSPIPLV

SEQ ID NO: 5995 - protein, 475 aa, Triticum aestivum
MRRRFRKSLSYAGELSSAGRAGASSSPSASLASLAGPEDDDEPFWEEEEGTVELVQLGANRAKNVLVLMSDTGGGHRASAEAIKDAFRIEFGDDYRVFVKDLCKDHAGWPLNNMESSYKFMVKHVQLWKVAFHGTSPRWVHNFYLAALASFYAKKVEAGLKKYKPDIIISVHPLMQHIPLWVLKWQGLQNRVVFATVITDLNTCHPTWFHADVNRCYCPSEEVAKRAELDDLKSSQIRVFGLPIRPSFCRAVLVKDDLRKELELDPDLPAVLLMGGGEGMGPVKKTAKALGDALFDKELGKPIGQLVVICGRNKTLSSSLQALEWKMPIKIRGFETQMEKWMGACDCIITKAGPGTIAEALIRGLPIILNDFIPGQEVGNVPYVVDNGAGVFSKSPKETAELVARWFGPGAEERKRMSENALKLAQPEAVFDIVRDIHELSQEQGVKAQISSSLTSSFFIPSPEASHCPSPIPLV

SEQ ID NO: 5996 - protein, 187 aa, Panicum virgatum
MAKLAVLLLLAVAASATTLARPLETPTRIKLIRGADAGGVSGDSMECVYTVFIRTGSIWKAGTESNITLELAAADGNGVGISDLPSWGGLMGPGHSYFERGNLDIFSGRGPCMAKTPCWMRVASDGTGPHHGWYCNYVEVTVTGPHKGCAQQLFTVEQWLATDAPPYKLEAVVDTCPAAAAAGAAVA

SEQ ID NO: 5997 - protein, 184 aa, Panicum virgatum
MAKLAVLLLAVAASATTLAHALEPPTRIKLIRGADAGGVSGDSMECVYTVFIRTGSIWKAGTDSNITLELVAADGNGVGISDLPSWGGLMGPGHSYFERGNLDIFSGRGPCMAKTPCWMRVASDGTGPHHGWYCNYVEVTVTGPHQGCAQQLFTVEQWLATDAPPYKLEAVVDNCSAAAGAAAA

SEQ ID NO: 5998 - protein, 193 aa, Oryza sativa
MANLAASLLFLLAVASSATVPAHGRRDLLPTRIKLVRGADAGAGAVAGGDKMECVYTVYIRTGSIWKAGTDANITLELAGADGNGVGITDLPSWGGLMGEGHSYFERGNLDIFSGRGPCMAAPPCWMRVASDGTGPHHGWYCNYVEVTVTGAHKGCAQQLFTVEQWLATDAAPYKLEAIRDKCSAAGAGAAAA

SEQ ID NO: 5999 - protein, 168 aa, Pennisetum glaucum
MAKLAVVLLLLAVAASATVLAHGRDLPTQIKLTRGAVAASGGGEGGDSMECVYTVFIRTGSIWKAGTNSNITLQLAAADGNGVGITDLPSWGGLMGPGHSYFERGNLDIFSGRGPCMARPPCWMRVASDGTGPHHGWYCNYVEVTVTGPHKGCAQELFTVEQWLATDA

SEQ ID NO: 6000 - protein, 187 aa, Sorghum bicolor
MAKLAVFLLLLAVAASATVPAHGRDPPTEIKLIRGADASGVGGDSMECVYTVFIRTGSIWKAGTDANITLQLAGADGNGVGISDLPSWGGLMGQGHAYFERGNLDIFSGRGPCMAKPPCWMRLISDGTGEHHGWYCNYVEVTVTGPHKGCTQQLFTVEQWLATDAAPYKLEAVRDLCSADGKSVAAA

SEQ ID NO: 6001 - protein, 1382 aa, Brachypodium distachyon
MGPHIPLPLRRRLHLLLLALLAVASGNPSRGVYDRGDEEADAYSILTFHDYTTPPPPPALPPPPAAPAATCAGDLGGVGDFDTRCVVPTSVRLGGAGVYVSGNGSLLLVDGVALTCERPGCVFSGNLSGEIRFGRGAHVVAAWVSLAASKIILSNDALINTTALAGDPPDKTSGVPTGTYGDGGGHGGRGASCYVKKGQAQEDSWGGDTYAWPNLKTPDSYGSKGGSTSVEKDYGGGGGGVVWLFAEEIVMNGTVLADGGDGGTKGGGGSGGSIYLKAATMQGGGKISACGGNGLSGGGGGRVSIDVFSRHDDTHFFVNGGRSSGCLDNAGAAGTLYEEVPKSITVNNNNLSTQTDTVFLDPPYEPLWTNVFIKNHAKVSLPLRWSRLQAQGQISLLTQATLTFGLTHYPYSEFELLAEELLMSDSTVQVFGALRMSVKMLLMWNSSMLIDGGRDSGVATSLLEGSNLIVLRQSSVIHSNANLGIHGQGVLNLSGNGDTIGAQRLILSLFYNIRICRVEDIDVHGHLHGTVINFNRARRVTVKPNGTISATGLGCRGGIGRGGMLSSGLSGGGGHGGKGGDGIYSGSHAGGGAAYGSADLPCELGSGSGNVSTKSSTAGGGIIVMGSLEQSLPSLFVSGSVEANGGTFTGLATKAANGGPGGGSGGTILLFVRTLSLEKGSVLSTVGGIGNNGSGGGGGGRIHFHWSDIPTGDDYVPFATIKGSILTRGGVVEGQGFPGENGTVTGKDCPKGLYGIFCKECPLGTYKNVTGSSKSLCSPCPPNELPHRAVYLNIRGGVAETPCPYKCVSDRYRMPHCFTALEELIYTFGGPWCFGLLLSGLLVILALVLSIARMKFVGTEEFPGPAPTQHGSQIDHSFPFLESLNEVLETNRAEESHCHVHRMFFMGPNTFSEPWHLPHTPPEQITEIVYEDAFNKFVDEINVLAAYQWWEGSICSILCILSYPLAWSWQQWRRRKMLQRLREFVRSEYDHSCLRSCRSRALYEGLKVAATPDLMLGYLDFFLGGDEKRPDLPTRLHQRFPMSLIFGGDGSYMAPFSLHSDSVVTSLISQAVPSSIWHRLVAGLNAQLRLVRRGNLKATFVPVLKWLETHANPGLNTYHVRVDLAWFQATALGYCQFGLVIHAVGAEEVSAELQGGSRIKIDQHLLNQNAHADSQLGYSRNNDAYMCKRITGGVLNVDNLVMLKDRRDLFHPFSLILHNTKPVGHQDLVGLVISILLLADFSLVLLTFLQLYSYSMIDVLLVLFVLPLGILAPFPAGINALFSHGPRRSAGLARVYALWNITSLVNVIVAFVCGLVHYKSSTKRHPSMQPWNLGGDETSWWLFPTGLVLCKCIQARLVDWHVSILEIQDRAVYSKDPNMFWQ

SEQ ID NO: 6002 - protein, 1382 aa, Oryza sativa
MATHIPLARLRLRLRLPHLALALLAVASGNPSLGGFDRGDAEAEAYSILTFHDYTPPPPPSLPPPPPAPSATCAGDLRGVGDLDTRCVVPASVRLRGPGVYISGNGTLVLVDGVALTCERPGCVVSANLSGGIFFGREARVVAGWVSLSATNITLSSDAVIDTTALAGDPPDKTSGVPTGSYGDGGGHGGRGASCYVKEGQAQEDSWGGDMYAWAELKTPNSYGSKGGSTSVEKDYGGGGGGVVWLFAKDIMMNGTILANGGDGGTKGGGGSGGSIYLKAKTMQGGGTISACGGDGLAGGGGGRVSVDVFSRHDDSQFFVHGGRSSGCLDNAGAAGTLYEEVPKSITVSNNNLSTQTDTVFLEPPYDPLWTNVFIKNHAKVSLPLRWSRIQAQGQISLLSRATLTFGLTHYPYSEFELLAEELLMSDSTIKVFGALRMSVKMLLMWNSRMLIDGGRESGVATSLLEGSNLIVLKESSVIHSIGNLGIHGQGILNLSGDGDTIQAQRLILSLFYNIVICRVEDIVVSGLVQGTVINFNRARNVTVRSSGTISATGLGCRGGIGRGRMLSSGLSGGGGHGGKGGDAFYSGSHAGGGTAYGSADLPCELGSGSGNVSTSSSTAGGGIIVMGSLEQSLPLLSLAGSIEANGGSFAGAVTHAANEGPGGGSGGTILLFVRALSLEEGSVLSSAGGVGSNGSGGGGGGRIHFHWSDIPTGDDYIPFATVNGSILARGGTVDGQGFPGENGTVTGKDCPKGLYGTFCKACPLGTYKNITGSLKSLCSPCPTNELPHRAVYISIRGGVTETPCPYKCVSDRYRMPHCFTALEELIYTFGGPWLFGLFLSGLLFLLALVLSIARMKFVGTDELPGPAPTQHSSQIDHSFPFLESLNEVLETNRAEESHCHVHRMYFMGPNTFSEPWHLPHTPPEQISEIVYEDAFNKFVDEINALAAYQWWEGSIYSILCILSYPLAWSWQQWRRRRKLQRLREFVRSEYDHSCLRSCRSRALYEGLKVAATPDLMLGYLDFFLGGDEKRPDLPPRLHQRLPMSLIFGGDGSYMAPFSLHSDSVVTSLISQGVPSSIWHRLVAGLNAQLRLARRGNLKATFLPVLKWLETHANPALNTYRVRVDLAWFQATALGYYQFGLVIHSVGPFSSGLQGGSRMKFDYHAQFQNTDVDSQLDHSRNNDAVMLKRITGRVLDIDNLRTLKDKRDLFYPLSLILHNTKPVGHQDLVGLVISILLLADFSLVLLTFLQLYSYSMIDVLLVLFVLPLGILAPFPAGINALFSHGPRRSAGLARVYALWNITSLVNVIVAFACGLVHYKSSAKRHPSMQPWNLGGDDTSWWLFPTGLVLCKCIQARLVDWHVSILEIQDRAVYSNDPTIFWQ

SEQ ID NO: 6003 - protein, 1343 aa, Sorghum bicolor
MLPTPWPSTFPSLTTGFLLLLALLAVASGAPAPSLGGFDRGEPPGADEYSILTFHDYMPPPPPALPPPPAAPAATCAGDLHGVGDLDTQCVVRESVRLGGGVFISGNGSLVILDGVAVTCERPGCVVSANLSGDLLLGNRARVVAGWVSLAAANITLGDDAAIDTTALGGDPPDQTSGVPTGTYGDGGGHGGRGASCFVKKGQAQEDSWGGDSYAWSALKTPNNYGSKGGSTTVEKDYGGGGGGVVWLFAEEIVMNGTVLADGGDGGTKGGGGSGGSIYLKASTMRGGGKVSACGGNGLAGGGGGRVSIDVFSRHDDAQIFVHVFLDPPYEPLWTNVFIRNRAKVSLPLRWSRIQAQGQILLAGATLTFGLTHYPYSEFELLAEELLMSDSTIKVFGALRMSVKMLLMWNSRMTIDGGREFAVGTSLLEGSNLIVLKEASVIHSNANLGIHGQGVLNLSGQGDTIEAQRLILSLFYNILICRVEDIDVSGLVQGTVINFNRARSVTVQTSGTISATGLGCRGGIGQGKMLSSGLSGGGGHGGKGGDGIYNGGHAEGGTVYGHADLPCELGSGSGNVSGSSTAGGGIIVMGSWEQSLPNLSLSGSIEANGGNFTGLISHATIGGPGGGSGGTILLFVRTLLLKKDSVLSSVGGVGSNGSGGGGGGRIHFHWSDIPTGDDYIPFATVKGTILTRGGVSEGQGLSGENGTVTGKDCPKGLYGTFCKECPSGTYKNITGSSKSMCSPCPPNELPRRAVYISVRGGVAETPCPYKCVSDRYRMPHCFTALEELIYTFGGPWLFGLLLSGLLVLLALVLSIARMKFVGTDELPGPAPTQHSSQIDHSFPFLESLNEVLETNRAEESHCHVHRMYFMGPNTFSEPWHLPHTPPEQISEIVYEDAFNKFVDEINALAAYQWWEGSVYSILCILSYPLAWSWQQWRRRKKLQKLREFVRSEYDHSCLRSCRSRALYEGLKVAATPDLMLGYLDFFLGGDEKRIDLPPRLHQRFPMSLIFGGDGSYMAPFSLHSDRVITTLISQAVPSSIWHRLVAGLNAQLRLVRHGNLNTSFVPVFKWLESHANPALNTYRVRVDLAWFQATALGYCQFGLVLHAVGGAVTAELQDGSIIKTDQYSVNQNTYSDSQTGHSRTSDALRKRITGTILNADNLRMLNDRRDLFYPLSLILHNTKPVGHQDLVGLVISILLLTDFSLVLLTFLQLYSYSMVGVLLVLFILPLGILAPFPAGINALFSHGQRRNHVFMYLPPPPPLPDSACLAIAASLEHTARSLCVRKDSSGRAFYPLPICFLPYSLTATMVKFGGSLPAHSLVARSVAFLTGSGVQPWFWCCSS

SEQ ID NO: 6004 - protein, 1258 aa, Panicum virgatum
MAGSAVTDDSAASTTGMRDDERSLSGDSLSEWRSCDRADCDSPSTSPPFWDSDGEDDDPGPKPSGLFGHYTWRIENFSKEKKREMKSEPFEAGGYKWYILVYPQGCDVSNHLSLFLCVANHDKLLPGWSHFAQFTIAVGNVDPKKMKYSDTLHRFWKKEHDWGWKKFMELSKIQDGFLVDDVLEIIAQVQVIREKVDRPFRCLDRPYRRELLRVYMTQVEQIYRRFVEERRNKLSKLIEDTMRWSSFCGFWSAIDPSTRHRMSREKTDTILKFLVKHFFVEKEVTSTLVMDSLYTSLKALEYQMNGKKGSTKAADLEELPAPMVHIDMDMFVLAGDVITLIKRAASEPLPCQPLALKDDKTSQSRMKDGTAGEVYKVSMEREERRLTELGQKILETFVLSHIFSGIEVAYQEAVALKRQEELIREEEEEAGLLENQMKGKRGGGTNEKEKRAKKKQAKQKKNNRKVKDKERDEKCEIKILERLHDEIAVDSSDGLPAVEVTARVDALEEGSSDGSDMSNRGKNQRNKGLSIVGFAEEGDGLPSTSSVAGGSGRNSSGFSTVPKLDQDTVLLTLRDKLRMLGQRLHEKNIEGQKLLKAHFEARDAKAKEAESSNSSSSLEKPPDVPESPKHLSEAAVDLKANGTPNKDVSVVNSMREGAVSGIPASINTEPVTAATSKVDLVSDRDNRLSSKMKANIASPCCSKPPGVDLDKDAPLPSKSPRINRAASAPQKLPAADKATPVPPKSPPVNKVPAVHPKSPVVDKTPVRAKSPAADRVAPVRPQSPAVDKATPVRPKSPAVDKAPPAGPKSSASEKATTLLPKSTPVDKASPALLKSPTGGKDAYVPSRSVHDKSIPAPPRLPQVDKAAPPSSELRQTSPGTNSETQEAAISRKVTATLVSEVTASRPSSAPVFPTPRSTAPATSHVHIPSLLSRSMSEAAERSASGPSPSAPSYAPQTYRNAIVGKAGLGTTSTSPAYQSSLSQDTTPPQPLSAYASSTAVMMPPAGRSDQLSTRHVLKSGLGKLEAHDSWQQWKGDSNVDKHVWRDQAPYQQMTNGQAYEQPRRDDSYQQASSRGTEKLSRYGGQQSRQFQSGTSDGHVWHPQQGPVPEEFPHLDIINDLLEEDHINGSIPDSFCQDYHVFGRPFSPRGNLTDMEMASVSSPGRFNSTDRYYDDGFSRSYDMSAIHGLRERQFPSMGSYSNGLSEMSVSKPWLNGSPNPAVSLGVGTNGYHHQVGDYTNLGGGVNGVSVWRRHANGRW

SEQ ID NO: 6005 - protein, 1199 aa, Panicum virgatum
GPKPSGLFGRYTWRIENFSKEKKREMKSEPFEAGGYKWYILVYPQGCDVSNHLSLFLCVANHDKLLPGWSHFAQFTIAVGNVDPKKMKYSDTLHRFWKKEHDWGWKKFMELSKIQDGFLVDDVLEIIAQVQVIREKVDRPFRCLDRPYRRELLRVYMTQVEQIYRRFVEERRNKLSKLIEDTMRWSSFCGFWSAIDPSTRHRMSREKTDTILKVLVKHFFVEKEVTSTLVMDSLYTSLKALEYQMNGKKGSTKAADLEELPAPMVHIDMDMFVLAGDVIALIKRAASEPLPCQPLALKDDKTSQSRLKDGTAGEVYKVSMEHEERRLTELGQKILETFVLSHIFSGIEVAYQEAVALKRQEELIREEEEEAGLLENQMKGKRGGGANEKEKRAKKKQAKQKKNNRKVKDKERDEKCEVKILERLHDEIAVDNSDGLPAVEVTAKVDALEEGSSDGSDMSNRGKNQRNKGLSIVGFAEEGDGLPSTSSVAGGSGRNSSGFSTVPKLDQDTVLLTLRDKLRKLGQRLHEKNIEGQKLLKAHFEARDAKAKEAESSNSSSSLEKPPDVPESPKHLSEAAVDLKANGTPNKDVSVVNSMREGAVLGTPASINTEPATAPATAKVDLVSDKDNGLSSKMKANIASPCCSKPPGVNLDKDAPLPSKSLRINRVASSPQKLPSADKGTPVPPKSPPINKAPAVHPKSAVVDKTLVHAKSPAVDRAAPVRPQSPAVDKATPVCPKSPAVDKAPPAGPKSSASDKATAVLPKSIPVDKASPALLKSPTGGKDAYVPSRLNDKSIPSPPRLPQVDKAALASSELRQTSPGTNSEAQEATTSRKVTATLVSEVTASRPSSAPVFPTPRSTAPATSHVHISSLLSRSMSEAAGRSANGPSPSAPSYAPQTYRNAIVGKAGLGTTSTSPAYQSSLSQDTTPSQPLSAYASSTAVMMPPAGRSDQLSTRHVLKSGLGKLEAHDSWQQWKGDNNVDKHVWRDQAPYQQMTNGQAYEQPRRDDSYQQASSRGTEKLSRYGGQQSRQFQSGTSDGHVWHPQQGPVPEEFPHLDIINDLLEEDHVNGSMPDSFCQAYHVFGRPFSPRGNLTDIEMASVSSSGRFNSTDRYYDDGFSRSDDMSAIHGLRERQFPSMGSYSNGLSEMSVSKPWLNGSPNPAVSLGVGTNGYHHQVGDYTNLGGGVNGVSVWRRHANGRW

SEQ ID NO: 6006 - protein, 412 aa, Panicum virgatum
MASSNGKPAQAEEGKAAAEGSIGGYESLHSLLEANLSPELFQEASRLLLGLNCARPLEAIALPEATMTLAETHNFDVQAFRFSADKEFLRQPRVVRVGLIQNSIAVPTTCHFAEQKKAIMDKIRPIVDAAGASGVNILCLQEAWTMPFAFCTREKRWCEFAEPVDGESTQFLQELAQKYNMVIVNPILERDVNHGETIWNTAVVIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCSPSLSRYRDGLAISDMDLNLCRQIKDKWAFRMTARYDMYASLLSEYLKPDFKPQVIVDPLINKRA

SEQ ID NO: 6007 - protein, 207 aa, Panicum virgatum
MASSNGKPAQAEEGKGAAEGSIGGYESLHRLLEANLSPELFQEASRLLLGLNCARPLEAIALPEATMTLAETHNFDVQAFRFSADKEFLRQPRVVRVGLIQNSIAVPTTCHFAEQKKAIMDKIRPIVDAAGASGVNILCLQEAWTMPFAFCTREKRWCEFAEPVDGESTQFLQELAQKYNMVIVNPILERDVNHGETIWNTAVIIGK

SEQ ID NO: 6008 - protein, 413 aa, Sorghum bicolor
MATSNGKAAQGEEGKTPPPAGSIGGYESLHRLLEANLSPELFQEASRLLLGLNCAQPLEAISLPDATTTLAETHNFDVQAFRFSADKEFLRQPRVVRVGLVQNSIAVPTTCHFADQKKAIMDKIKPVIDAAGASGVNILCLQEAWTMPFAFCTREKRWCEFAEPVDGESTQFLQELAQKYNMVIVSPILERDVNHGETIWNTAVIIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLIISDMDLNLCRQIKDKWAFRMTARYEMYASLLSEYLKPDFKPQVIVDPLINKKA

SEQ ID NO: 6009 - protein, 406 aa, Panicum virgatum
MASSNGKPAQAEEGSIGGYESLHRLLEANLSPELFQEASRLLLGLNCARPLEVIALPEATMTLAETHNFDVQAFRFSADKEFLRQPRVVRVGLIQNSIAVPTTCHFAEQKKAIMDKIGPIVDAAGASGVNILCLQEAWTMPFAFCTREKRWCEFAEPVDGESTQFLQELAQKYNMVIVNPILERDVNHGETIWNTAVIIGNNGNIIGIHRKNHIPRVGDFNESTYYMEGNTGHPVFETTYGKIGVNICYGRHHPLNWLAFGLNGAEIVFNPSATVGELSEPMWPIEARNAAIANSYFVGSVNRVGTEVFPNPFTSGDGKPQHADFGHFYGSSHFSAPDASCTPSLSRYRDGLAISDMDLNLCRQIKDKWAFRMTARYDMYASLLSEYLKPDFKPQVIVDPLTNKRA

SEQ ID NO: 6010 - protein, 413 aa, Saccharum officinarum
MATSNGKAAQGEEGKTPPPAGSIGGYESLHRLLEANLSPELFQEASRLLLGLNCARPLEAISLSDATTALAETHNFDVQAFRFSADKEFLRQPRVVRVGLIQNSIAVPTTCHFADQKKAIMDKIKPVIDAAGASGVNILCLQEAWTMPFAFCTREKRWCEFAEPIDGESTQFLQELAQKYNMVIVSPILERDVNHGETIWNTAVVIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPNASCTPSLSHYRDGLIISDMDLNLCRQIKDKWAFRMTARYEMYASLLSEYLKPDFKPQVIVDPLVNKKA

SEQ ID NO: 6011 - protein, 411 aa, Pseudoroegneria spicata
MESSNGKPPQGEEEGKAAGSIGGYESLHRLLESNLPPELFKEASRLLLGLNCARPLEAISLPGATTNLAEAHNFDVQAFRFSADKEHMRQPRIVRVGLIQNSIAVPTTCHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDMYANLLSEYLKPDFKPQVIADPLINKRA

SEQ ID NO: 6012 - protein, 411 aa, Secale cereale
MESSNGKPPQGEEEGKAAGSIGGHESLHRLLESNLSPELFKEASRLLLGLNCAHPLEAISLPGATTDLAEAHNFDVQAFRFNADKEHMRQPRIVRVGLIQNSIAVPTTCHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDMYANLLSEYLKPDFKPQVIADPLINKRA

SEQ ID NO: 6013 - protein, 411 aa, Secale cereale
MESSNGKPQQGDEEGKAAGSIGGYESLHRLLESSLSPELFKEASRLLLGLNCAHSLEAVSLPGATTDLAEAHNFDLQAFRFNADKEHMRQPRIVRVGLIQNSIAVPTTCHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDMYANLLSEYLKPDFKPQVIADPLINKRA

SEQ ID NO: 6014 - protein, 411 aa, Secale cereale
MESSNGKPPQGEEEGKAAGSIGGYESLHRLLESSLSPELFKEASRLLLGLNCAHPLEAVSLPGATTDLAQAHNFDLQAFRFNADKEHMRQPRIVRVGLIQNSIAVPTTSHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDMYANLLSEYLKPDFKPQVIADPLINKRA

SEQ ID NO: 6015 - protein, 385 aa, Pennisetum glaucum
LHRLLEANLSPELFQEASRLLLGMNCARPLETISLPEATTTLAASHNFDVQAFRFSADKEFLRQQRVVRVGLIQNSIAVPTTYHFADQKKAIMDKIRHIVDAAGASGVNILCLQEAWTMPFAFCTREKRWCEFAEPVDGESTQFLQELAQKYNMVIVSPILERDVNHGETIWNTAVVIGNNGNIIGIHRKNHIPRVGDFNESTYYMEGDTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLIISDMDLNLCRQIKDKWAFRMTARYEMYASFLSEYLKPDFKPQVIVDPLINKRA

SEQ ID NO: 6016 - protein, 411 aa, Hordeum vulgare
MESSNGKPPQGEEEGKAAGSIGGYESLHRLLESNLSPELFKEASRLLLGLNCAHPLEPISLPGATTDLAQAHSFDVQAFRFNADKEHMRQPRIVRVGLIQNSIAVPTTCHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMVSDMDLNLCRQIKDKWAFRMTARYDMYANLLSEYLKPDFKPQIIADPLINKRA

SEQ ID NO: 6017 - protein, 411 aa, Triticum aestivum
MESSNGKPPQGEEEGKAAGSIGGHESLHRLLESNLPPELFKEASRLLLGLNCAHPLEAVSLPGATTDLAKAHNFDVQAFRFNADKEHMRQPRIVRVGLIQNSIAVPTTCHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDMYANLLSEYLKPDFKPQIIADPLINKRA

SEQ ID NO: 6018 - protein, 411 aa, Leymus cinereus x Leymus triticoides
  misc_feature (70)..(70): Xaa can be any naturally occurring amino acid
  misc_feature (73)..(73): Xaa can be any naturally occurring amino acid
  misc_feature (93)..(93): Xaa can be any naturally occurring amino acid
  misc_feature (105)..(105): Xaa can be any naturally occurring amino acid
  misc_feature (353)..(353): Xaa can be any naturally occurring amino acid
MESSNGKPPQGEEEGKAAGSIGGYESLHRLLESNLPPELFKEASRLLLGLNCAHPLEAISLPGATTDLAXAHXFDVQAFRFNADKEHMRQPRXVRVGLIQNSIAXPTTCHFADQKKSIMEKVKPIIDAAGASGVNILCLQEAWTMPFAFCTREKRWCEFAEPVDGESTQFLQELAQKYNMVIVSPILERDINHGEIIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRXRDGLMISDMDLNLCRQIKDKWAFRMTARYDMYANLLSEYLKPDFKPQVIADPLINKRA

SEQ ID NO: 6019 - protein, 415 aa, Festuca arundinacea
MESSNGKPPHGKEEGKAAAAEGSIGGYESLHRLLESNLSPELFKEASRLLLGLNCARPLEAISLPGATTALAEAHDFDVQAFRFNADKEQMRQPRIVRVGLVQNSIAVPTTCHFADQKKAIMEKVKLIVDAAGASGVNVLCLQEAWTMPFAFCTREKRWCEFAEPVDGESTQFLQDLAQKYNMVIVSPILERDINHGEIIWNTVVVIGNNGNIIGIHRKNHIPRVGDFNESTYYMEGNMGHPVFETAYGKIAVNICYGRHHPLNWLAFGLNGAEIVFNPSATVGELSEPMWPVEARNAAIANSYFVGSINRVGTEVFPNAFTSGDGKPQHADFGHFYGSSHFSAPDASCTPSLSRYRDGLMISDMDLNLCRQIKDKWAFRMTARYDMYANLLSEYMKPDYKPQVISDPLINKRKA

SEQ ID NO: 6020 - protein, 413 aa, Oryza sativa
MDSSNGERPPQGEDAPAAAAGSIGGYESLHRLLQSNLSPELFKEASRLLLGLNCGRALEAISLPEATSALAKAHNFDVQAFRFDADKEYLRQPRVIRVGLIQNSIAIPTTSHFADQKKAIMEKVKPMIDAAGDAGVNILCLQEAWTMPFAFCTREKRWCEFAEPVDGESTQFLQQLAKKYNMVIVSPILERDVNHGEIVWNTAVVIGNHGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWGFRMTARYDTYASLLSEYLKPDFKPQVIVDPLINKSA

SEQ ID NO: 6021 - protein, 417 aa, Brachypodium distachyon
MESSNGKPPQGEEEAKAAAAVAEGSIGGYESLHRLLESNLSPELFKEASRLLLGLNCALPLQTISLPGVTTALAEEHDFDVQAYRFNADKEYIRQPRIVRVGLIQNSIAVPTTCHFADQKKAIMEKVKLIIDAAGASGVNILCLQEAWTMPFAFCTREKRWCEFAEPVEGESTQFLQELAQKYNMVIISPILERDINHGEIIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDIYASLLSEYLKLDFKPQVIADPLINKRRA

SEQ ID NO: 6022 - protein, 413 aa, Avena sativa
MESSNGKPPHEEKEGKAAEGSIGGYESLHRLLESNLSPELFKEASRLLLGLNCARPLGAISLPGATKALADAHDFDVQAFRFNADNEYMRQPRIVRVGLIQNSIAVPTTCHFADQKKAIMEKVKLIIDAAGASGVNVLCLQEAWTMPFAFCTREKRWCEFAEPADGESTQFLQDLAQKYNMVIVSPILERDINHGEIIWNTVVVIGNNGNMIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNAFTSGDGKPQHADFGHFYGSSHFSAPDASCTPSLSRYRDGLMISDMDLNLCRQIKDKWGFRMTARYDMYANLLSEYLKPDFKPQVIADPLINKRKA

SEQ ID NO: 6023 - protein, 418 aa, Musa acuminata
MASHQRRDENGRAAAEEEDGSTTGSIHGFESLHRLLEANLKPQIFQEVSRLLLGLNCGRHLERVSLPQAATSLSAEHDFDLQAFCFHADKELLRQPRIVRVGLIQNAIGLPTTAHFVDQKNAIRQKVEPMIDAAGASGVNILCLQEAWMMPFCFCTREKKWCEFAEPFDGESTQFLQEFARKYNMVIVNSILERDIHHGETIWNTAVVIGNHGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEIFPNPFTSGDGKPQHSDFGHFYGSSHFSAPDASCTPSLSRYRDGLMVSDMDLNLCRQLKDKWGFRMTARYELYSEMLAKYLKPDFTPQVIVDPMLQKRNPL

SEQ ID NO: 6024 - protein, 233 aa, Carpinus betulus
MVIISSILERDVNHGETLWNTAVIIGNHGNIIGKHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEIFPNPFTSGDGKPQHADFGHFYGSSHFSAPDASCTPSLSRNRDGLLISDMDLNLCRQLKDKWGFRMTARYEVYAELLANYLKPDFEPQVITDPLLHKKTL

SEQ ID NO: 6025 - protein, 343 aa, Zea mays
MDLNLLVLQAFRFSADKEFLRQSRVVRVGLIQNSIAVPTTCHFADQKKAIMDKIKPLIDAAGASGVNIMCLQEAWTMPFAFCTREKRWCEFAEPVDGESTQFLQELAQKYNMVIVSPILERDINHGETIWNTAVVIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLIISDMDLNLCRQIKDKWAFRMTARYEMYASLLSEYLKPDFKPQVIVDPLINKKA

SEQ ID NO: 6026 - protein, 416 aa, Theobroma cacao
MEKSEGIEKENGTVEEKQSFKDGSICGYDSLQRLLSANLKPQIFQEVSRLLLGLNCGRPLETIVPPESAIALSSKHDFDLQAFSFSADKELLREPRVVRVGLIQNSIALPTTAPFLDQKKAIFKKLRPIIDAAGASGVNILCLQEAWMMPFAFCTREKRWCEFAEPDNGESTQFLQEFACKYNMVIINPILERDVNHGETLWNTAIIIGNHGNIIGKHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEIFPNPFTSGDGKPEHPDFGHFYGSSHFSAPDASCTPSLSRYKDGLLISDMDLNLCRQLKDKWGFRMTARYELYADILARYLKPDFEPQVIPDPLLHKKSS

SEQ ID NO: 6027 - protein, 416 aa, Gossypium hirsutum
MEKTDGIGKENGSTEEKQSFKDGSICGYNSLHHLLSANLKPQLYQEVSRLLLGLNCGKALETIVPPESAKALSSKHDFDLQAFKFSADKELLREPRVVRVGLIQNSIALPTTAPFSDQKKAIFEKLGPIIDAAGASGVNILCLQEAWMMPFAFCTREKRWCEFAEPVNGESTQFLQEFALKYNMVIISSILERDINHGETLWNTAVIIGNHGNIIGKHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEIFPNPFTSGDGKPPHPDFGHFYGSSHFSAPDASCTPSLSRYKDGLMISDMDLNLCRQLKDKWGFRMTARYELYADTLASYLKPDFEPQVISDPLLHKKSF

SEQ ID NO: 6028 - protein, 420 aa, Ipomoea nil
MENRKEDSNDVSGNCNAQPTTETSKNASICGFDSLHRLLQASLTPQLFQEVSRLLLGLNCGRAVEAIEVPEPAKALSAKHDFDLQAFSFHADKESLRQPRIVRVGLIQNSIALPTTAPFLEQKRAIFQKLKPIIDAAGTAGVNILCLQEAWTMPFAFCTREKRWCEFAEPVDGESTLFLQEFARKYNMVIISPILERDVKHGETLWNTCVVIGNHGNIIGIHRKNHIPRVGDFNESTYYMEGNTGHPVFETAYGKIGVNICYGRHHPLNWLAFGLNGAEIVFNPSATVGELSEPMWPIEARNAAIANSYFVASINRVGTEVFPNAFTSGDGKPEHTDFGHFYGSSHFSSPDASCTPSLSRYRDGLIISDMDLNLCRQLKDKWGFRMTARYEMYADLLSRYVKPDFEPQVISDPLLHKNAS

SEQ ID NO: 6029 - protein, 416 aa, Musa acuminata
MGSHQEREENGGAAAEGQEISAPGSIHGFESLHRLLEANLKPPIFQEVSRLLLGLNSWSPLQRISLPMAATTLSEAYNFDLQAFCFHADAEYLREPQIVRVGLIQNSIALPTTAHIADQKNALMQKVKPMIDAAGASDVNILCLQEAWMMPFAFCTREKKWCEFAEPVNGESTQFLQKLARKYNMVIVNPILERDVNHGETIWNTAIVIGNHGNIIGIHRKNHIPRVGDFNESTYYMEGNTGHPVFETAYGKIAINICYGRHHPLNWLAFGLNGAEIVFNPSATVGELSEPMWPIEARNAAIANSYFVGSINRVGTEIFPNAFTSGDGKPEHSDFGHFYGSSHFSAPDASCTPSLSRYRDGLMVSDMDLNLCRQLKDKWGFRMTARYELYAEMLSKYLKPDFTPQVIVDPMLQKRK

SEQ ID NO: 6030 - protein, 416 aa, Gossypium hirsutum
MEKTDGIGKENGSTEEKQSFKDGSICGYNSLHHLLSANLKPQIYQEVSRLLLGLNCGKTLETIVLPESAKALSSKHDFDLQAFKFSADQELLREPRVVRVGLIQNSIALPTTAPFSDQKNAIFEKLGPIIDAAGASGVNILCLQEAWMMPFAFCTREKRWCEFAEPVNGESTQFLQEFARKYNMVIISSILERDINHGETLWNTAVIIGNHGNIIGKHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEIFPNPFTSGDGKPQHPDFGHFYGSSHFSAPDASCTPSLSRYKDGLMISDMDLNLCRQLKDKWGFRMTARYELYADTLASYLKPDFEPQVISDPLLHKKSS

SEQ ID NO: 6031 - protein, 434 aa, Flaveria ramosissima
METKEEAVNENGNLEESSRTLKDGSICGFESLHRLLESSLSPQAFKEVSRLLTGLNCGKALEPLTIVETAKGLSSQHDFDIQAFRFNADKELLREPCIVRVGLIQNSIALPTTAPFLDQKKAIFQKLKPIIDAAGASGVNILCLQEAWMMPFAFCTREKRWCEFAEPADGESTQFLQGFARKYNMVIVNPILERDLKHGETIWNTAVIIGNNGNIIGKHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHVSAPDASCTPSLSRNRDGLLISDMDLNLCRQLKDKWGFRMTARYELYADMLSRYVKPDFEPQVISDPLLPKIICKRLEILLFMLYVDLCQL

SEQ ID NO: 6032 - protein, 407 aa, Fragaria vesca
MEEKNGQVEKSSDGSVCGYDSLHHLLSANLKPHLFQEVNRILLGLNCGKPLETISVPESAKGLSSQHDFDLQAFCFHADKELLREPRIVRVGLIQNSIAVPTTAHFMDQKREIFGKLKPIIDAAGVSGVNILCLQEAWTMPFAFCTREKRWCEFAEPVDGESTRFLQDLARKYNMVIISPILERDVNHGETLWNTAVIIGNHGNIIGKHRKNHIPRVGDFNESTYYMEGNTGHPVFETAYGKIAVNICYGRHHPLNWLAFGLNGAEIVFNPSATVGELSEPMWPIEARNAAIANSFFVGSINRVGTEVFPNPFTSGDGKPQHSDFGHFYGSSYFSAPDASCTPSLSRHCDGLLMSDMDLNLCRQIKDKWGFRMTARYELYADLLDRYLKPDFEPQVISDPMLHKKTA

SEQ ID NO: 6033 - protein, 477 aa, Pennisetum glaucum
STAGATVPARFVWPYGGKRVFVSGSFTRWSEHLQMSPVEGCPSVFQATCSLSPGMYQYKFFVDGEWRHDERQPTVSGEYGIVNTLYLTREINQINSVLSPSTPGTRMNMEVDSENFQRTVTVSDGNNQEGPLRVSEAAIQISRCRVIEYLSLHTGYDLLPDSGKVIALDVNLPVKQSFHILHEQGIPVAPLWDSFRGQFVGLLSPLDFILILKELETHGSNLTEEQLETHTISAWKEAKRQTYGRYEGRPHQPLVHVTPYESLRDIALKILQNGISTVPIIYSSSSDGSFPQLLHLASLSGILKCICRYFKNSTGNLPILNQPVCTIPLGSWVPRIGDPNGRPLAMLRRTASLSSALNMLIQAGVSSIPIVDDNDSLVDTYSRSDITALAKDKVYTHIRLEEMAIQQALQLGQDANTPFGHFNGQRCQMCLRSDPLLKVMERLSNPGVRRVFIVEAGSKRVEGIISLSDIFRFLLSL

SEQ ID NO: 6034 - protein, 491 aa, Panicum virgatum
MFSHGADSAHDAGGVGVSSAGATVPARFVWPYGGKRVFVSGSFTRWSEHLQMSPVEGCPTVFQAICSLSPGMHQYKFFVDGEWRHDERQPTISGEYGIVNTVYLTREINSVLSPSTPGTRMDVDNENFQRTVTLSDGNIQDGGPRVSEAAIQISRCRVSEYLSLHTGYDLLPDSGKVIALDINLPVKQSFHILHEQGIPVAPLWDSFRGQFVGLLSPLDFILILKELETHGSNLTEEQLETHTISAWKEAKRQTYGRHDGQWRPHQPLVHATPYESLRDIALKILQNGISTVPVIYSSSSDGSFPQLLHLASLSGILKCICRYFKNSTGNLPILNQPVCTIPLGSWVPKIGDPNSRPLAMLRPHASLSSALNMLVQAGVSSIPIVDENDSLLDTYSRSDITALAKDKVYTHVRLEEMTIHQALQLGQDANTRFGFFNGQRCQMCLRSDPLLKVMERLSNPGVRRVFIVEAGSKRVEGIISLSDIFKFLLSL

SEQ ID NO: 6035 - protein, 491 aa, Panicum virgatum
MFSHGADSAHDAGGVGVSSAGATVPARFVWPYGGKRVFVSGSFTRWSEHLQMSPVEGCPTVFQAICSLSPGMHQYKFFVDGEWRHDERQPTISGEYGIVNTVYLTREINSVLSPSTPGTRMDVDNENFQRTVTLSDGNIQDGGPRVSEAAIQISRCRVSEYLSLHTGYDLLPDSGKVIALDINLPVKQSFHILHEQGIPVAPLWDSFRGQFVGLLSPLDFILILKELETHGSNLTEEQLETHTISAWKEAKRQTYGRHDGQWRPHQPLVHATPYESLRDIALKILQNGISTVPVIYSSSSDGSFPQLLHLASLSGILKCICRYFKNSTGNFPILNQPVCTIPLGSWVPKIGDPNSRPLAMLRPHASLSSALNMLVQAGVSSIPIVDENDSLLDTYSRSDITALAKDKVYTHVRLEEMTIHQALQLGQDANTRFGFFNGQRCQMCLRSDPLLKVMERLSNPGVRRVFIVEAGSKRVEGIISLSDIFKFLLSL

SEQ ID NO: 6036 - protein, 496 aa, Zea mays
MFSHGADSAHDAGAVGVSSGGATVPTRFVWPYGGKRVFVSGSFTRWSEHLPMSPIEGCPTVFQAICSLSPGIHEYKFFVDGEWRHDERQPTISGEFGIVNTLYLTREYNQINTLSSPSTPGSRMNMDVDNENFQRTVTLSDGTVSEGTLRVSEAAIQISRCRVSEYLSLHTCYDLLPDSGKVIALDINLPVKQSFHILHEQGIPVAPLWDSFRGQFVGLLSPLDFILILRELETHGSNLTEEQLETHTISAWKEAKRQTNGRNDGQWRPQQHLVHATPYESLRDIAVKLLQNGISTVPVIYSSSSDGSFPQLLHLASLSGILKCICRYFKNSTGNLPILNQPVCSIPLGSWVPKIGDLNSRPLAMLRPNASLSSALNMLVQAGVSSIPIVDDNDSLLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 6037 - protein, 496 aa, Sorghum bicolor
MFSHGADSAHDAGAVGVSTGGATVPTRFVWPYGGKRVFVSGSFTRWSEHLPMSPVEGCPTVFQAICSLSPGIHEYKFFVDGEWRHDERQPTISGEFGIVNTLYLTREFNQLNALLSPSTPGSRMNMDVDNENFQRTVTLSDGTVPEGTPRVSEAAIQISRCRVSEYLNLHTCYDLLPDSGKVIALDINLPVKQSFHILHEQGIPVAPLWDSFRGQFVGLLSPLDFILILRELETHGSNLTEEQLETHTISAWKEAKRQTYGRNDGQWRPHQHLVHATPYESLRDIAVKLLQNGISTVPVIYSSSSDGSFPQLLHLASLSGILKCICRYFKNSTCNLPILNQPVCSIPLGSWVPKIGDPNSRPLAMLRPNASLSSALNMLVQAGVSSVPIVDENDALLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 6038 - protein, 497 aa, Zea mays
MFSHGADSAHDAGTVGVSSGVGATVPARFVWPYGGKRVFVSGSFTRWSEHLPMSPVEGCPTVFQAICSLSPGIHEYKFYVDGEWRHDERQPTISGEFGIVNTLYLTREFNQINALLNPSTPGSRMNMDVDNENFQHTVTLSDGTIPEGTVRVSEAAIQISRCRVSEYLNLHTCYDLLPDSGKVIALDINLPVKQSFHILHEQGIPVAPLWDSFRGQFVGLLSPLDFILILRELETHGSNLTEDQLETHTISAWKEAKRQTCGRNDGQWRAHQHLVHATPYESLRDIAVKLLQNDISTVPVIYSSSSDGSFPQLLHLASLSGILKCIFRYFKNSTGNLPILNQPVCSIPLGSWVPKIGDPNSRPLAMLRPNASLSSALNMLVQAGVSSIPIVDENDSLLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 6039 - protein, 494 aa, Brachypodium distachyon
MFSHGADSARDAAGAAVGVSAAVPTRFVWPYGGKRVFLTGSFTRWSEHLPMSPVEGCPAVFQAICSLSPGIYQYKFFVDGEWKHDERQPTITGDYGVVNTLYLTREYDHINNVLSPSTPGSRANMDVDNDSFHRTVSLSDGALQEGPPRISEAAIQISRCRVSEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQWRSNQHLVHATPFESLRDIALKILQTGVSTVPIIYSTVSDGSFPQLLHLASLSGILKCICRYFKNSTGSLPILNQPVCTIPLGTWVPKIGDPNGHPLAMLRPNTSLSSALNLLVQAGVSSIPIVDDSDSLLDTYSRSDITALAKDKVYTHIRLDEMTIHQALQLGQDANSPFGLFNGQRCQMCLRSDPLLKVMERLANPGVRRVFIVEAGSKRVEGIISLSDVFKLLLS

SEQ ID NO: 6040 - protein, 493 aa, Oryza sativa
MFSHGADSAHDAGAVSTGASGVPTRFVWPYGGKRVYLTGSFTRWTEHLPMSPVEGCPTVFQAICSLSPGIHQYKFCVDGEWRHDERQPTITGDYGVVNTLCLTRDFDQINTILSPSTPGSRMNMDVDNDNFQRTVSLSDGIIQEGPQRISEAAIQISRCRVADFLNGQTGYDLLPDSGKVIALDVNLPVKQSFHILHEQGIPVAPLWDSFRGQFVGLLSPLDFILILRELETHGSNLTEEQLETHTISAWKEAKRQTYARNEGSWRANHHLVHATPYESLREIAMKILQNGVSTVPIMFSSSPDGSYPQLLHLASLSGILKCICRYFKNSQGNLPILSQPVCTIPLGTWVPKIGDPNGRPLAMLRPNTSLSAALNLLVQAGVSSIPIVDDNDSLLDTYSRSDITALAKDKVYTHIRLDEMTIHQALQLGQDANSPFGFFNGQRCQMCLRSDTLLKVMERLANPGVRRVFIVEAGSKRVEGIISLSDIFKFLLS

SEQ ID NO: 6041 - protein, 497 aa, Triticum aestivum
MFSHGADPAHDASAAGGGVSVSAGGPLVHTRFVWPHGGKRVFLSGSFTRWSEHLPMSPVEGCPTVFQAICSLPPGIYQYKFNVDGQWRHDEGQPTITGEYGVVNTLYLTREFDHINTVLSPTTPGSRMDVDNDSFQRMGSLLDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHATPYESLRGIAMKILETGISTVPIIYSSSTDGSFPQLLHLASLSGILKCICRYFKNSTGSLPILNQPVCSIPLGTWVPKIGEPNGHPLAMLRPNTSLSSALNLLVQAGVSSIPIVDDNDSLIDTYSRSDITALAKDKVYTHIRLDEMTIHQALQLGQDANSPFGLFNGQRCQMCLRSDPLLKVMERLANPGVRRVFIVEAGSKRVEGVISLSDIFKLLLS

SEQ ID NO: 6042 - protein, 497 aa, Triticum aestivum
MFSHGADPAQDASAAGGGVGVSAGGPAVPTRFVWPHGGKRVFLSGSFTRWSEHFPMSPVEGCPTVFQAICNLPPGIYQYKFNVDGQWRHDEGQPTITGEYGVVNTLYLTREFDHINTVLSPTTPGSRMDVDSDSFQRMGSLSDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHATPYESLRGIAMKILETGISTVPIIYSSSSDGSFPQLLHLASLSGILKCICRYFKNSTGSLPILNQPVCSIPLGTWVPKIGEPNGHPLAMLRPNTSLSSALNLLVQAGVSSIPIVDDNDSLIDTYSRSDITALAKDKVYTHIRLDEMTIHQALQLGQDANSPFGLFNGQRCQMCLQSDPLLKVMERLANPGVRRVFIVEAGSKRVEGVISLSDIFKLLLS

SEQ ID NO: 6043 - protein, 449 aa, Secale cereale
MWSEHLPMSPVEGCPTVFQAICNLPPGIYQYKFNVDGQWRHDEGQPTITGEYGVVNTLYLTREFDHINTVLSPTTPGSRMDVDNDSFQRMGSLSDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHATPYESLRGIAMKILETGISTVPIIYSSSSDGSFPQLLHLASLSGILKCICRYFKNSTGSLPILNQPVCSIPLGTWVPKIGEPTGHPLAMLRPNTSLSSALNLLVQAGVSSIPIVDDNDSLIDTYSRSDITALAKDKVYTHIRLDEMTIHQALQLGQDVNSPFGLFNGQRCQMCLRSDPLLKVMERLANPGVRRVFIVEAGSKRVEGVISLSDVFKLLLS

SEQ ID NO: 6044 - protein, 497 aa, Secale cereale
MFSHGADPAHDASAAGGGVGVSAGGPAVPTRFVWPHGGKRVFLSGSFTMWSEHLPMSPVEGCPTVFQAICNLPPGIYQYKFNVDGQWRHDEGQPTITGEYGVVNTLYLTREFDHINTVLSPTTPGSRMDVDNDSFQRMGSLSDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHVTPYESLRGIAMKILETGISTVPIIYSSSSDGSFPQLLHLASLSGILKCICRYFKNSTGSLPILNQPVCSIPLGTWVPKIGEPTGHPLAMLRPNTSLSSALNLLVQAGVSSIPIVDDNDSLIDTYSRSDITALAKDKVYTHIRLDEMTIHQALQLGQDVNSPFGLFNGQRCQMCLRSDPLLKVMERLANPGVRRVFIVEAGSKRVEGVISLSDVFKLLLS

SEQ ID NO: 6045 - protein, 497 aa, Hordeum vulgare
MFSHGADPAHDASAAGGGVGVSAGGPAVPTRFVWPHGGKRVFLSGSFTRWSEHLPMSPVEGCPTVFQAICSLPPGIYQYKFNVDGQWRHDEGQPTITGEYGVVNTLYLTREFDHINTVLSPITPGSRMDVDGESSQRMGSLSDGALQEGSPRISEAAIQISRCRVAEYLNAHIGYDLLPDSGKVIALDINLPVKQSFHILHEQGIPVAPLWDSIRGQFVGLLSPLDFILILRELETHGSNLTEEQLETHTISAWKEAKRQTYGRNDGQLRSNQHLVHATPYESLRGIAMKILETGISTVPIIYSSSSDGSFPQLLHLASLSGILKCICRYFKNSTGSLPILNQPVCSIPLGTWAPKSGEPNGHPLAMLRPNTSLSSALNLLVQAGVSSIPIVDDNDSLIDTYSRSDITALAKDKVYTHIRLDEMTIHQALQLGQDANSPFGLFNGQRCQMCLRSDTLMKVMERLANPGVRRVFIVEAGSKRVEGVISLSDIFKLLLS

SEQ ID NO: 6046 - protein, 477 aa, Triticum aestivum
VSAGGPAVHTRFVWPHGGKRVFLSGSFTRWSEHFPMSPVEGCPTVFQAICSLPPGIYQYKFNVDGQWRHDEGQPTITGEYGVVNTLYLTREFDHINTVLSPTTPGSRMDVDNDSFQRMGSLSDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHATPYESLRGIAMKILETGISTVPIIYSSSSDGSFPQLLHLASLSGILKCICRYFKNSTGSLPILNQPVCSIPLGTWVPKIGEPNGHPLAMLRPNTSLSSALNLLVQAGVSSIPIVDDNDSLIDTYSRSDITALAKDKVYTHIRLDEMTIHQALQLGQDANSPFGLFNGQRCQMCLRSDPLLKVMERLANPGVRRVFIVEAGSKRVEGVISLSDIFKLLLS

SEQ ID NO: 6047 - protein, 416 aa, Pennisetum glaucum
LAPLRLRAGRGAIATPSPPAALSAAALPRRGPAAAASIHRDWALRVSAPSRLTSTVEGEDAAGGVFDPGAPPPFGLAEIRAAIPKHCWVKDPWRSMSYVLRDVVIVLGLAAAAARLDSWLVWPLYWAAQGTMFWALFVLGHDCGHGSFSNNAKLNSVVGHILHSSILVPYHGWRISHRTHHQNHGHVEKDESWHPLPERLYNSLDFMTRKLRFTMPFPLLAFPLYLFKRSPGKKGSHFNPSSELFQPNEKKDIITSTTSWLAMVGILAGLTFVMGPIQMLKLYAVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGPLPLHLFGVLSESLKQDHYVSDTGDVLYYQTDKKMT

SEQ ID NO: 6048 - protein, 444 aa, Panicum virgatum
MARLVLSECCGLAPLRLRSGRGAIAAPAPPAALSAAAVPRGPAAAAIHRDWALRVSAPTRLASAVDEGGRRSAPLGEEEKAAAGGDFDPGAPPPFGLAEIRAAIPKHCWVKDPWRSMSYVLRDVVVVLGLAAAAARLDSWLVWPLYWAAQGTMFWALFVLGHDCGHGSFSNNPKLNSVVGHILHSSILVPYNGWRISHRTHHQNHGHVENDESWHPLPERLYNSLDFMTKKLRFTMPFPLLAFPLYLFKRSPGKTGSHFNPSSDLFQPNEKKDIITSTASWLAMVGLLAGLTFVMGPIQMLKLYAVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGPLPLHLFGVLSESLKQDHYVSDTGDVVYYQIDKMMNTSAQNSD

SEQ ID NO: 6049 - protein, 451 aa, Sorghum bicolor
MARLVLSECCGLAPLRLRAGRRGAAIAAPSPAALSVAAAAVVPGRPASAAIHRDWALRVSAPTRLTSAVEEDKRSSPLGEEGVADSGAAGGDGFDPGAPPPFGLAEIRAAIPKHCWVKDPWRSMSYVLRDVVVVLGLAAAAARLDSWLVWPLYWAAQGTMFWALFVLGHDCGHGSFSNNPKLNSVVGHILHSSILVPYHGWRISHRTHHQNHGHVEKDESWHPLPERLYKSLDFMTKKLRFTMPFPLLAFPLYLFARSPGKTGSHFNPSSDLFQPNEKKDIITSTASWLAMVGVLAGLTFMMGPIPMLKLYGVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGALPWHLFGVLAQSLKQDHYVSDTGDVVYYQTDSKTNTSAQKSD

SEQ ID NO: 6050 - protein, 443 aa, Zea mays
MARLVLSECCGLAPLRRLRAGRGAIAAPSPPALSAAPRRRPASASIHRDWALRVSAPTRLASAAVEEDKPSAAPGQEEGAAAGGEFDPGAPPPFGLAEIRAAIPKHCWVKDPWRSMSYVLRDVAVVLGLAAAAARLDSWLVWPLYWAAQGTMFWALFVLGHDCGHGSFSNNPKLNSVVGHILHSSILVPYHGWRISHRTHHQNHGHVEKDESWHPLPERLYKSLDFMTRKLRFTMPFPLLAFPLYLFARSPGKSGSHFNPGSDLFQPTEKNDIITSTASWLAMVGVLAGLTFLMGPVPMLKLYGVPYLVFVAWLDMVTYLHHHGHEDKLPWYRGKEWSYLRGGLTTLDRDYGWINNIHHDIGTHVIHHLFPQIPHYHLIEATEAAKPVLGKYYKEPKKSGALPWHLFRVLAQSLKQDHYVSDTGDVVYYQAESKTSTSALKSD

SEQ ID NO: 6051 - protein, 403 aa, Panicum virgatum
AAAAIHRDWALRVSAPTRLASAVDEGDRRSAPLVEEEEAAGADFDPGAPPPFGLAEIRAAIPKHCWVKDPWRSISYVLRDVVVVLGLAAAAARLDSWLVWPLYWAAQGTMFWALFVLGHDCGHGSFSNNPKLNSVVGHILHSSILVPYHGWRISHRTHHQNHGHVEKDESWHPLPERLYKSLDFMTKKLRFTMPFPLLAFPLYLFKRSPGKTGSHFNPSSELFQPNEKKDIITSTASWLAMVGLLAGLTFVMGPIQMLKLYAVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGPLPLHLFGVLSESLKQDHYVSDTGDVVYYQTDKMITPLHKIQIDI

SEQ ID NO: 6052 - protein, 458 aa, Oryza sativa
MARLVLSECCGLTPLRLRGRGAIALPAPPSLAAGPRRPVSAAAAGGAIHREWALRVSAPTRLTSVVEEDNRGEEVVEEEARGSLAAAEAAAGEVGGDGDGFDPGAPPPFGLAEIRAAIPKHCWVKDPWRSMSYVLRDVVVVLGLAAAAARVDSWLVWPLYWAAQGTMFWALFVLGHDCGHGSFSSNAKLNSVVGHILHSSILVPYHGWRISHRTHHQNHGHVEKDESWQPLSERLYNSLDYMTKKLRFTMPFPMLAFPLYLFARSPGKKGSHFNPSSDLFQPNEKKDVITSTASWLAMVGILAGLTFVMGPLKMLKLYAVPYVIFVMWLDFVTYLHHHGHEDKLPWYRGKEWSYLRGGLTTLDRDYGWINNVHHDIGTHVIHHLFPQIPHYHLVEATEAAKPVLGKYYKEPEKSAPLPFHLLGVLAKSLNSDHYVSDTGDVVYYQTDLKTSSSAQSSD

SEQ ID NO: 6053 - protein, 396 aa, Panicum virgatum
RDWALRVSAPTRLASAVDEGGRRSAPLGEEEKAAAGGDFDPGAPPPFGLAEIRAAIPKHCWVKDPWRSMSYVLRDVVVVLGLAAAAARLDSWLVWPLYWAAQGTMFWALFVLGHDCGHGSFSNNPKLNSVVGHILHSSILVPYNGWRISHRTHHQNHGHVENDESWHPLPERLYNSLDFMTKKLRFTMPFPLLAFPLYLFKRSPGKTGSHFNPSSDLFQPNEKKDIITSTASWLAMVGLLAGLTFVMGPIQMLKLYAVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGPLPLHLFGVLSESLKQDHYVSDTGDVVYYQIDKMMNTSAQNSD

SEQ ID NO: 6054 - protein, 442 aa, Brachypodium distachyon
MTRLVLSESCGGLAPLRARGGRRCAIALPPPLHLAAGPRRPFSAAAAFHRGWALRVSSPTRLASVIQDEEDDKRSSPSQGEDAEFNPGAPPPFGLAEIRAAIPKHCWVKDPWRSMSYVLRDVLVVLGLAAAAARVDSWLVWPLYWAAQGTMFWALFVLGHDCGHGSFSSNPKLNSVVGHILHSSILVPYNGWRISHRTHHQNHGHVEKDESWHPLPQRLYNSLDTMTKKLRFSMPFPMLAFPLYLFARSPGKAGSHFDPNSDLFQPNEKKDVLTSTASWLAMAGILAGLTFVMGPLQMLKLYAIPYVVFVMWLDFVTYLHHHGHEDKLPWYRGKEWSYLRGGLTTLDRDYGLINNVHHDIGTHVIHHLFPQIPHYHLVEATEAAKPVLGKYYKEPEKSGPLPFHLLEALSRSLKSDHYVSDTGDVVYYQSESETSTSAQSSD

SEQ ID NO: 6055 - protein, 436 aa, Hordeum vulgare
MARLALSDCRGLTPLRARSAIALPSPPHLAAGPRRPAPAAIHRDWALRVSAPTRLASVLEEDKRGLGGAEEAGSSSAGFNPGAPPPFGLAEIRAAIPKHCWVKDPWRSMSYVLRDVLVVLGLAAAAARADSWLVWPLYWAAQGTMFWALFVLGHDCGHGSFSSNPKLNSVVGHILHSSILVPYNGWRISHRTHHQNHGHVEKDESWHPLPQRLYNSLDSMTKKLRFSMPFPMLAFPLYLFARSPGKEGSHFNPNSDLFQPNEKKDVLTSTASWLAMIGVLAGLTFVMGPLKMLKLYAIPYVIFVMWLDFVTYLHHHGHEDKVPWYRGKEWSYLRGGLTTLDRDYGLINKIHHDIGTHVIHHLFPQIPHYHLVEATEAAKPVLGKYYKEPEKSAPLPFHLLQVLSRSLKKDHYVSDTGDIVYYQSESETSTSGQRSD

SEQ ID NO: 6056 - protein, 439 aa, Triticum aestivum
MARLALSDCRGLTPLRARSRGSAIALPSPPHLAAGPRRAAPAAIHRDWALRVAAPTRLASVFEEDRRGLGGAEEAGSSSAGFNPGAPPPFGLAEIRAAIPKHCWVKDPWRSMSYVLRDVLVVLGLAAAAARADSWLVWPLYWAAQGTMFWALFVLGHDCGHGSFSSNPKLNSVVGHILHSSILVPYNGWRISHRTHHQNHGHVEKDESWHPLPQRLYNSLDNMTKKLRFSMPFPMLAFPLYLFARSPGKEGSHFNPNSDLFQPNEKKDVLTSTASWLAMIGVLAGLTFVMGPLKMLKLYAVPYVIFVMWLDFVTYLHHHGHEDKVPWYRGKEWSYLRGGLTTLDRDYGLINNIHHDIGTHVIHHLFPQIPHYNLVEATEAAKPVLGKYYKEPEKSAPLPFHLLQVLSRSLKEDHYVSDTGDIVYYQSESETSTSAQSSD

SEQ ID NO: 6057 - protein, 339 aa, Panicum virgatum
MFWRDGGGTGGGNGRDSLSGGLPCGQVRVLVVGDSGVGKSSLVHLLLNGSAVARPAQTIGCAVGVKHITYSSPGSSSNSIKADAERNFFVELWDVSGHERYKECRSLFYSQINGVIFVFDLSQRKTKTNLNKWAVEVAESGTFSAPLGSGGPGGLPVPYLVIANKVDIAPRDGRRVSSGNLVDVARQWVEKQGLLPPSEELPLADSFPGNSGLLTAAKEARYDKEALNKFFRMLIRRRYFSNELPAPSPWSLTPREDTILPVETVNDDDLFQRKSYGGQSYKYNGVAPLPAQRNLTPPPTLYPQQPMSSSSENYRYHRFSSSSIPDSGGGRTSRADINI

SEQ ID NO: 6058 - protein, 339 aa, Panicum virgatum
MFWRDGGGTGGGNGRDSLSGGLPCGQVRVLVVGDSGVGKSSLVHLLLNGSAVARPAQTIGCAVGVKHITYSSPGSSSNSIKADAERNFFVELWDVSGHERYKECRSLFYSQINGVIFVYDLSQRKTKTNLNKWAVEVAESGTFSAPLGSGGPGGLPVPYLVIANKVDIAPRDGRRVSSGNLVDVARQWVEKQGLLPPIEELPLADSFPGNSGLLTAAKEARYDKEALIKFFRMLIRRRYFSNELPAPSPWSLTPREDTILPVETVNDDDLFQRKSYGGQSYKYNGVAPLPAQRNLTPPPTLYLQQPMSSSSENYRYHRFSSSSIPDSGGGRTSRADINI

SEQ ID NO: 6059 - protein, 338 aa, Sorghum bicolor
MFWKDGGGTGGGNGRDLSGGPPCGQVRVLVVGDSGVGKSSLVHLLLKGSAVARPAQTIGCAVGVKHITYSSPGSSSNSIKGDAERNFFVELWDVSGHERYKDCRSLFYSQINGVIFVYDLSQRKTKTNLNKWAVEVAESGTFSAPLGSGGPGGLPVPYLVIANKVDIAPRDGRRVSSGNLVDVARQWVEKQGLLPSSEELPLADSFPGNSGLLTAAKEGRYDKEALIKFFRMLIRRRYFSNELPAPSPWSLTPREDTILPVESVNDDDMFQRKSYGGQSYKYNGVAPLPAQRNLTPPPTLYPQQPMSSSSENYRYHRFSSSSIPDSSGGRTSRANLNI

SEQ ID NO: 6060 - protein, 339 aa, Zea mays
MLFWKDGGGTGGGNGRDLSGGPPCGQVRVLVVGDSGVGKSSLVHLLLKDSAVARPAQTIGCAVGVKHITYSSPGSSSNSVKGDAERNFFVELWDVSGHERYKECRSLFYSQINGVIFVYDLSQRKTKTNLNKWAVEVSESGTFSAPLGSGGPGGLPVPYLVIANKVDIAPRDGRRVSSGNLVDVARQWVEKQGLLPSSEVLPLADNFPGNSGLLTAAKEARYDKEALIKFFRMLIRRRYFSNELPAPSPWSLTPREDTILPVETVNDDDMFQRKSYGGQSYKYNGVTPLPAQRNLTPPPTLYPQQPMSSSSENYRYHRFSSSSIPDSSGGSKSRANLNI

SEQ ID NO: 6061 - protein, 343 aa, Oryza sativa
MRFWRDSGGGGSGGGRDLNGGGTPCGQVRVLVVGDSGVGKSSLVHLILKGSAIARPPQTIGCAVDVKHITYGSPGSSSNSINSIKGDAERNFFVELWDVSGHERYKECRSLFYSQINGVIFVYDLSQRKTKTNLNKWAVEVAESGTFSAPLGSGGPGGLPVPYLVIANKVDIAPRDGKRVSSGNLVDVARQWVEKQGLLPSSEELPLAESFPGNSGLLTAAKVARYDKEALVKFFRMLIRRRYFSNELPAPSPWSLTPREDTILPVETTNDDDLFQRKSYAGQSYKYSGVTPLPAQRNLTPPPTLYPQQPMSSSSENYRYHRFSSSAIPDASSSRTNRADINI

SEQ ID NO: 6062 - protein, 337 aa, Brachypodium distachyon
MRFWRDGGASGSGRELNGGPPCGQVRVLIVGDSGVGKSSLAHLILKDFAIARPPQTIGCTVDVKHITYGSPGSSSNTIKGDAERNFFVELWDVSGHERYRDCRSLFYSQINGVIFVYDLSQRKTKANLSKWAVEVAESGTFSAPLGSGGPGGLPVPYLVIANKVDIAPRDGRRVSSGNLVDVARQWVEKQGLLPSSEELPLVESFPGNSGLLTAAKEARYDKEAVVKFFRMLIRRRYFSNELPAPSPWSLTPREDTILPVETVNDEELFKRKSYGGQSYKYNGVAPLPAQRNLTPPLTPYPQQPMSSTSENYRYHRYSSSSIPDASSSRANRLDLNL

SEQ ID NO: 6063 - protein, 337 aa, Secale cereale
MRFWRDGGASGSGRDLNGGMPYGQVRVLVVGDSGVGKSSLARLILEGSAIARPTQTIGCTVDVKHITYGSPGSSSNSIVGDAERNFFVELWDVSGHDRYRDCRSLFYSQINGVIFVYDLSQRKTKTNLSKWAVEVAESGTFSAPLGSGGPGGLPVPYLVIANKVDIAPRDGRRVSSGNLIDVARQWVDKQGLLPSSEELPLVDSFPGNSGLLTAAKEARYDKEAVVKFFRMLIRRRYFSNELPPPSPWSLTPRGDTILPVETTNDEELFKRKSYGGQRYKYNGVAPLSAQQNVTLPLTPSPQQPMSSSAENYRYHRFSSSSIPDKNSSRTSRLDINL

SEQ ID NO: 6064 - protein, 300 aa, Saccharum officinarum
MFWKDGGGTGGGNGRDLSGGPPCGQVRVLVVGDSGVGKSSLVHLLLKGSAVARPAQTIGCAVGVKHITYSSPGSSSNSIKGDAERNFFVELWDVSGHERYKNCRSLFYSQINGVIFVYDLSQRKTKTNLNKWAVEVAESGTFSAPLGSGGPGGLPVPYLVIANKVDIAPRDGRRVSSGNLVDVARQWVEKQGLLPSSEELPLADSFPGNSGLLMAAKEARYDKEALIKFFRMLIRRRYFSNELPAPSPWSLTPREDTILPVETVNDDDMFQRKSYSGQSYKYNGVAPLPAQRNLTPPPTL

SEQ ID NO: 6065 - protein, 337 aa, Triticum aestivum
MRFWRDGGASGSGRDLNGGMPYGQVRVLVVGDSGVGKSSLARLILQGSAIARPTQTIGCTVDVKHITYGSPGSSSNSIVGDAERNFFVELWDVSGHDRYRDCRSLFYSQINGVIFVYDLSQRKTKTNLSKWAVEVAESGTFSAPLGSGGPGGLPVPYLVIANKVDIAPRDGRRVSSGNLIDVARQWVDKQGLLPSSEELPLVDSFPGNSGLLTAAKEARYDKEAVVKFFRMLIRRRYFSNELPAPSPWSLTPRGDTILPVETTNDEELFKRKSYGGQRYKYNGVAPLSAQQNVTLPLTPSPQQPMSSSAENYRYHRFSSSAIPDKNSSRTSRLDINL

SEQ ID NO: 6066 - protein, 337 aa, Triticum aestivum
MRFWRDGGASGSGRDLNGGMPYGQVRVLVVGDSGVGKSSLARLILHGSAIARPTQTIGCTVDVKHITYGSPGSSSNSVVGDAERNFFVELWDVSGHDRYRDCRSLFYSQINGVIFVYDLSQRKTKTNLSKWAVEVAESGTFSAPLGSGGPGGLPVPYLVIANKVDIAPRDGRRVSSGNLIDVARQWVDKQGLLPSSEELPLVDSFPGNSGLLTAAKEARYDKEAVVKFFRMLIRRRYFSNELPAPSPWSLTPRGDTILPVETMNDEELFKRKSYGGQRYKYNGVAPLSAQQNVALPLTPSPQQPMSSSAENYRYHRFSSSAIPDKNNSRTSRLDINL

SEQ ID NO: 6067 - protein, 337 aa, Hordeum vulgare
MRFWRDGGASASGRDLNGGMPYGQVRVLIVGDSGVGKSSLAHLILQGSAIARPTQTIGCTVDVKHITYGGLGSSSNSIIGDAERNFFVELWDVSGHDRYRDCRSLFYSQINGVIFVYDLSQRKTKTNLSKWAVEVAESGTFSAPLGSGGPGGLPVPYLVIANKVDIAPRDGRRVSSGNLIDVARQWVDKQGLLPSNEELPLVDSFPGNSGLLTAAKEARYDKEAVVKFFRMLIRRRYFSNELPAPSPWSLTPRGDTILPVETTNDEELFKRKSYGGQRYKYNGVAPLSAQQNVTLPLSPSPQQPMSSSAENYRYHRFSSSAIPDKNSSRTSRLDINL

SEQ ID NO: 6068 - protein, 244 aa, Sorghum bicolor
MSETGHTVQVTNLSSRVSESDLHEFFSFSGPIEHIELIRSEDYGATAYVTFKERFALETAVLLSGATIVDQPVCITYWGQPEETFNFWDRPTWETEEEIEYRNYQTCQYNTTPQEAFTVAQDIMKTMLAKGYVLSKDALAKARAFDESHGLTAAAAARAAELSKRIGLTDRVNAGVGAMRSVDETYRVRETTKTVATATGRTAAKVVNGIVTSSYFSAGAMMLSDALTRAAKAAADLAAHGRQS

SEQ ID NO: 6069 - protein, 244 aa, Saccharum officinarum
MSETGHTVQVTNLSSRVSESDLHEFFSFSGPIEHIELIRSEEYGATAYVTFKERFALETAVLLSGATIVDQPVCITYWGQPEETFNFWDRPTWEVEEEIEYRNYQTCQYNTTPQEVFTVAQDIMKTMLAKGYVLSKDALAKARAFDESHGLTAAAAARAAELSKRIGLTDRVNAGVGAMRSVDETYRVTETTKTVATATGRTAAKVANGIVTSSYFSAGAMMLSDALTRAAKAAADLAAHGRQS

SEQ ID NO: 6070 - protein, 244 aa, Zea mays
MSETGHTVQVTNLSSRVSESDLYEFFSFSGPIEHVELIRSGEYGATAYVTFKERFALETAVLLSGATIVDQPVCITYWGQPEETFNFWDRPTWEVEEEIEYTSYQSCQYNTTPQEALTVAQDIVKTMLAKGYVLSKDALAKARAFDESRGLTAAAAAKAAELSKRIGLTDRVSAGVGAMRSVDETYRVTETTKTVATATGRTAAKVVNGIVTSSYFSAGAMMLSDALTRAAKAAADLAAHGRQS

SEQ ID NO: 6071 - protein, 251 aa, Panicum virgatum
MSETGYTVQVTNLSSRVSESDLHEFFSFSGPIEHIELIRAGEYGSTAYVTFKERYALETAALLSGATIVDQPVCITYWGQPEETFNFWDRPSWEVEEEIEYRNYQACQLNTTPQEALTVAQDVVKTMLAKGYVLSKDALAKARAFDESRGLTASAAAKAAELSKRIGLTDRVNAGVSAINAGVGAMRSVDETYRVSETTKTVATATGRTAVKVANSIVTSSYFSAGAMMVSDALTRAAKAAADLAAHGRQS

SEQ ID NO: 6072 - protein, 251 aa, Panicum virgatum
MSETGYTVQVTNLSSRVSENDLHEFFSFSGPIEHIELIRSGEYGSTAYVTFKERYALETAALLSGATIVDQPVCITYWGQPEETFNFWDRPSWEVEEEIEYRNYQACQFNTTPQEALTVAQDVVKTMLARGYVLSKDALAKARAFDESRGLTASAAAKAAELSKRFGLTDRVNAGVSAINAGVGAMRSVDETYRVSETTKTVATATGRTAAKVANSIVTSSYFSAGAMMVSDAFTRAAKAAADLAAHGRQS

SEQ ID NO: 6073 - protein, 251 aa, Setaria italica
MSETGYTVQVTNLSGRVSESDLHEFFSFSGPIEHIELIRSGEYGATAYVTFKERYALETAVLLSGATIVDQPVCITYWGQPEETFSFWDRPTWEVEEEIEYRNYQSCQFNTTPQEALTVAQDVVKTMLARGYVLSKDALAKARAFDESRGYTAAAAAKAAELSKRFGLTDRVNAGVGALSAGVGAMRSVDETYGISETTKTVATATGRTAAKVANSIVTSSYFSAGAMMVSDALNRAAKAAADLAAHGRQS

SEQ ID NO: 6074 - protein, 251 aa, Panicum virgatum
MSETGYTVQVTNLSSRVSENDLHEFFSFSGPIEYIELIRSGEYGSTAYVTFKERYALETAALLSGATIVDQPVCITYWGQPEESFNFWDRPSWEVEEEIEYRNYQACQFNTTPQEALTVAQDVVKTMLARGYVLSKDALAKARAFDESRGLTASAAAKAAELSKRFGLTDRVNAGVSAINAGVGAMRSVDETYRVSETTKTVATATGRTAAKVANSIVTSSYFSAGAMMVSDAFTRAAKAAADLAAHGRQS

SEQ ID NO: 6075 - protein, 251 aa, Pennisetum glaucum
MSETGYTVQVTNLSGRVSESDLHEFFSFSGPIEHIELIRSGEYGATAYVTFKERYALETAVLLSGATIVDQPVCITYWGQPEETFSFWDRPTWESEEEIEYRNYQSCQFNTTPQQALTVAQDVVKTMLAKGYVLSKDALAKARAFDESRGYTAAAAAKAAELSMRFGLTPHINTGVGALNAGVGAMRSVDETYRILETTKTVATATGRTAAKVANNIVTSSYFSAGAMMVSDALTRAAKAAADLAAHGRQS

SEQ ID NO: 6076 - protein, 792 aa, Sorghum bicolor
MDPEFGVGTAPRKREAWRTTLLLAYQSLGVVYGDLSISPLYVYKSTFAEDITHSEGNEEIYGALSFVFWTLTLIPLLKYVTIVLRAHDNGEGGTFALYSLICRHANVCLLPNRQLADQDLSTYSLQRPHDAAGTCAPSPVKAWLENHTKLHTALLVMVMIGTCMVIGDGVLTPAISVFSAVSGLELSLSKDQHEYAVIPITCAILVFLFALQHYGTHRVGFLFAPIILAWLLCMSTIGLYNIIRWNPQIYTALNPSYMIRFLRKTKKSGWMSLGGILLCMTGSEAMFADLGHFSYSSIQLAFTSLVYPSLILGYMGQAAYLSQHHNLDASYQIGFYIAVPESVRWPVLVLAILASVVGSQAIISGTFSIINQSQSLSCFPRVKVVHTSDKVHGQIYIPEVNWILMILCVAVTVGFRNTKHMGNASGLAVITVMLVTTCLMSLVIMLCWDRSPWLALAFFLFFGSIEALYFSASLIKFLEGAWLPIFLALILLAIMFVWHYTTIRKYEYDMHNKVTLEWLLALGDKLGMVRVPGIGLVYTDLTSGVPANFSRFVTNLPAFHRVLVFVCVKSVTVPHVLPAERYLVGRVGPPGHRSYRCIVRYGYRDVHQDVDSFETELVESLATFIKLDALFRCSDAGGEQRDSSYYERENALTVIGSNPLRRHMSLGYDDSHSHDDGASSDSDSVDGIELAASAPAPAAVKKQVRFAVPPPRSPGVDESVLEELHELCEAREAGTAFILGHSHVKTKPGSSLLKRLAVGVGYNFLRRNCRGPDVALRVPPASLLEVGMVYVL

SEQ ID NO: 6077 - protein, 788 aa, Setaria italica
MDTEFGVGMAPRKRESWRTTLLLAYQSLGVVYGDLSISPLYVYKSTFAEDITHSETNEEIYGALSFVFWTLTLIPLIKYVTIVLRADDNGEGGTFALYSLICRHANVSLLPNRQVADEELSTYKLECPPEVAQRSRVKEWLEKHKKLHTALLVMVMIGTCMVIGDGVLTPAISVFSAVSGLELSLSKHQHEYAVIPITCAILVFLFALQHYGTHRVGFLFAPIVLCWLLCMSAIGLYNIIHWNPHVYQALNPCYMITFLKKTRKSGWMSLGGILLCMTGSEAMFADLGHFSYSAIQLAFTSLVYPSLILGYMGQAAYLSKHHNFDASYQIGFYIAVPESVRWPVLVLAILASVVGSQAIISGTFSIINQSQSLSCFPRVKVVHTSAKIHGQIYIPEVNWMLMILCIAVTVGFRNTKHMGNASGLAVITVMMVTTCLMSVVIMLCWHRSPLLALAFFLFFGSIEALYFSASLIKFLEGAWVPILLSLILLAVMFVWHHTTIKKYEYDMQNKVTLEWLLALGDKLGMVRVPGIGLVYTDLTSGVPANFSRFVTNLPAFHRVLVFVCVKSVPVPHVLPAERYLVGRVGPPGHHSYRCIVRYGYRDVHQDVDSFETELVESLATFIKLDALFRCSDAGGEQRDSSYYERENALTVIGSNPLRRHLGLGYDDSHDGVSSAHEAAGSANGIELAAAAPAIKKQVRFAVESAAPRSPGVDERVLEELQELCEAREAGTAFILGHSHVQTKPGSSVLKKLAVGVGYNFLRRNCRGPDVVLRVPPASLLEVGMVYVL

SEQ ID NO: 6078 - protein, 845 aa, Panicum virgatum
MDPEFGVGTAPRKRESWRTTLLLAYQSLGVVYGDLSISPLYVYKSTFAEDIKHSDTNEEIFGALSFVFWTLTLIPLIKYVTVVLRADDNGEGGTFALYSLICRHANVSLLPNRQVADEELSTYKLEYPPEVAQRSRVKDWLEKHKKLHTALLVMVMIGTCMIIGDGVLTPAISVFSAVSGLELSLSKDQHEYAIIPITCAILVFLFALQHYGTHRVGFLFAPIVLSWLLCMSGIGLYNIIHWNPHVYRALNPSYMITFLKKTRKSGWMSLGGILLCMTGSEAMFADLGHFSYSAIQLAFTSLVYPSLILGYMGQAAYLSKHHNLDASYQIGFYIAVPESVRWPVLVLAILASVVGSQAIISGTFSIINQSQSLSCFPRVKVVHTSDKIHGQIYIPEVNWMLMILCIAVTVGFRNTKHMGNASGLAVITVMLVTTCLMSVVIMLCWHRSPLLALAFFLLFGSVEALYFSASLIKFLEGAWVPILLSLILLAVMFVWHHVTIRKYEYDMHNKVTLEWLLALGDKLGMVRVPGIGLVYTDLTSGVPANFSRFVTNLPAFHRVLVFVCVKSVPVPHVLPAERYLVGRVGPPGHCSYRCIVRYGYRDVHQDVDSFETELVESLATFIKLDALFRCSDAGQGGAGQQLRLRKRARERAHSHREQPAAAPPAAGVRRVPRRRVVGPRDGRGRDRARGGGAGDQEAGEVRGDPLQEPRRGRARAGGAARAVRGAGGRHGVHPGALARADQARVVAAQEAGRRRRVQLPAAELPRPGRGAARAAGVAARGRHGLRAVRNVTAIHPRLRSVRPAFSASLCHCIVLCTSRLADVNCSAMRCHDIFFSNTQESCTSL

SEQ ID NO: 6079 - protein, 780 aa, Hordeum vulgare
MEPGKRETWRTTMLLAYQSLGVVYGDLSISPLYVYKSTFADDITHTDSNDEILGVLSFVFWTLTLVPLIKYVSIVLRAHDNGEGGTFALYSLICRHANVSLLPNRQLADEELSTYSLERPPEEVAHGSRVRRWLEGHRSLKTALLVMVMIGTCMVIGDGVLTPVISVFSAVSGLELSLSKHQHEYAVTPITCAIIVFLFALQHYGTHRVGFLFAPIILAWLICMSALGVYNIIYWNPQVYMALNPMYMLKFLRKTKKSGWMSLGGIVLCMTGSEAMFADLGHFSYSAIQLAFTSLVYPALILGYMGQAAYLTRHHNFDSSYQIGYYISVPEAVRWPVLVLAIMASVVGSQAIISGTFSIINQSQALSCFPRVKVVHTSAKVHGQIYIPEINWMLMVLCIAVTVGFRDTKHMGNASGLAVITVMLVTTCLTSLVMMLCWQRPPALALAFFVFFGSIEALYFSASLTKFLDGAWVPLLLALILVAVMFVWHHTTVKKYEFDLHNKVTMEWLLALCDRLGMVRVPGIGLVYTDLTSGVPANFSRFVTNLPAFHRVLVFVCVKSVPVPRVLPAERYLVGRVGPAGHRSYRCIVRYGYRDVHQDVDSFETELVESLASFIRLDALFRCSDARSDADYERENAFTVIGSNPLRRRISYDDTHDSASSVEIRVDSMTGSGTNTVELAAVPTAARVVKRVRFLVDPGSPEVEDKQMLEELHELCEAREAGTAFIMGHSHVKAKPGSSLLRRLAIGYGYNFLRRNCRGPDVVLRVPPASLLEVGMVYVL

SEQ ID NO: 6080 - protein, 782 aa, Triticum aestivum
MEPGKRETWRTTMLLAYQSLGVVYGDLSISPLYVYKSTFADDITHTDSNDEILGVLSFVFWTLTLIPLLKYVSIVLRADDNGEGGTFALYSLICRHANVSLLPNRQLADEELSTYSLERPPEEVAHGSRVRRWLEAHRSLKTALLVMVMIGTCMVIGDGVLTPVISVFSAVSGLELSLSKHQHEYAVTPITCAIIVFLFALQHYGTHRVGFLFAPIILAWLICMSALGVYNIIYWNPQVYMALNPVYMFKFLKKTKKSGWMSLGGILLCMTGSEAMFADLGHFSYSAIQLAFTSLVYPALILGYMGQAAYLTKHHDFDSSYQIGYYISVPEAVRWPVLVLAIMASVVGSQAIISGTFSIINQSQALSCFPRVKVVHTSAKVHGQIYIPEINWMLMVLCIAVTVGFRDTKHMGNASGLAVITVMLVTTCLTSLVMMLCWHRPPVLALAFFVFFGSIEALYFSASLTKFLDGAWVPLLLALILVAVMFVWHHTTVKKYEFDLHNKVTMEWLLALCDRLGMVRVPGIGLVYTDLTSGVPANFSRFVTNLPAFHRVLVFVCVKSVPVPRVLPAERYLVGRVGPPGHRSYRCIVRYGYRDVHQDVDSFETELVESLASFIRLDALFRCSDARSDADYERENAFTVIGSNPLRRRISYDDTHDSASSVEIRVESPTGSNGTNTMELTAMPAAAPRVVKRVRFLVDPGSPDVEDKQMLEELHELCEAREAGTAFIMGHSHVKAKPGSSLLRRLAIGYGYNFLRRNCRGPDVVLRVPPASLLEVGMVYVL

SEQ ID NO: 6081 - protein, 782 aa, Secale cereale
MEPGKRETWRTTMVLAYQSLGVVYGDLSISPLYVYKSTFADDITHTDSNDEILGVLSFVFWTLTLVPLLKYVSIVLRAHDNGEGGTFALYSLICRHANVSLLPNRQPADQDLSTYSLERPPEEAAHGSRVRRWLEAHRGLKTALLIMVMIGTCMVIGDGVLTPVISVFSAVSGLELSLSKHQHEYAVTPITCAIIVFLFALQHYGTHRVGFLFAPIILAWLICMSTLGVYNIIKWNPQVYMALNPVYMLKFLKKTKKSGWMSLGGILLCMTGSEAMFADLGHFSYSAIQLAFTSLVYPALILGYMGQAAYLTRHHNFDSSYQIGYYISVPEAVRWPVLVLAIMASVVGSQAIISGTFSIINQSQALSCFPRVKVVHTSAKVHGQIYIPEINWMLMVLCIAVTVGFRDTKHMGNASGLAVITVMLVTTCLTSLVMMLCWHRPPALALAFFIFFGSIEALYFSASLTKFLDGAWVPLLLALILVAVMFVWHHTTVKKYEFDLHNKVTMEWLLALCDRLGMVRVPGIGLVYTDLTSGVPANFSRFVTNLPAFHRVLVFVCVKSVPVPRVLPAERYLVGRVGPPGHRSYRCIVRYGYRDVHQDVDSFETELVESLASFIRLDALFRCSDARSDADYERENAFTVIGSNPLRRRISYDDTHDSASSVEIRVESPAGSNGTNTIELTSVPAVAPRVVKRVRFLVDPGSPDVEDKQMVEELHELCEAREAGTAFIMGHSHVKAKPGSSLLRRLAIGYGYNFLRRNCRGPDVVLRVPPASLLEVGMVYVL

SEQ ID NO: 6082 - protein, 467 aa, Saccharum officinarum
MNSQSVLAMEQIATPDKTGHASAPSVLFDAKLDHHSLMDGTLASTSQSSNIKTELIRSSSLSRSLSVNLQKRSPESDPDSPQSHVSHPKFSEPMFSNSSTFCTSLFSSSSTKTEPCRQMCTLPFLPHPPKCEQHVSAGQSSSSSLLLSGDTGNGLDEAEQSDDLKDFLDLSGDASDGSFRENNALAFDEQMEFQFLSEQLGIAITDNEKSPHLDDIYGTPPQLSSLPVSSCPTQSIQNLGSPVKAQLSSSQPSSSSATTNKSRLKWTLELHERFLEAEKKLEGPEKATPKGVLKLMKVEGLTIYHVKSHLQKYRLAKYLPGPKEDKKASSEDKKAQSGKSGSDSSKNKNLQVAEALRMQIEVQKQLHEQLEVQRQLQLRIEEHARYLQKILEEQQKAGNVSLKVPTKPQATVSPESTSDERSESEVGTISPRPSKNKNPFVDTECKSPARIKRTKVQVDLENEAPCS

SEQ ID NO: 6083 - protein, 472 aa, Panicum virgatum
MSSQSVATGEQIIAPDQIVHACTSTQTSVHKLFDAKLDHGFLIDDTLSSTSQSSNIKTELIRTSSLSRSLSVNLHKRSPESDPESPLSHVSHPKFSDPILSNSSTFCTSLFSSSSKNTDPCRQMGTLPFLPHPPKCEQQVSAGQSSSSSLLLSGDTGNALDEAGQSDDLKDFLNLSGDASDGSFHGENNTLSFDEQMEFQFLSEQLGIAITDNEESPHLDDIYGTPPQLSSLPVSSCSNQSKQNLGSPVKVQLSSSRSSSDSATTNKSRLRWTLELHERFVEAVNKLEGPEKATPKAVLKQMKVEGLTIYHVKSHLQKYRLAKYLPEPKEDKKASSEDKKAQLGSSSSDSSKTKNLQVAEALRMQMEVQKQLHEQLEVQRQLQLRIEEHARYLQKILEEQQKAGNLSMKAPTKAQAGSPETTSKERSESEGGTTSPRPSKNRNPDVDAECKSPGGSKRTKVQVDPERVAPCS

SEQ ID NO: 6084 - protein, 472 aa, Panicum virgatum
MSSQSVATGEQIIAPNQIVHACTSTQTSVHKLFDAKLDHGFLIDDTLSSTSQSSNIKTELIRTSSLSRSLSVNLQKRSPESDPESPLSHVSHPKFSDPILSNSSTFCTSLFSSSSKNTDPCRQMGTLPFLPHPPKCEQQVSAGQSSSSSLLLSGDTGNALDEAGQSDDLKDFLNLSGDASDGSFHGENNILAFDEQMEFQFLSEQLGIAITDNEESPHLDDIYGTPPQLSSLPVSSCSNQSKQNLGSPVKVQLSSSRSSSDSATTNKSRLRWTLELHERFVEAVNKLEGPEKATPKAVLKQMKVEGLTIYHVKSHLQKYRLAKYLPEPKEDKKASSEDKKAQLGSSSSDSSKTKNLQVAEALRMQMEVQKQLHEQLEVQRQLQLRIEEHARYLQKILEEQQKAGNLSMKAPTEAQAGSPETTSKERSESEGGTTSPRPSKNRNPDVDAECKSPGGSKRTKVQVDPERVAPCS

SEQ ID NO: 6085 - protein, 164 aa, Zea mays
MAAVSSTATASSQPELPTSTAHPTANAAAISRLARRPRRNNSFVMVEEASYASGGGDGGVARTKSLTEDDLEELKGCVDLGFGFAYSEIPELCGTLPALELCYSMTRRFLDEQRAPGQDEEEEEPASPPLPNWRIFAPGDDPEEVKARLKYWAQAVACTVKLCS

SEQ ID NO: 6086 - protein, 278 aa, Setaria italica
MAEQPHAEGGASPKHETLMEKLADKLHAGGGKGDSSSSDSDNDERPRPSAPAAEVKPSFSVSAAAAAAEARAKVFRLFGREQPIHKALGGGKPADVFLWRNRNISAGVLGGVTAIWILFECLGYHLLTFVCHGLIFSLGVLFLWSNASSFINKSPPRIPEVIIPEDLVVNIALSTRYEINRAFVNLRQIALGRDIKKFLMVIAGLWLLSVLGSCCNFLTLVYIVFVVLHTVPVLYEKYEDQIDSYGEKGWVEIKKQYAVFDEKVLSKVPRGPAKDKKH

SEQ ID NO: 6087 - protein, 280 aa, Leymus cinereus x Leymus triticoides
MAEQPHAEDAGHKPETLMEKIADKLHVGGGDHSSSDSDNDERPRPSAPPAPAASEVTTASFADSASAAAADAKNKMFRLFGREQPIHKVLGGGKPADVFMWRNKNISAGVLGGATAIWILFELLGYHLLAFLGHALIFSLGVLFLWSNASSFINKSPPRIPEVIIPEDLVVNIALSTRHEINRAFANLRQIALGRDIKKFLIVIAGLWLLSILGSCCNFLTLFYVVFVVLHSVPVIYEKYEDQIDTYGEKGWIEVKKQYAVFDAKVLSKVLRGPLKDKKN

SEQ ID NO: 6088 - protein, 279 aa, Zea mays
MAEQPQEGGASPKHESLMEKLADKLHVGGGKGDSSSSDSDRDEPPHPSAPPTDEVKQPSFSDSTATAAAEAKAKVFRLFGREQPIHKALGGGKPADVFLWRNRNISAGVLGGATAIWILFELLGYHLLTFVCHGLIFSLGVLFLWSNASSFIHKSPPKIPEVVIPEDLVVNIAVSTRYEINRAFANLRRIALGRDIKKFLMVIAGLWLLSVLGSCCNLLTLVYIVFVVLHTVPVLYEKYEDQIDTYGEKGWVEIKKQYAVFDEKVLSKVPRGPAKDKKH

SEQ ID NO: 6089 - protein, 286 aa, Brachypodium distachyon
MAEQAHAEEASHKSETLMEKIADKLHVGGGDGSSSSSDSEADERPRPSAPPAPAPTPAVSEVTTASFADSASAAAADAKAKMFRLFGREQPIHKVLGGGKPADVFMWRNKNISAGVLGGATAIWILFELLGYHLLAFLCHGLIFSLGVLFLWSNASSFINKSPPRIPEVIIPEDLVVNVALSTRHEINRAFANLREIALGRDIKKFLIVIAGLWLLSILGSCCNFLTLVYIVFVVLHTVPVLYEKYEDQIDSYGEKGWVEVKKQYSVFDAKVLSKVPRGPLKDKKN

SEQ ID NO: 6090 - protein, 284 aa, Sorghum bicolor
MAEQSQPHEEGGASPKHESLMEKLADKLHVGGGGKGDSSSSSDSDNDERPRPSAPPADEVKQTSFSDSAATAAAEAKAKVFRLFGREQPIHKALGGGKPADVFLWRNRNISAGVLGGATAIWILFELLGYHLLTFVCHGLIFSLGVLFLWSNASSFIHKAPPKIPEVIIPEDLVVNIALSTRYEINRAFANLRQIALGRDIKKFLMVIAGFWFLSVLGSCCNFLTLVYIVFVVLHTVPVLYEKYEDHIDSYGEKGWIEIKKQYAVFDEKVLSKVPRGPAKDKKH

SEQ ID NO: 6091 - protein, 283 aa, Zea mays
MAEQTQPQGEGGASPKHESLMEKLADKLHVGGGKADSSSSSDSDSDERPRPSAPPADELKQPSFSDAAATAAAEAKAKVFRLFGREQPIHKALGGGKPADVFLWRNKNISAGILGGATAIWILFELLGYHLLTFVCHGLIFALGVLFLWSNASSFIHKAPPKIPEVIIPEDLVVNIALSTRYEINRAFANLRQIALGRDLKKFLMVIAGFWLLSVLGSCCNFLTLVYIVFVVLHTVPVLYEKYEDQIDSYGEKGWVEIKKQYAVFDEKVLSKVPRGPAKDKKH

SEQ ID NO: 6092 - protein, 283 aa, Saccharum officinarum
QPQPHEEGGASPKHESLMEKLADKLHVGGGKGDSSSSSDSDNDERPRPSAPPAPPADEVKQPSFSDSAATAAAEAKAKVFRLFGREQPIHKALGGGKPADVFLWRNRNISAGVLGGATAIWILFELLGYHLLTFVCHGLIFSLGVLFLWSNASSFIHKAPPKIPEVVIPEDLVVNIALSTRYEINRAFANLRQIALGRDIKKFLMVIAGFWLLSVLGSCCNFLSLVYIVFVVLHTVPVLYEKYEDQIDSYGEKGWIEIKKQYAVFDEKVLSKVPRGPAKDKKH

SEQ ID NO: 6093 - protein, 286 aa, Triticum aestivum
MAEQPHAEDAGHKPETLMEKIADKLHVGGGDHSSSSSDSDKEEHPRPSAPPAPAPAPAASEVTTASFAASASAAAADAKNKMFRLFGREQPIHKVLGGGKPADVFMWRNKHISAGVLGGATAIWILFELLGYHLLAFLGHALIFSLGVLFLWSNASSFINKSPPRIPEVIIPEDLVVNIALSTRHEINRAFANLRQIALGRDIKKFLIVIAGLWLLSILGSCCNFLTLFYIVFVVLHTVPVIYEKYEDQIDTYGEKGWIEVKKQYAVFDAKVLSKVPRGPLKDKKN

SEQ ID NO: 6094 - protein, 286 aa, Pseudoroegneria spicata
  misc_feature (275)..(275): Xaa can be any naturally occurring amino acid
MAEQPHAEDAGHKPETLMEKIADKLHVGGGDHSSSSSDSDHDERPRPSAPPAPAPAPAASEVTTPSFAASASSAAADAKNKMFRLFGREQPIHKVLGGGKPADVFMWRNKHISAGVLGGATAIWILFELLGYHLLAFLGHALIFSLGVLFLWSNASSFINKSPPRIPEVIIPEDLVVNIALSTRHEINRAFANLRQIALGRDIKKFLIVIAGLWLLSILGSCCNFLTLFYIVFVVLHTVPVIYEKYEDQIDTYGEKGWIEVKKQYAVFDAKVLSXVPRGPLKDKKN

SEQ ID NO: 6095 - protein, 368 aa, Saccharum officinarum
MSATGESGGDPAAARRRWDLTNKGPESTTMLKEAVEMSTDEESDGVVICHPNGNTDGCDEAISGSRDDDSPEGQETSSIKDPDVEGDTQEDKCVNQDSLKLIDQEKSAPPKSPAKSATASSGSERPKRVIPQPFSLSTQRRSSGVNGGVTNPLANKDKSGDKSSISPASMTKKSTTMAPRKTLQPEQAFHPLDEDSCSVTSSTTTSTRAGRTKTTVPVAPSFVCANRADKRKEFYTKLEEKHKALEAEKDEAEARKKEEQDVALKQLRKSLVIKAKPMPSFYQEGPPPKAELKKVPPTRAKSPKFTSSRRKSCSDTPQTPEGKTTNATSTRSHRHSIGSSKDANRVQCSPKSGVATKTRSVKPELKAL

SEQ ID NO: 6096 - protein, 369 aa, Zea mays
MSVAGESGGDPAAARRRWDLSNKGPDSTPMLKEAVEMSTDEESDGVVICHPNGNTDGCDEAISGSHDDDSPEGQETSSIKDPDVEGDTQEDKCVNQDSLKLIDQETSAPPKSPAKSATASSGPEKPKRVVTQPLSLSTQRRSSGVNGGVTNPSPNKDKSGDKSSISPASMTKKCTPLAPRKTLQPEQAFHPLEEDSCSVTSSTTTSSRAGRTKTTVPVAPSFVCANRADKRKEFYTKLEEKHKALEAEKDEAEARKKEEQDVAIKQLRKSLVIRAKPMPSFYQEGPPPKAELKKVPPTRAKSPKFTSSRRKSCNDTPQTPEGKNTNATSTTRPHRHSIGASKDASRVQCSPKSGVATKTRSVKPELKAL

SEQ ID NO: 6097 - protein, 368 aa, Cenchrus ciliaris
MAASGDGGGDPAAARRRWDLTNKGPESAPIVKEAVEISTDEESDGVVICHPNGDSNTDGCDEATSDNHDDDSPEDQVTSSVKKSDVEGDTQEDKCVNQESLKLIDQEQSAPPKSPAKSASSGSERPKRVVPQPFSLSTQRRSSGGNGGVTSPSINKEKSGDKSSISPASMTKKSTPAAPRKTLQPEQAFHPQEEDSCSVTSSTTTSTRAGRTKTTVPVPPSFVCANRADKRREFYTKLEEKHKALEAEKDEAEARKKEEQEAALKQLRKSLVIRAKPMPSFYQEGPPPKVELKKVPPTRAKSPKFTSSRRKSCSDTTQTPEGKNTSASSARSHRHSIGSSKDANRVQCSPKNGVATKTRAVKPELKAL

SEQ ID NO: 6098 - protein, 367 aa, Setaria italica
MAASGEGGGDPAAARRRWDLTNKGPESAPIVKEAVEISTDEESDVVICHPNGDSNTDGCDEATSGNHDDDSPEDQVTSSVKDPNVEGDTQEDKCVNQESLKLIDQEQSAPPKSPAKSASSGSERPKRVVPQPFSLSTQRRSSGGNGGVSSPSINKEKSGDKSSISPASMTKKSTPVAPRKTLQPEQTFHPQEEDSCSVTSSTTTSTRAGRTKTTVPVPPSFVCANRADKRREFYTKLEEKHKALEAEKDEAEARKKEEQEAALKQLRKSLVIRAKPMPSFYQEGPPPKVELKKVPPTRAKSPKFTSSRRKSCSDTAQTPEGKNTSASSARTHRHSIGSSKDANRVQCSLKNGVATKTRAVKPELKAL

SEQ ID NO: 6099 - protein, 368 aa, Pennisetum glaucum
MAASGEGGGDPAAARRRWDLTNKGPESAPIVKEAVEISTDEESDGVVICHPNGDSNTDGCDEATSGNHDDDSPEDQVTSSVKKPDAEGDTQEDKCVNQESLRLIDQEQPAPPKSPAKSASSGSERPKRVVPQPFSLSTQRRSSGGNGGVTSPSINKEKSGDKSSISVASMTKKSTPVAPRKTLQPEQTVHPQEEDSCSVTSSTTTSTRAGRTKTTVPVPPSFVCANRADKRREFYTKLEEKHKALEAEKDEAEARKKEEQESALKQLRKSLVIRAKPMPSFYQEGPPPKAELKKVPPTRAKSPKFTSSRRKSCSDTAQTPEGKNTSASSVRSHRHSIGSSKDANRVQCSPKNGVATKTRAVKPELKAL

SEQ ID NO: 6100 - protein, 368 aa, Panicum virgatum
MAASGESGGDPAAARRRWDLTNKGPDSTPIVKETVEISTDEESDGAVICHPNGNSNTDGCDEATSGNLDDDSPEGQVTSSVKDPDMEGDTQEDKCVNQDSLKLIDQEKSAPPKSPAKSASSGSERPKRVVPQPFSLSSQRRSSGGNGGVTSPPINKGKSSDKNSISPASMTKKSTPMAPRKILQPEQTFHPQEEDSCSVTSSTTTSTRAGRTKTTVPVAPSFVCANRADKRREFYTKLEEKHKALEAEKDEAEARKKEEQEAALKQLRKSLVIRAKPMPSFYQEGPPPKAELKKVPPTRAKSPKFTSSRRKSCSDTAQSPEGKNTSASSARSHRHSIESSKDANRVQCSPKNGVATKTRAVKPELKAL

SEQ ID NO: 6101 - protein, 368 aa, Panicum virgatum
MAASGESGGDPAAARRRWDLTNKGPDSTPIVKETLEISTDEESDGVVLCHPNGKSNTDGCDEATSGNHDDDIPEDQVTSSVKDSDVEGDTQEDKCVNQDSLKLIDQEKSAPPKSPVKSASSGSERPKRVVPQPFSLSSQRRSSGGNGVVTSPPINKEKSGDKNSISPASMTKKSTPMAPRKTLQPEQAFHPQEEDSCSVTSSTTTSTRAGRTKTTVPVPPSFVCANRADKRREFYTKLEEKHKALEAEKDEAEARKKEEQEAALKQLRKSLVIRAKPMPSFYQEGPPPKAELKKVPPTRAKSPKFTSSRRKSCSDTAQTPEGKNTIASSARSHRHSIGSSKDANRVQCSPKNGVATKTRAVKPELKAL

SEQ ID NO: 6102 - protein, 373 aa, Zea mays
MSATAESGGDLSAARRRWDLTNKGAESTPILKDAVEISTDEESDGVVTCHPNGNTDGCEETISGSHDDDSPEGQETSSIKEPDVEGDTQEDKRVNQDSLKLIDEESAPPKSPAKSATASSRSERPKRVVPRPFSLSNQRSLFGVNGGVANPLANKDKSGDKSSISPASMTKKSTQMALRKTLQPEKVFHPLEEDSCSVTSSYPFSVTTTSTRAGRTKMTVPVAPSFVCANRADKRKEFYTKLEEKHKALEAEKDEAEARKKDEQDVALKQLRKSLVIRAKPMPSFYQEGPPPKAELKKVPPTRAKSPKFTSSRRRSCSDTPLTPGGENTNATSTRPHRHSIGSPRDANRVQQCSPKSGVATKTRSVKAELKAL

SEQ ID NO: 6103 - protein, 368 aa, Panicum virgatum
MAASGESGGDPAAARRRWDLTNKGPDSTPIVKGTLEISTDEESDGVVLCHPNGKSNTDGCDEATSGNHDDDIPEDQVTSSVKDSDVEGDTQEDKCVNQDSLKLIDQEKSAPPKSPVKSASSGSERPKRVVPQPFSLSSQRRSSGGNGVVISPPINKEKSGDKNSISPASMTKKSTPMAPRKTLQPEQAFHPQEEDACSVTSSTTTSTRAGRTKTTVPVPPSFVCANRADKRREFYTKLEEKHKALEAEKDEAEARKKEEQEAALKQLRKSLVIRAKPMPSFYQEGPPPKAELKKVPPTRAKSPKFTSSRRKSCSDTAQTPEGKNTIASSARSHRHSIGSSKDANRVQCSPKNGVATKTRAVKPELKAL

SEQ ID NO: 6104 - protein, 308 aa, Saccharum officinarum
MDPPRAVAVLLLILLPVLAPVASGVPFVVLHGIGDECGNDGLASFTEMLGEWSGSKGYCIEIGRGAWDSWLMPLQEQANTVCKKVKKMKELSEGYNIVGLSQGNLIGRAVIEYCDGGPPVKNFISIGGPHAGTASVPLCGSGFLCILIDDLIKSEIYSDYVQAHLAPSGYLKIPTDMEDYLKGCRFLPKLNNEIPSARNTTYKERFSSLENLVLIMFEDDAVLIPRETAWFGYYPDGAFSPVLPPQETKLYTEDWIGLRTLDEAGRVKFVSVPGGHLRISRSDMKKYIVPYLTPEASSKQSIHRMLSL

SEQ ID NO: 6105 - protein, 309 aa, Zea mays
MDPPRAVAFLLILLPVLAPVASGVPFVVLHGIGDECGNDGLSSFTKMLGEWSGSKGYCIEIGRGAWDSWLMPLQEQANTVCKKVKKMKELSEGYNIVGLSQGNLIGRAVIEYCDCGPPVKNFISIGGPHAGTASVPLCGSGFLCILIDDLIKSEIYSDYVQAHLAPSGYLKIPTDMEDYLKGCKFLPKLNNEIPSARNTTYKERFSSLENLVLIMFEDDAVLIPRETAWFGYYPDGAFSPVLPPQETKLYTEDWIGLKTLDEAGRVKFVSVPGGHLRITRSDMKKYIVPYLTPEASSKKNIHIHRMLSL

SEQ ID NO: 6106 - protein, 310 aa, Setaria italica
MAALAPRDVAVLLLLLFPVLAPVASAVPFIVLHGIGDECGNDGLASFTEMLGEWSGSKGYCIEIGRGAWDSWLMPLQEQANTVCKKVKKMKELSEGYNIVGLSQGNLIGRAVIEYCDCGPPVKNFISIGGPHAGTASVPLCGSGFLCILIDNLIKLEIYSDYVQAHLAPSGYLKIPTDMEDYLKGCRFLPKLNNEIRSERNATYKERFSSLENLVLIMFEDDAVLIPRETAWFGYYPDGAFNPVLPPQETKLYTEDWIGLKTLDEAGRVKFVSVPGGHLRISRSDMKKYIVPYLKPDASPKQSIRRILSV

SEQ ID NO: 6107 - protein, 310 aa, Panicum virgatum
MAAPAPRDVAVLLLLLFPVLAPVASAVPFVVLHGIGDECGNDGLASFTKMLGEWSGSKGYCIEIGKGAWDSWLMPLQEQANTVCKKVKKMKELSEGYNIVGLSQGNLIGRAVVEYCDCGPPVKNFISIGGPHAGTASVPLCGSGLLCILIDNLIKLEIYSDYVQAHLAPSGYLKIPTDMEDYLKGCRFLPKLNNEIPSERNSTYKERFSSLENLVLIMFEDDAVLIPRETAWFGYYPDGAFNPVLPPQETKLYTEDWIGLKTLDEAGRVKFVSVPGGHLRISRSDMKKYIVPYLKPDASSKYSIRRILSV

SEQ ID NO: 6108 - protein, 310 aa, Panicum virgatum
MAAPAPRDVAVLLLLLFPVLAPVASAVPFVVLHGIGDECGNDGLASFTKMLGEWSGSKGYCIEIGKGAWDSWLMPLQEQANTVCKKVKKMKELSEGYNIVGLSQGNLIGRAVVEYCDCGPPVKNFISIGGPHAGTASVPLCGSGLLCILIDNLIKLEIYSDYVQAHLAPSGYLKIPTDMEDYLKGCRFLPKLNNEIPSERNSTYKERFSSLENLVLIMFEDDAVLIPRETAWFGYYPDGAFNPVLPPQETKLYTEDWIGLKTLDEAGRVKFVSVPGGHLRISRSDMKKYIVPYLKPDASSKHSIRRILSV

SEQ ID NO: 6109 - protein, 303 aa, Pennisetum glaucum
DVAVLLLLLFPMLLPVASAVPFIVLHGIGDECGNDGLASFTELLEEWSGSKGYCIEIGRGAWDSWLMPLQEQANTVCKKVKTMKELSEGYNIVGLSQGNLIGRAVIEYCDCGPPVKNFISIGGPHAGTASVPLCGSGFLCVLIDNLIKLEIYSDYVQAHLAPSGYLKIPTDMEDYLKGCRFLPKLNNEIPSERNATYKERFSSLENLVLIMFEDDAVLIPRETAWFGYYPDGAFSPVLPPQKTKLYTEDWIGLKTLDEAGRVKFVSVPGGHLRISRSNMKKYIVPYLKLDASPKQGIRRILSV

SEQ ID NO: 6110 - protein, 313 aa, Oryza sativa
MAYALRGAALVGVLLLVVASPALVPVASAVPFIVLHGIGDQCENGGMASFTEMLGEWSGSKGYCIEIGRGAWDSWLMPLQEQADTVCKKVKKMKELRKGYSIVGLSQGNLIGRAVIEYCDGGPPVKNFISIGGPHAGTASVPLCGSGIVCVLIDALIKLEIYSNYVQAHLAPSGYLKIPTDMTDYLKGCKFLPKLNNEIPSERNATYKQRFSSLENLVLIMFEDDAVLIPRETAWFGYYPDGAFSPVQPPQKTKLYTEDWIGLKALEEAGRVKFVSVPGGHLSISRSDTKKYIVPYLKPDGSSRFGIRRILSD

SEQ ID NO: 6111 - protein, 313 aa, Triticum aestivum
MAALSPAVSLLLVLVVAASAALAPVASAVPFIVLHGIGDQCGNDGIASFTDELAEWSGSKGYCMEIGRGSWDSWLMPLQDQANVVCKKVKEMEELREGYSIIGLSQGNLIGRAVIEYCDGGPPVKNFISIGGPHAGTASVPLCGSGFLCVLVDALIQLEIYSNYVQAHLAPSGYLKIPTDMTAYLQGCKFLPKLNNEIPSERNITYKERFSSLENLVLIMFEDDAVLIPRETAWFGYYPDGAFNPVLPPQETKLYTEDWIGLRTLDEAGRVKFVSVPGGHLRISRSDMKKYIVPYLTPSCGSSKQSIRRILSY

SEQ ID NO: 6112 - protein, 313 aa, Pseudoroegneria spicata
MAALSPVVSLLLVLVIAASAALAPVASAVPFIVLHGIGDQCGNDGIASFTDELAEWSGSKGYCMEIGRGSWDSWLMPLQDQANVVCKKVKEMEELREGYSIIGLSQGNLIGRAVIEYCDGGPPVKNFISIGGPHAGTASVPLCGSGVLCVLVDVLIQLEIYSNYVQAHLAPSGYLKIPTDMTDYLKGCKFLPKLNNEIPSERNITYKERFSSLENLVLIMFEDDAVLIPRETAWFGYYPDGAFNPVLPPQETRLYTEDWIGLRTLDEAGRVKFVSVPGGHLRISRSDMKKYIVPYLTPSCGSSKQSIRRILSY

SEQ ID NO: 6113 - protein, 366 aa, Brachypodium distachyon
MAVLVLVLVLAACAALAPVASAVPFIVLHGIGDQCGNDGIASFTDELGKWSGSKGYCMEIGRGSWDSWIMPLQEQANAVCNKVKEMKDLHEGYNIIGLSQGNLIGRAVIEYCDDGPPVKNFISIGGPHAGTASVPLCGSGILCILVDALIQLEIYSNYVQAHLAPSGYLKIPTDMAEYLKGCKFLPKLNNEIPSERNATYKERFSSLENLVLIMFQDDAVLIPRETAWFGYYPDGSFNPVLPPQKTKLYTEDWIGLRTLDETGRVKFVSVPGGHLRISRSDMKKYIVPYLKPWYQRRVLVGSCWIEDRTTRVSVFVSPAASIAVKNTLVKRRENEGKKSRKEYRKSWDCKCLPALGKMGEIIQVKV

SEQ ID NO: 6114 - protein, 315 aa, Secale cereale
MAVLSPAVSLLLVLVVAASAALAPVASAVPFIVLHGIGDQCGNDGIASFTDELAEWSGSKGYCMEIGRGSWDSWLMPLQDQANVVCKKVKEMEELREGYSIIGLSQGNLIGRAVIEYCDGGPPVKNFISIGGPHAGTASVPLCGSGILCVLVDVLIQLEIYSNYVQAHLAPSGYLKIPTDMTDYLKGCKFLPKLNNEIPSERNITYKERFSSLDNLVLIMFEDDAVLIPRETAWFGYYPDGAFNPVLPPQETKLYTEDWIGLRTLDEAGRVKFVSVPGGHLRISRSDMKKYIVPYLTPSCGSSKQSIRRILSYRG

SEQ ID NO: 6115 - protein, 609 aa, Sorghum bicolor
MSNLFAVALVLSSLYYGITMATASSDESFFQKCLASSCSEGGPEIRFPFRLVTSPLSCGAPGMELVCSKADTILVHPNLGLCKVIAIEYSVGTIIIVPLAESKCPFQKIISTNLSTDVYRPYGERATLVSCSAEFIPSDKANIAGPIFCLNNTSQFTYLVSSFQSMDFLPLDCMVLSNSISVPYRSINMDFNETVKRTIAFGETMLRWSVPNITNVCQNCEDEGRLCGFKSETRQAFCKSKKQSSHLKVIAVTTPVATLLVISAMAAAALYLALKSKYDEEIHMKVEMFLKTYSTSKPTRYTFSEVKKITRRFNNILGQGGFGSVYKGELSNGVPVAVKMLENSTGEGEEFINEVATIGTIHHDNVVRLLGFCSERSRRALIYEFMPNASLEKYIFSQESDSSGQEHLTPNKMLEIATGIARGIEYLHQGCNQRILHFDIKPSNILLDYNFKPKISDFGLAKLCARDQSIVTLTAARGTMGYIAPELYSRNFGTVSYKSDVYSFGMVVLEMMSGKRRSIYPETENQNDIYIPEWIYEKIVTGQELELVREMTQGEKDIMRKLAIVALWCIQWNPANRPSMTKVVNMLTDSLQSLKMPPKPFVSSFGQQA

SEQ ID NO: 6116 - protein, 668 aa, Zea mays
MVSSHGFLLSLQALTMVSTIMTNTGVIATQGQAFCPSSSCGHLQDIRSPFRMQGDPQGCGFPEYELVCIDSKAIIHINNGRYFVTSISYSNSTFWVVDANLDNSSCPIPASNQRPYVNGLPSEGRTLLDPDTVTWAAFVSCSEMLSDVSSPFLSCCSGIYQPVNCRSTKNSFAYVFTTTFFPMVGDIKPSCRYLSMIPFGSRHVKRPDNASYDDIVKFMKNGFAVNFPYRNGRSYHLVINTCLKDANGYFNDKISNSSIVDQTLAAVFGIDLRFLRCVNDYSYRSKLFWAMVAMISTVVIVKFVIVFGILSRFVFAPLTVLTFLAYKYWKTRISIDAVEKFLQMQQALSPARYAYTDITAITGHFREKLGQGGYGSVYRGVLPGDVSVAVKMLSNSLCNGDEFISEVSTIGSIHHVNVVRLVGFCSEETKRALIYEYMPRGSLDKHIFSSEQSFSWDKLNGIALGIARGINYLHQGCEMQILHFDIKPHNILLDNSFTPKVADFGLAKLYPRDNSFVPVSAARGTVGYIAPEMISRNFGAVSCKSDVYSFGMLLLEMAGGRRNLDQHAERRSQTYYPAWVYSHLTRQEVGEICEAFDVHEVERKLCVVGLWCIQMKPHDRPTMAEVVGMLEAGADGLQIPPQPFFCGGELTGSTSYFSSELSAISENG

SEQ ID NO: 6117 - protein, 763 aa, Zea mays
MAAMVGARRALLAARFSPRGTIAASAAPAPLYRPMDSPLRLPAERVCLQSWVPHRGAGTFASERTDEDYQREWGQNKAGSYTDSRWNGSNLQLQRDVTSAGSTTGTHKNKGVDGVGGSSEQHYRSGGSYGFQNNHQPYTGTRANNERYNASQPYRGSGPYSQQGLDGHFSNDRQQYNGTEANSTYSSGYYTQSKQKIYEGEGANNGQYGYGPSGQPCPNPVGNSQRVQKQQYVDHRSGGSYPDRSGHHPSQYVNPTHSRKEHVAGFQQGNNSNFGYNASQAYQSPYFTRQADTHSTSQGYSMYLNTDVQRLSHGVHQEKHSHAQSAGSFGNHVNSAPHEYGKYHQSLQGNPSNVGSPYEVPSEAGSKHKCTVEELEKFCDDGNVKEALEVLAMLKENRIVLHAPQYFRLMQACGDATALSEARLIHSQISESSLTVDTDFQNKIMEMYARCGSMEDAKKIFSSMDHHNLTSWNTMISGFVHNVLGEEAIDFFERFKQTGDKPDHGMFRHVFLACGILGSVNEGMLHFESMQKDFGIHPTTEHYASIVTMLGQSGYIVEAYEFVERMPVEPSIEVWENLMNMCRLNGFLELGDRCAQIIECLDSSRLNEQSKMGLFPVDVSDLAKEKERKKASVAEARSKVHEYRAGDRSHPDTPKIYEELRYLLAHMKEAGYIADTRFVLHDVDQETKEDALLAHSERLAISYGLITSAPRSPIRVIKNLRSCGDCHTAFKIISKLVGRQIIARDAKRFHHFENGVCSCKDYW

SEQ ID NO: 6118 - protein, 146 aa, Saccharum officinarum
MTTSLKKNRKKRGHVSAGHGRIGKHRKHPGGRGNAGGMHHHRILFDKYHPGYFGKVGMRYFHKLRNKFYCPSVNVERLWSMVPADKAAEAAGGDKAPLLDVTQFGYFKVLGKGMLPPKPIVVKAKLISKVAEKKIKAAGGAVLLTA

SEQ ID NO: 6119 - protein, 147 aa, Panicum virgatum
MTTSLKKNRKKRGHVSAGHGRIGKHRKHPGGRGNAGGMHHHRILFDKYHPGYFGKVGMRYFHKLRNKFYCPSVNVERLWSMVPADKAAEAAGGADKAPLVDVTQFGYFKVLGKGMLPPKPIVVKAKLISKVAEKKIKAAGGAVVLTA

SEQ ID NO: 6120 - protein, 145 aa, Setaria italica
MTTSLKKNRKKRGHVSAGHGRIGKHRKHPGGRGNAGGMHHHRILFDKYHPGYFGKVGMRYFHKLRNKFYCPSVNVERLWSMVPADKAAEAGGDKAPLVDVTQFGYFKVLGKGMLPPKPIVVKAKLISKVAEKKIKAAGGAVVLTA

SEQ ID NO: 6121 - protein, 145 aa, Pennisetum glaucum
MTTSLKKNRKKRGHVSAGHGRIGKHRKHPGGRGNAGGMHHHRILFDKYHPGYFGKVGMRYFHKLRNRFYCPSVNVERLWSMVPADKAAEAGGDKAPLVDVTQFGYFKVLGKGMLPPKPIVVKAKLISKVAEKKIKAAGGAVVLTA

SEQ ID NO: 6122 - protein, 147 aa, Panicum virgatum
MTTSLKKNRKKRGHVSAGHGRIGKHRKHPGGRGNAGGMHHHRILFDKYHPGYFGKVGMRYFHKLRNRFSCPSVNVERLWSMVPADKAAEAAAGADKAPLVDVTQFGYFKVLGKGMLPPKPIVVKAKLISKVAEKKIKAAGGAVVLTA

SEQ ID NO: 6123 - protein, 147 aa, Panicum virgatum
MTTSLKKNRKKRGHVSAGHGRIGKHRKHPGGRGNAGGMHHHRILFDKYHPGYFGKVGMRYFHKLRNRFSCPSVNVERLWSMVPADKAVEAAAGADKAPLVDVTQFGYFKVLGKGMLPPKPIVVKAKLISKVAEKKIKAAGGAVVLTA

SEQ ID NO: 6124 - protein, 146 aa, Zea mays
MTTSLKKNRKKRGHVSAGHGRIGKHRKHPGGRGNAGGMHHHRILFDKYHPGYFGKVGMRYFHRLRNKFHCPSVNVERLWSMVPAGKAAEAAGADQAPLVDVTQFGYFKVLGKGMLPSRPIVVKAKLISKVAEKKIKAAGGAVLLTA

SEQ ID NO: 6125 - protein, 145 aa, Unknown
  Sequence found in Organisms: Sorghum bicolor, Saccharum officinarum
MTTRFKKNRKKRGHVSAGHGRIGKHRKHPGGRGNAGGMHHHRILFDKYHPGYFGKVGMRYFHKLRNKFYCPAVNIERLWSMVPADKAAEAGGDKAPQIDVTQFGYFKVLGKGVLPPKPIVVKAKLISKVAEKKIKAAGGAVVLTA

SEQ ID NO: 6126 - protein, 145 aa, Setaria italica
MTTRFKKNRKKRGHVSAGHGRIGKHRKHPGGRGNAGGMHHHRILFDKYHPGYFGKVGMRYFHKLRNKFYCPAVNVERLWSMVPAEKAAEAGGDKAPQIDVTQFGYFKVLGKGKLPSKPIVVKAKLISKVAEKKIKAAGGAVVLTA

SEQ ID NO: 6127 - protein, 145 aa, Zea mays
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDKAPQIDVTQFGYFKVLGKGVLPPKPIVVKAKLISKVAEKKIKAAGGAVVLTA

SEQ ID NO: 6128 - protein, 145 aa, Zea mays
MTTRFKKNRKKRGHVSAGHGRIGKHRKHPGGRGNAGGMHHHRILFDKYHPGYFGKVGMRYFHKLRNKFYCPAVNIERLWSMVPTDKAAEAGGDKAPQIDVTQFGYFKVLGKGVLPPKPIVVKAKLISKVAEKKIKAAGGAVVLTA

SEQ ID NO: 6129 - protein, 145 aa, Panicum virgatum
MTTRFKKNRKKRGHVSAGHGRIGKHRKHPGGRGNAGGMHHHRILFDKYHPGYFGKVGMRYFHKLRNKFYCPAVNVERLWSMVPAEKEAEAGADKAPQIDVTQFGYFKVLGKGKLPSKPIVVKAKLISKVAEKKIKAAGGAVVLTA

SEQ ID NO: 6130 - protein, 146 aa, Oryza sativa
MTTSLRKNRKKRGHVSAGHGRIGKHRKHPGGRGNAGGMHHHRILFDKYHPGYFGKVGMRYFHRLRNKFYSPAVNVERLWSMVPAEQAAEAAGAGKAPLLDVTQFGYFKVLGKGLLPEKPIVVKAKLISKVAEKKIKAAGGAVVLTA

SEQ ID NO: 6131 - protein, 145 aa, Brachypodium distachyon
MTTRFKKNRKKRGHVSAGHGRIGKHRKHPGGRGNAGGMHHHRILFDKYHPGYFGKVGMRYFHKLRNRFYCPSVNVERLWSMVPAEKAAEAGGDKAPVVDVSQFGYFKVLGKGLLPEKPIVVKAKLISKVAEKKIKAAGGAVVLVA

SEQ ID NO: 6132 - protein, 145 aa, Pennisetum glaucum
MTTRFKKNRKKRGHVSAGHGRIGKHRKHPGGRGNAGGMHHHRILFDKYHPGYFGKVGMRYFHKLRNRFHCPAVNVERLWSMVPAEKAAEAGGDKAPLIDVSQFGYFKVLGKGKLPEKPIVVKAKLISKVAEKKIKAAGGAVVLTA

SEQ ID NO: 6133 - protein, 145 aa, Panicum virgatum
MTTRFKKNRKKRGHVSAGHGRIGKHRKHPGGRGNAGGMHHHRILFDKYHPGYFGKVGMRYFHKLRNRFTCPAVNVERLWSMVPAEKAAEAGADKAPQIDVTQFGYFKVLGKGKLPSKPIVVKAKLISKVAEKKIKAAGGAVVLTA

SEQ ID NO: 6134 - protein, 148 aa, Brachypodium distachyon
MTTRFKKNRKKRGHVSAGHGRIGKHRKHPGGRGNAGGMHHHRILFDKYHPGYFGKVGMRYFHKLRNRFHCPTVNVERLWSMVPADKAAEAAGAPNKAPVVDVSQFGYFKILGKGMLPPNTPIVVKAKLISKVAEKKIKAAGGAVLLTA

SEQ ID NO: 6135 - protein, 145 aa, Unknown
  Sequence found in Organisms: Festuca arundinacea, Avena sativa
MTTRFKKNRKKRGHVSAGHGRVGKHRKHPGGRGNAGGMHHHRILFDKYHPGYFGKVGMRYFHKLSNRFYCPSVNVERLWSMVPAEKVAEAGADKAPVLDVSQFGYFKVLGKGLLPDKPIVVKAKLISKIAEKKIKAAGGAVVLVA

SEQ ID NO: 6136 - protein, 146 aa, Oryza sativa
MTTRFKKNRKKRGHVSAGHGRIGKHRKHPGGRGNAGGMHHHRILFDKYHPGYFGKVGMRYFHKLSNRFHCPAVNVERLWSMVPTDKAAEAGAGKAPVIDVTQFGYTKVLGKGMLPPQRPIVVKAKLISKVAEKKIKAAGGAVLLTA

SEQ ID NO: 6137 - protein, 145 aa, Hordeum vulgare
MTTRLKKNRKKRGHVSAGHGRVGKHRKHPGGRGNAGGMHHHRILFDKYHPGYFGKVGMRYFHKLSNRFYTPTVNVERLWSMVPSDKAAEAGGDKAPVVDVSQFGYFKVLGKGMLPEKPIVVKAKLISKIAEKKIKAAGGAVVLVA

SEQ ID NO: 6138 - protein, 148 aa, Avena sativa
MTTSLKKNRKKRGHVSAGHGRVGKHRKHPGGRGNAGGMHHHRILFDKYHPGYFGKVGMRYFHKLSNRFHCPTVNVDRLWSMVPADKAAEAAASPDKAPVIDVSQFGYFKILGKGMLPPNTPIVVKAKLISKIAEKKIKAAGGAVLLTA

SEQ ID NO: 6139 - protein, 129 aa, Cynodon dactylon
MTTRFKKNRKKRGHVSAGHGRIGKHRKHPGGRGPAGGMHHHRILFDKYHPGYFGKVGMRYFHKLRNKFYSPAVNVEKLWSMVPADKAAEAAAGADKAPLIDVTQFGYFKVLGKGRLPDKPIVVKAKLFS

SEQ ID NO: 6140 - protein, 145 aa, Cenchrus ciliaris
  misc_feature (4)..(4): Xaa can be any naturally occurring amino acid
  misc_feature (25)..(25): Xaa can be any naturally occurring amino acid
  misc_feature (40)..(41): Xaa can be any naturally occurring amino acid
  misc_feature (44)..(45): Xaa can be any naturally occurring amino acid
  misc_feature (48)..(49): Xaa can be any naturally occurring amino acid
  misc_feature (62)..(62): Xaa can be any naturally occurring amino acid
  misc_feature (119)..(119): Xaa can be any naturally occurring amino acid
  misc_feature (125)..(125): Xaa can be any naturally occurring amino acid
  misc_feature (144)..(144): Xaa can be any naturally occurring amino acid
MTTXLKKNRKKRGHVSAGHGRIGKXRKHPGGRGNAGGMHXXRIXXDKXXPGYFGKVGMRYFXKLRNRFYCPSVNVERLWSMVPADKAAEAGGDKAPLVDVTQFGYFKVLGKGMLPPKPXVVKAKXISKVAEKKIKAAGGAVVLXA

SEQ ID NO: 6141 - protein, 145 aa, Secale cereale
MTTGFKKNRKKRGHVSAGHGRVGKHRKHPGGRGNAGGMHHHRILFDKYHPGYFGKVGMRYFHKLSNRFYTPTINVERLWSMVPADKAAEAGGDKAPVVDVSQFGYFKVLGKGMLPEKPIVVKAKLISKIAEKKIKAAGGAVVLVA

SEQ ID NO: 6142 - protein, 145 aa, Secale cereale
MTTRFKKNRKKRGHVSAGHGRVGKHRKHPGGRGNAGGMHHHRILFDKYHPGYFGKVGMRYFHKLSNRFYTPTINVERLWSMVPADKAAEAGGDKAPVVDVSQFGYFKVLGKGMLPEKPIVVKAKLISKIAEKKIKAAGGAVVLVA

SEQ ID NO: 6143 - protein, 236 aa, Pseudoroegneria spicata
  misc_feature (83)..(83): Xaa can be any naturally occurring amino acid
MTTRFKKSRKKRGHVSAGHGRVGKHRKHPGGRGNAGGMHHHRILFDKYHPGYFGKVGMRYFHKLSNRFYTPTINVERLWSMAXAASERAAAMTTRFKKNRKKRGHVSAGHGRVGKHRKHPGGRGNAGGMHHHRILFDKYHPGYFGKVGMRYFHKLSNRFYTPTINVERLWSMVPADKAAEAGGDKAPVVDVSQFGYFKVLGKGMLPEKPIVVKAKLISKIAEKKIKAAGGAVVLVA

SEQ ID NO: 6144 - protein, 145 aa, Triticum aestivum
MTTRFKKNRKKRGHVSAGHGRVGKHRKHPGGRGNAGGMHHHRILFDKYHPGYFGKVGMRYFHKLSNRFYTPTVNVERLWSMVPSEKAAEAGGDKAPVVDVSQFGYFKVLGKGMLPEKPIVVKAKLISKIAEKKIKAAGGAVVLVA

SEQ ID NO: 6145 - protein, 148 aa, Lolium multiflorum
MTTSMKKNRKKRGHVSAGHGRVGKHRKHPGGRGNAGGMHHHRILFDKYHPGYFGKVGMRYFHKLSNRFHCPTVNVDRLWSMVPADKAAEAAATPGKAPVIDVSQFGYFKILGKGMLPPNTPIVVKAKLISKIAEKKIKAAGGAVLLTA

SEQ ID NO: 6146 - protein, 171 aa, Panicum virgatum
LPPPASTTPPSPAAAPGKSAASGGDDDPLQRRTRKKAPVTCPPGHGRIGKHRKHPGGRGNAGGMHHHRILFDKYHPGYFGKVGMRYFHKLRNRFTCPAVNVERLWSMVPAEKAAEAGADKAPQIDVTQFGYFKVLGKGKLPSKPIVVKAKLISKVAEKKIKAAGGAVVLTA

SEQ ID NO: 6147 - protein, 148 aa, Festuca arundinacea
MATSMKKNRKKRGHVSAGHGRVGKHRKHPGGRGNAGGMHHHRILFDKYHPGYFGKVGMRYFHKLSNRFHCPTVNVDRLWSMVPADKAAEAAATPGKAPVIDVSQFGYFKILGKGMLPPNTPIVVKAKLISKIAEKKIKAAGGAVLLTA

SEQ ID NO: 6148 - protein, 133 aa, Panicum virgatum
MTTSLKKNRKKRGHVSAGHGRIGKHRKHPGGRGNAGGMHHHRILFDKYHPGYFGKVGMRYFHKLRNRFSCPSVNVERLWSMVPADKAAEAAAGADKAPLVDVTQFGYFKVLGKGMLPPKPIVVKAKLISKVAE

SEQ ID NO: 6149 - protein, 144 aa, Oryza sativa
MTTRFKKNRKKRGHVSAGHGRIGKHRKHPGGRGNAGGMHHHRILFDKYHPGYFGKVGMRYFHRLSNRFHCPAVNVERLWSMVPAEAGAGAGKAPVIDVTQFGYTKVLGKGMLPPERPIVVKAKLISKVAEKKIKAAGGAVLLTA

SEQ ID NO: 6150 - protein, 583 aa, Oryza sativa
MGSWRRKAYGALKDSTKVGLAKVNSDFKELDIAIVKATNHVECPPKDRHVRKIFVATSINRPRADVQYCIYALSRRLSKTKNWTVALKTLIVVHRLLREGDPTFKEEFLAYSYKGSVLQRANFKDDSSQLAWDCSAWVRAYALFLEERLECFRILKFDIETERLMRSPECSSKAHSRTRTLPCIELLEQLPALQQLLFRLIGCQPEGAAGTNYLIQYALALVLKESFKIYCAINDGIINLVDMFFDMPKYDAIKALVVYKRAGQQAEDLSDFYDSCKQLELARTFQFPTLRQPPSSFIATMEEYIREAPRPSINSVENGERKLVTYDQEATEESEKPAEEEKDEPAESEQEQEPKQEPKPPETTGDLLNLDAEVSPLVAELEENNAWALAIVGTGDQTKASTSLDLFSGNTSGWELALVTAPSSTSQTVQTKLAGGFDKLLLDSLYEDETRRRQIAGVTYTGSIGGGAPNPFDTNDPFATSSSFLPPSNVQFAMLNQQQHQYYQSQHQQQYYQPHHFQDHQHHHNMYFQTHYQQNQIYQQQQQQQHQYPAPQAGSSNPFGDPFGDLVPMAMAVSQKHGHSSLI

SEQ ID NO: 6151 - protein, 146 aa, Unknown
  Sequence found in Organisms: Catharanthus roseus, Catharanthus roseus
MTTRFKKNRKKRGHVSAGHGRIGKHRKHPGGRGNAGGMHHHRILFDKYHPGYFGKVGMRYFHKLRNKFYCPIVNVDKLWSMVPQDVKEKATKDNAPVIDVTQFGYFKVLGKGVLPENQPFVVKAKLISKTAEKKIKEAGGAVLLTA

SEQ ID NO: 6152 - protein, 146 aa, Chelidonium majus
MTTNLKKNRKKRGHVSAGHGRIGKHRKHPGGRGNAGGMHHHRILFDKYHPGYFGKVGMRYFHKLRNKFYCPIVNVDKLWSMIPQDVKDKATPENAPLLDVTQFGYFKVLGKGALPSSQPIVVKAKLISKTAEKKIKEAGGAVILTA

SEQ ID NO: 6153 - protein, 151 aa, Eragrostis curvula
MTTSLRKNRKKRGHVSAGHGRIGKHRKHPGGRGNAGGMHHHRILFDKYHPGYFGKVGMRYFHKLRNKFYCPAVNVEQLWSMVPADKAAEAGADKDPQIDVSQFGYFKVLGKGRLPDKPIIVKGQPHLQGRREQDQSRWRRHSAHRIRYRTE

SEQ ID NO: 6154 - protein, 144 aa, Triticum aestivum
MTTRFKKNRKKRGHVSAGHGRIGKHRKHPGGRGNAGGMHHHRILFDKYHPGYFGKVGMRYFHKLRNKFYCPAVNIERLWSMVPADKAAEAGGDKAPQIDVTQFGYFKVLGKGVLPPKPIVVKATHLQGRREEVKAAGGAVVLNA

SEQ ID NO: 6155 - protein, 149 aa, Elaeis guineensis
MTTRFKKNRKKRGHVSAGHGRIGKHRKHPGGRGNAGGMHHHRILFDKYHPGYFGKVGMRYFHRLRNKFYCPTVNVDRLWSLIPDDVKESATAGGGSSAPLIDVTQFGYFKVLGKGMLPPSSPVVVKAKLVSKIAEKKIKAAGGAVLLTA

SEQ ID NO: 6156 - protein, 149 aa, Phalaenopsis aphrodite
MTTRFKKNRKKRGHVSAGHGRIGKHRKHPGGRGNAGGMHHHRILFDKYHPGYFGKVGMRYFHRLRNKFYCPTVNIDRLWSLVPEEVKAAAVAAPGGKAPLIDVTQFGYFKVLGKGMLPASQPVVVKAKLISKTAEKKIKANGGAVLLTA

SEQ ID NO: 6157 - protein, 146 aa, Artemisia annua
MTTSLRKNRKKRGHVSAGHGRIGKHRKHPGGRGNAGGMHHHRILFDKYHPGYFGKVGMRYFHKLRNKFYCPIVNVDKLWSMVPQEAKEKATGDKVPVVDVTQLGYFKVLGKGSVPVKHPMVVKAKLISKVAEKKIKEAGGAVVLTA

SEQ ID NO: 6158 - protein, 146 aa, Eschscholzia californica
MTTRLKKNRKKRGHVSAGHGRIGKHRKHPGGRGNAGGMHHHRILFDKYHPGYFGKVGMRYFHKLRNKFYCPIVNVDKLWSMIPEDVKAKASPENAPLLDVTQFGFFKVLGKGSLPSSQPIVVKAKLISKTAEKKIKEAGGAVVLTA

SEQ ID NO: 6159 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPEDVKEKANGDKVPVVDVTQYGYFKVLGKGTVPASQPIVVKAKLISKIAEKKIKEAGGAVVLTA

SEQ ID NO: 6160 - protein, 146 aa, Lactuca sativa
MTTRLRKNRKKRGHVSAGHGRIGKHRKHPGGRGNAGGMHHHRILFDKYHPGYFGKVGMRYFHKLRNKFYCPIVNVDKLWSMVPQDVRENASADKIPVVDVTQHGFFKVLGKGMVPPSHPMVVKAKLISKTAEKKIKEAGGAVLLTA

SEQ ID NO: 6161 - protein, 144 aa, Plantago ovata
MTTHLRKNRKKRGHVSAGHGRIGKHRKHPGGRGNAGGMHHHRILFDKYHPGYFGKVGMRYFHKLRNKFYCPTVNVDRIWSMVPADVKEKASKDNAPMIDVTQFGYFKVLGKGLVEKPVVVKAKLISKTAERKIKEAGGAVVLTA

SEQ ID NO: 6162 - protein, 148 aa, Musa acuminata
MTTRFRKNRKKRGHVSAGHGRIGKHRKHPGGRGNAGGMHHHRILFDKYHPGYFGKVGMRYFHRLRNKFHCPAVNVDRLWSLVPDAVKESAAKDGTAAPLIDVTQFGYFKVLGKGMLPPDRPVVVKAKLISKIAEKKIKAAGGAVVLTA

SEQ ID NO: 6163 - protein, 149 aa, Elaeis guineensis
MTTRFKKNRKKRGHVSAGHGRIGKHRKHPGGRGNAGGMHHHRILFDKYHPGYFGKVGMRYFHRLRNKFYCPTVNVDRLWSLVPDDVKESAVACDANSAPLIDVTQFGYFKVLGKGMLPPSRPVVVKAKLVSKIAEKKIKAAGGAVLLTA

SEQ ID NO: 6164 - protein, 143 aa, Amorphophallus konjac
KKNRKKRGHVSAGHGRIGKHRKHPGGRGNAGGMHHHRILFDKYHPGYFGKVGMRYFHKLRNKFYCPAVNVDRLWSLVPEDVKANAAAGGAGAPLLDVTQFGYFKVLGKGALPRSQPIVVKAKLVSKIAEKKIKEAGGAVVLTA

SEQ ID NO: 6165 - protein, 146 aa, Ocimum basilicum
MTTRFKKNRKKRGHVSAGHGRIGKHRKHPGGRGNAGGMHHHRILFDKYHPGYFGKVGMRYFHKLRNKFYCPTVNIDRLWSLVPQEVKDKASKDNAPLLDVTQFGYFKVLGKGLLPADKPVVVKAKLVSKNAEKKIKEAGGAVVLTA

SEQ ID NO: 6166 - protein, 146 aa, Cirsium arvense
MTTRFKKNRKKRGHVSAGHGRIGKHRKHPGGRGNAGGMHHHRILFDKYHPGYFGKVGMRYFHRLRNKFHCPIVNVDKLWSMVPQDAKENASADKVPIVDVTQFGYFKVLGKGMVPPSQPMVVKAKLISKTAEKKIKEAGGAVLLTA

SEQ ID NO: 6167 - protein, 146 aa, Cirsium arvense
MTTRFKKNRKKRGHVSAGHGRIGKHRKHPGGRGNAGGMHHHRILFDKYHPGYFGKVGMRYFHRLRNKFHCPIVNVDKLWSMVPSDAKENASADKVPIVDVTQFGYFKVLGKGMVPPSHPMVVKAKLISKTAEKKIKEAGGAVLLTA

SEQ ID NO: 6168 - protein, 146 aa, Eschscholzia californica
MTTGLKKNRKKRGHVSAGHGRIGKHRKHPGGRGNAGGMHHHRILFDKYHPGYFGKVGMRYFHKLRNKFFCPIVNVEKLWSMIPQDVKDKANPNNVPVIDVTQFGYFKVLGKGVLPQSQPIVVKAKLISKVAEKKIKEAGGAVVLTA

SEQ ID NO: 6169 - protein, 146 aa, Eschscholzia californica
MTTRLKKNRKKRGHVSAGHGRIGKHRKHPGGRGNAGGMHHHRILFDKYHPGYFGKVGMRYFHKLRNKFFCPIVNVEKLWSMIPQETKDKASPENAPLIDVTQFGYFKVLGKGVLPQSQPIVVKAKLISKVAEKKIKEAGGAVVLTA

SEQ ID NO: 6170 - protein, 147 aa, Eucalyptus grandis
MTTRFKKNRKKRGHVSAGHGRIGKHRKHPGGRGNAGGMHHHRILFDKYHPGYFGKVGMRYFHKLRNKFYCPIVNVEKLWSLVPQDAKDKASGAAAAPVLDVTQFGFFKVLGKGVLPEKQPIVVKAKLVSKIAEKKIKEAGGAVVLTA

SEQ ID NO: 6171 - protein, 146 aa, Fagopyrum esculentum
MTTHLKKNRKKRGHVSAGHGRIGKHRKHPGGRGNAGGMHHHRILFDKYHPGYFGKVGMRYFHKLRNKFFCPKVNVENLWSLLPQEVKDKASKDNAPVIDVTQFGYFKVLGKGVLPPNQPIVVKAKLISKIAEKKIKEAGGAVVLTA

SEQ ID NO: 6172 - protein, 146 aa, Fagopyrum esculentum
MTTHLKKNRKKRGHVSAGHGRIGKHRKHPGGRGNAGGMHHHRILFDKYHPGYFGKVGMRYFHKLRNKFFCPKVNVEHLWSLVPQEVKDKATKDNAPVIDVTQFGYFKVLGKGLLPANQPIVVKAKLISKIAEKKIKEAGGAVVLTA

SEQ ID NO: 6173 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPADVKEKASTDKVPVIDVTQHGYFKVLGKGTVSASQPIVVKAKLISKIAEKKIKEAGGAVVLTA

SEQ ID NO: 6174 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPQDVKEKASADKVPVIDVTQHGYFKVLGKGTVPASQPIVVKAKLISKTAEKKIKEAGGAVVLTA

SEQ ID NO: 6175 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPEDVKEKASADKVPVIDVTQHGYFKVLGKGTVPASQPIVVKAKLISKTAEKKIKEAGGAVVLTA

SEQ ID NO: 6176 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPQDVKEKATADKVPVVDVTQYGYFKVLGKGTVPASQPIVVKAKLISKNAEKKIKEAGGAVVLTA

SEQ ID NO: 6177 - protein, 146 aa, Gerbera hybrid cultivar
MTTRFRKNRKKRGHVSAGHGRIGKHRKHPGGRGNAGGMHHHRILFDKYHPGYFGKVGMRYFHRLRNKFHCPIVNVDKLWSMVPEDVKEKATADKVPVVDVTQFGYFKVLGKGMVPPSQPMVVKAKLISKTAEKKIKEAGGAVLLTA

SEQ ID NO: 6178 - protein, 146 aa, Vitis vinifera
MTTRFKKNRKKRGHVSAGHGRIGKHRKHPGGRGNAGGMHHHRILFDKYHPGYFGKVGMRYFHKLRNKFYCPIVNIDKLWSMVPQDVKDKASPDNAPLIDVTQFGYFKVLGKGALPSSQPIVVKAKLVSKIAEKKIKEAGGAVVLTA

SEQ ID NO: 6179 - protein, 146 aa, Populus trichocarpa
MTTRFKKNRKKRGHVSAGHGRIGKHRKHPGGRGNAGGMHHHRILFDKYHPGYFGKVGMRYFHKLRNKFYCPIVNIDKLWSMVPQDVKDKATKDTVPMIDVTQFGYFKVLGKGVLPDKQPIVVKAKLISKIAEKKIKEAGGAVVLTA

SEQ ID NO: 6180 - protein, 146 aa, Populus trichocarpa
MTTRFKKNRKKRGHVSAGHGRIGKHRKHPGGRGNAGGMHHHRILFDKYHPGYFGKVGMRYFHKLRNKFYCPIVNIDKLWSMVPQDVKDKATKDTVPMIDVTQFGYFKVLGKGVLPEKQPIVVKAKLISKIAEKKIKEAGGAVVLTA

SEQ ID NO: 6181 - protein, 147 aa, Papaver somniferum
MTTHLKKNRKKRGHVSAGHGRVGKHRKHPGGRGNAGGMHHHRILFDKYHPGYFGKVGMRYFHKLRNKFYCPIVNIDKLWSMVPEDVKAKAKGTDEAPVIDVTQYGYFKVLGKGVLPDNQPIVVKAKLISKTAEKKIKDAGGAVILTA

SEQ ID NO: 6182 - protein, 109 aa, Utricularia gibba
MHHHRILFDKYHPGYFGKVGMRYFHKLRNKFFCPTVNVDRLWSMVPKNVKEKASKDNVPLIDVTQFGYFKVLGKGTLPEDQPVVVKAKLVSKNAEKKIKEAGGAVLLTA

SEQ ID NO: 6183 - protein, 149 aa, Prunus mume
MTTSLKKNRKKRGHVSAGHGRIGKHRKHPGGRGNAGGMHHHRILFDKYHPGYFGKVGMRYFHKLRNKFYCPIVNVDELWSLVPQEAKDKAAANKGNDVPLIDVTQFGYFKVLGKGALPQNQPVVVKAKLISKTAEKKIKEAGGAVVLTA

SEQ ID NO: 6184 - protein, 149 aa, Prunus persica
MTTSLKKNRKKRGHVSAGHGRIGKHRKHPGGRGNAGGMHHHRILFDKYHPGYFGKVGMRYFHKLRNKFYCPIVNVDKLWSLVPQEAKDKAAANKGNDVPLIDVTQFGYFKVLGKGALPQNQPVVVKAKLISKTAEKKIKEAGGAVVLTA

SEQ ID NO: 6185 - protein, 148 aa, Musa acuminata
MTTRFKKNRKKRGHVSAGHGRIGKHRKHPGGRGNAGGMHHHRILFDKYHPGYFGKVGMRYFHRLRNKFHCPALNVDRLWSLVPDAVKDAAAKDAAAAPLIDVTQFGYFKVLGKGMLPPGRSVVVKAKLISKIAEKKIKAAGGAVVLTA

SEQ ID NO: 6186 - protein, 148 aa, Musa acuminata
MTTRFKKHRKKRGHVSAGHGRIGKHRKHPGGRGNAGGMHHHRILFDKYHPGYFGKVGMRYFHRLRNKFHCPAVNVDRLWSLVPDAVKDAATKDAAAAPLIDVTQFGYFKVLGKGMLPSDRPVVVKAKLISKIAEKKIKAAGGAVVLTA

SEQ ID NO: 6187 - protein, 149 aa, Musa acuminata
MTTRFRKNRKKRGHVSSGHGRIGKHRKHPGGRGNAGGMHHHRILFDKYHPGYFGKVGMRYFHRLRNKFYCPAVNVDRLWSLVPEAVKDAAAAKGGATAPLVDVTQFGYFKVLGKGILPPDRSVVVKAKLVSKIAEKKIKAAGGAVVLTA

SEQ ID NO: 6188 - protein, 149 aa, Elaeis guineensis
MTTRFKKNRKKRGHVSAGHGRIGKHRKHPGGRGNAGGMHHHRILFDKYHPGYFGKVGMRYFHRLRNKFHCPTVNVDRLWSLVPDDVKAAAAAAGGSSAPMIDVTQFGYFKVLGKGMLPPTCPVVVKAKLVSKIAEKKIKEAGGAVVLTA

SEQ ID NO: 6189 - protein, 146 aa, Ricinus communis
MTTRFKKNRKKRGHVSAGHGRIGKHRKHPGGRGNAGGMHHHRILFDKYHPGYFGKVGMRYFHKLRNKFYCPIVNIDKLWSMIPEDVKDKANKDNVPLLDVTQFGYFKVLGKGVLPENQPIVVKAKLVSKIAEKKIKEAGGAVVLTA

SEQ ID NO: 6190 - protein, 146 aa, Amsonia hubrichtii
MTTRFKKNRKKRGHVSAGHGRIGKHRKHPGGRGNAGGMHHHRILFDKYHPGYFGKVGMRYFHKLRNKFYCPIVNIDKLWSMVPQDVKDKATKDNAPVIDVTQFGYFKVLGKGVLPENQPVVVKAKLISKTAEKKIKEAGGAVVLTA

SEQ ID NO: 6191 - protein, 146 aa, Arnica chamissonis
MTTGLRKNRKKRGHVSAGHGRIGKHRKHPGGRGNAGGMHHHRILFDKYHPGYFGKVGMRYFHRLRNKFYCPIVNVDKLWSLVPQDVKEKSTGDKVPVIDVTQHGYFKVLGKGNVPASKPFVVKAKLISKTAEKKIKEAGGAVLLTA

SEQ ID NO: 6192 - protein, 146 aa, Arnica chamissonis
MTTSLRKNRKKRGHVSAGHGRIGKHRKHPGGRGNAGGMHHHRILFDKYHPGYFGKVGMRYFHRLRNKFHCPIVNVDKLWSMVPQDVKEKSSADKVPVIDVTQFGYFKVLGKGTVPASQPFVVKAKLISKTAEKKIKEAGGAVLLTA

SEQ ID NO: 6193 - protein, 146 aa, Cannabis sativa
MTTRFKKNRKKRGHVSAGHGRVGKHRKHPGGRGNAGGMHHHRILFDKYHPGYFGKVGMRYFHKLRNKFYSPIVNIDRLWSMVPQEVKDKATKDNVPLIDVTQFGYFKVLGKGALPENQPVVVKAKLISKIAEKKIKAAGGAVLLTA

SEQ ID NO: 6194 - protein, 146 aa, Catharanthus roseus
MTTRFKKNRKKRGHVSAGHGRIGKHRKHPGGRGNAGGMHHHRILFDKYHPGYFGKVGMRYFHKLRNKFYCPIVNVDKLWSLVPSDVKEKADGSNAPVIDVTQYGYFKVLGKGVLPQNQPVVVKAKLISKTAEKKIKEAGGAVVLTA

SEQ ID NO: 6195 - protein, 146 aa, Cleome gynandra
MTTSLKKTRKKRGHVSAGHGRIGKHRKHPGGRGNAGGMHHHRILFDKYHPGYFGKVGMRYFHKLRNKFYCPIVNLDKLWSMVPQDVKDKASKDNVPMIDVTQFGYFKVLGKGMLPENQPVVVKAKLVSKTAEKKIKEAGGAVVLTA

SEQ ID NO: 6196 - protein, 146 aa, Cucurbita pepo
MTTRFKKNRKKRGHVSAGHGRIGKHRKHPGGRGNAGGMHHHRILFDKYHPGYFGKVGMRYFHKLRNKFYCPIVNVDKLWSLVPQEVKDKASKDNAPLVDVTQFGYFKVLGKGVLPENQPIVVKAKLISKIAEKKIKENGGAVVLTA

SEQ ID NO: 6197 - protein, 146 aa, Euphorbia peplus
MTTRLKKNRKKRGHVSAGHGRIGKHRKHPGGRGNAGGMHHHRILFDKYHPGYFGKVGMRYFHKLRNKFYCPIVNIEKLWSMVPQEVKDKASKDNVPMLDVTQFGFFKVLGKGVLPDGKPMVVKAKLISKIAEKKIKENGGAVVLTA

SEQ ID NO: 6198 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPEDVKEKASADKVPVVDVTQYGFFKVLGKGTVPASQPIVVKAKLISKNAEKKIKEAGGAVVLTA

SEQ ID NO: 6199 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIVNVDKLWSMVPEDAKEKASADKVPVIDVTQHGYFKVLGKGTVPASQPIVVKAKLISKTAEKKIKEAGGAVVLTA

SEQ ID NO: 6200 - protein, 146 aa, Flaveria ramosissima
MTTRLRKNRKKRGHVSAGHGRIGKHRKHPGGRGNAGGMHHHRILFDKYHPGYFGKVGMRYFHRLRNKFHCPIVNVDKLWSMVPEDVKEKASGDKVPVVDVTQYGYFKVLGKGTVPASQPIVVKAKLISKNAEKKIKEAGGAVVLTA

SEQ ID NO: 6201 - protein, 146 aa, Carpinus betulus
MTTRFKKSRKKRGHVSCGHGRIGKHRKHPGGRGNAGGMHHHRILFDKYHPGYFGKVGMRYFHRLRNKFFCPIVNVDKLWSLVPKDVKEKASKDNAPLIDVTQFGYFKVLGKGMLPENLPIVVKAKLISKTAEKKIKEAGGAVVLTA

SEQ ID NO: 6202 - protein, 146 aa, Lippia dulcis
MTTRFKKNRKKRGHVSAGHGRIGKHRKHPGGRGNAGGMHHHRILFDKYHPGYFGKVGMRYFHKLRNKFYCPTVNIDKLWSMVPQEVKDKASKDSAPLIDVTQFGYFKVLGKGLLPADKPVVVKAKLVSKNAEKKIKEAGGAVVLTA

SEQ ID NO: 6203 - protein, 146 aa, Plantago ovata
MTTHLRKNRKKRGHVSAGHGRIGKHRKHPGGRGNAGGMHHHRILFDKYHPGYFGKVGMRYFHKLRNKFYCPTVNIDRIWSMVPQEVKDKAGKDSVPLVDVTQFGYFKVLGKGLLPEGKPVVVKAKLISKNAERKIKEAGGAVVLTA

SEQ ID NO: 6204 - protein, 146 aa, Populus trichocarpa
MTTRFKKNRKKRGHVSAGHGRIGKHRKHPGGRGNAGGMHHHRILFDKYHPGYFGKVGMRYFHKLRNKFHCPIVNIDKLWSMVPQDVKDKATKDTVPMIDVTQFGYFKVLGKGVLPEKQPIVVKAKLISKIAEKKIKEAGGAVVLTA

SEQ ID NO: 6205 - protein, 146 aa, Papaver somniferum
MTTHLKKNRKKRGHVSAGHGRVGKHRKHPGGRGNAGGMHHHRILFDKYHPGYFGKVGMRYFHKLRNKFHCPIVNIDKLWSMVPQEVKDKASSDKAPVIDVTQFGYFKVLGKGVLPENQPIVVKAKLISKTAEKKIKQAGGAVVLTA

SEQ ID NO: 6206 - protein, 146 aa, Sarracenia psittacina
MTTRFKKNRKKRGHVSAGHGRIGKHRKHPGGRGNAGGMHHHRILFDKYHPGYFGKVGMRYFHKLRNKFYCPIVNIDKLWSLVPQDVKDKASPTSAPLIDVTQFGYFKVLGKGFLPASQPIVVKAKLISKTAEKKIKEAGGAVILTA

SEQ ID NO: 6207 - protein, 146 aa, Helianthus annuus
MTTSLRKNRKKRGHVSAGHGRIGKHRKHPGGRGNAGGMHHHRILFDKYHPGFFGKVGMRYFHKLRNKFYCPIVNVDRLWSLVPQDVKEKSTADKVPVIDVTQHGYFKVLGKGNVPASQPFVVKAKLISKTAEKKIKEAGGAVLLTA

SEQ ID NO: 6208 - protein, 146 aa, Tragopogon dubius
MTTRLRKNRKKRGHVSAGHGRIGKHRKHPGGRGNAGGMHHHRILFDKYHPGYFGKVGMRYFHRLRNKFHCPIVNVDKLWSMVPQDVKEKASADKVPVVDVTQFGYFKVLGKGAVPLSQPMVVKAKLISKIAEKKIKEAGGAVLLTA

SEQ ID NO: 6209 - protein, 146 aa, Utricularia gibba
MTTRLRKNRKKRGHVSAGHGRIGKHRKHPGGRGNAGGMHHHRILFDKYHPGYFGKVGMRYFHKLRNKFFCPTVNVDKLWSLVPEDVKEKASKDKVPLIDVTQFGYFKVLGKGTLPADQPVVVKAKLVSKNAEKKIKEAGGAVVLTA

SEQ ID NO: 6210 - protein, 145 aa, Pseudotsuga menziesii
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATADSAPLIDVTQFGYFKVLGKGELPSQPIVVKAKLVSKLAEKKIKEAGGAVLLTA

SEQ ID NO: 6211 - protein, 137 aa, Secale cereale
RKKRGHVSAGHGRVGKHRKHPGGRGNAGGMHHHRILFDKYHPGYFGKVGMRYFHKLSNRFYTPTVNVERLWSMVPSEKAAEAGGDKAPVVDVSQFGYFKVLGKGMLPEKPIVVKAKLISKIAEKKIKAAGGAVVLVA

SEQ ID NO: 6212 - protein, 120 aa, Cedrus atlantica
MTTRLKKNRKKRGHVSAGHGRIGKHRKHPGGRGNAGGMHHHRILFDKYHPGYFGKVGMRHFHKLRNHYHCPIVNIEKLWSLVPEDIKAKATPDSAPLIDVTQFGFLRFWARVNFPRSPSL

SEQ ID NO: 6213 - protein, 149 aa, Unknown
  Sequence found in Organisms: Malus domestica, Capsicum annuum
MTTRFKKNRKKRGHVSAGHGRIGKHRKHPGGRGNAGGMHHHRILFDKYHPGYFGKVGMRYFHRLRNKFHCPIVNLDKLWSLVPQEVKDKAAAAKGGSEAPLLDVTQFGYFKVLGKGVLPSQPLVVKAKLISKTAEKKIKEAGGAVVLTA

SEQ ID NO: 6214 - protein, 146 aa, Phaseolus vulgaris
MTTRFKKNRKKRGHVSAGHGRIGKHRKHPGGRGNAGGMHHHRILFDKYHPGYFGKVGMRYFHKLRNKFYAPIVNIDKLWSLLPQEAKDKATADKAPLLDVTQFGYFKVLGKGVLPQNQPIVVKAKLISKIAEKKIKEAGGAVVLTA

SEQ ID NO: 6215 - protein, 146 aa, Mimulus guttatus
MTTRLRKNRKKRGHVSAGHGRIGKHRKHPGGRGNAGGMHHHRILFDKYHPGYFGKVGMRYFHKLRNQFHCPIVNIEKLWSMIPQDVRDKATKDNAPMIDVTQFGYFKVLGKGLLPENKPLVVKAKLVSKVAEKKIKEAGGAVVLTA

SEQ ID NO: 6216 - protein, 146 aa, Mimulus guttatus
MTTALRKNRKKRGHVSAGHGRIGKHRKHPGGRGNAGGMHHHRILFDKYHPGYFGKVGMRYFHKLRNKFYCPTVNIDTLWSMVPQEVKDKATKDNAPVIDVTQFGYFKVLGKGLLPAGQPVVVKAKLVSKTAEKKIKEAGGAVLLTA

SEQ ID NO: 6217 - protein, 147 aa, Unknown
  Sequence found in Organisms: Prunus persica, Prunus mume
MTTRFKKNRKKRGHVSAGHGRIGKHRKHPGGRGNAGGMHHHRILFDKYHPGYFGKVGMRYFHRLRNKFHCPIVNLDKLWSLVPQDVKDKAAKGNEAPLLDVTQFGYFKVLGKGVLPSSQPLVVKAKLISKTAEKKIKEAGGAVVLTA

SEQ ID NO: 6218 - protein, 146 aa, Ambrosia trifida
MTTRLRKNRKKRGHVSAGHGRIGKHRKHPGGRGNAGGMHHHRILFDKYHPGFFGKVGMRYFHKLRNKFYCPIVNVDKLWSMVPQDVKEKASADKVPVIDVTQLGYFKVLGKGTVPASQPFVVKAKLISKTAEKKIKEAGGAVVLTA

SEQ ID NO: 6219 - protein, 146 aa, Ambrosia trifida
MTTRLRKNRKKRGHVSAGHGRIGKHRKHPGGRGNAGGMHHHRILFDKYHPGFFGKVGMRYFHRLRNKFYCPIVNVDKLWSMVPQEVKDKASGDKVPVVDVTQLGYFKVLGKGMVPPSQPMVVKAKLISKTAEKKIKEAGGAVVLTA

SEQ ID NO: 6220 - protein, 146 aa, Aquilegia formosa
MTTGLKKNRKKRGHVSAGHGRIGKHRKHPGGRGNAGGMHHHRILFDKYHPGYFGKVGMRYFHKLRNKFYCPIVNIDKLWSLVPQEIKDKATPENAPLIDVTQLGYFKVLGKGMLPPSQPVVVKAKLVSKNAEKKIKAAGGAVILTA

SEQ ID NO: 6221 - protein, 146 aa, Unknown
  Sequence found in Organisms: Brassica juncea, Brassica rapa
MATALKKNRKKRGHVSAGHGRIGKHRKHPGGRGNAGGMHHHRILFDKYHPGYFGKVGMRYFHKLRNKFYCPIVNLDKLWSLVPEDVKAKAGKDKVPMIDVTQHGFFKVLGKGHLPEGKPFVVKAKLISKTAEKKIKEAGGAVVLTA

SEQ ID NO: 6222 - protein, 146 aa, Brassica juncea
MATGLKKNRKKRGHVSAGHGRIGKHRKHPGGRGNAGGMHHHRILFDKYHPGYFGKVGMRYFHKLRNKFFCPIVNLDRLWSLVPEDVKAKAGKDKVPMIDVTQHGFFKVLGKGHLPEGKPFVVKAKLISKTAEKKIKEAGGAVVLTA

SEQ ID NO: 6223 - protein, 146 aa, Unknown
  Sequence found in Organisms: Brassica napus, Brassica juncea, Brassica rapa
MTTRFKKNRKKRGHVSAGHGRIGKHRKHPGGRGNAGGMHHHRILFDKYHPGYFGKVGMRYFHKLRNKFFCPIVNLDRLWSLVPEDVKAKATKDKVPLIDVTQHGFFKVLGKGHLPENKPFVVKAKLISKTAEKKIKEAGGAVVLTA

SEQ ID NO: 6224 - protein, 146 aa, Unknown
  Sequence found in Organisms: Brassica napus, Brassica oleracea, Brassica rapa
MTTRFKKNRKKRGHVSAGHGRIGKHRKHPGGRGNAGGMHHHRILFDKYHPGYFGKVGMRYFHKLRNKFYCPIVNLDRLWSLVPEDVKAKSTKDKVPLIDVTQHGFFKVLGKGHLPENKPFVVKAKLISKTAEKKIKEAGGAVVLTA

SEQ ID NO: 6225 - protein, 147 aa, Brassica rapa
MATALKKNRKKRGHVSAGHGRIGKHRKHPGGRGNAGGMHHHRILFDKYHPGYFGKVGMRYFHKLRNKFYCPIVNLDRLWSLVPEDVKAKAGKDDKVPMIDVTQHGFFKVLGKGHLPEGKPFVVKAKLISKTAEKKIKEAGGAVVLTA

SEQ ID NO: 6226 - protein, 146 aa, Chelidonium majus
MTTRFKKNRKKRGHVSAGHGRIGKHRKHPGGRGNAGGMHHHRILFDKYHPGYFGKVGMRYFHKLRNKFYCPIVNIDKLWSMLPEDVKAKATPENAPVIDVTQYGYFKVLGKGALPPSQPIVVKAKLISKTAEKKIKEAGGAVVLTA

SEQ ID NO: 6227 - protein, 146 aa, Cleome spinosa
MTTRFKKNRKKRGHVSAGHGRIGKHRKHPGGRGNAGGMHHHRILFDKYHPGYFGKVGMRYFHKLRNKFHCPIVNLDKLWSLVPQEVKDKATKDNAPLIDVTQFGYFKVLGKGVLPENKPIVVKAKLVSKNAEKKIKEAGGAVVLTA

SEQ ID NO: 6228 - protein, 146 aa, Cleome spinosa
MTTSLKKTRKKRGHVSAGHGRIGKHRKHPGGRGNAGGMHHHRILFDKYHPGYFGKVGMRYFHKLRNKFHCPIVNLDKIWSMVPQDVRDKATKDNVPMIDVTQFGYFKVLGKGMLPENQPIVVKAKLVSKTAEKKIKEAGGAVVLTA

SEQ ID NO: 6229 - protein, 146 aa, Unknown
  Sequence found in Organisms: Gossypium hirsutum, Gossypium raimondii
MTTRFKKNRKKRGHVSAGHGRIGKHRKHPGGRGNAGGMHHHRILFDKYHPGYFGKVGMRYFHKLRNKFYCPIVNIDKLWSLVPQDVKAKANKDAAPMIDVTQFGYFKVLGKGVLPEDQPIVVKAKLVSKTAEKKIKEAGGAVVLTA

SEQ ID NO: 6230 - protein, 146 aa, Cucumis sativus
MTTRFKKNRKKRGHVSAGHGRIGKHRKHPGGRGNAGGMHHHRILFDKYHPGYFGKVGMRYFHKLRNKFYCPIVNVDKLWSLVPQEVKDKASKDNVPLIDVTQFGYFKVLGKGVLPENKPVVVKAKLISKIAEKKIKENGGAVVLTA

SEQ ID NO: 6231 - protein, 146 aa, Euonymus alatus
MTTRLKKNRKKRGHVSAGHGRIGKHRKHPGGRGNAGGMHHHRILFDKYHPGYFGKVGMRYFHKLRNKFYCPIVNVDKLWSMVPQEVKDKASKDNVPMLDVTQFGYFKVLGKGVLPENKPIVLKAKLVSKIAEKKIKENGGAVVLVA

SEQ ID NO: 6232 - protein, 146 aa, Euonymus alatus
MTTGLKKNRKKRGHVSAGHGRIGKHRKHPGGRGNAGGMHHHRILFDKYHPGYFGKVGMRYFHKLRNKFYCPIVNVDKLWSMVPQEVKDKASKDNVPMLDVTQFGYFKVLGKGVLPENKPIVLKAKLVSKIAEKKIKENGGAVVLVA

SEQ ID NO: 6233 - protein, 146 aa, Flaveria ramosissima
MTTRLRKNRKKRGHVSAGHGRIGKHRKHPGGRGNAGGMHHHRILFDKYHPGYFGKVGMRYFHKLRNKFYCPIINVDKLWSMVPEDVKAKASADKVPVIDVTQHGYFKVLGKGTVPASQPIVVKAKLISKTAEKKIKEAGGAVVLTA

SEQ ID NO: 6234 - protein, 146 aa, Vitis vinifera
MTTRFKKNRKKRGHVSAGHGRIGKHRKHPGGRGNAGGMHHHRILFDKYHPGYFGKVGMRYFHKLRNKFYCPIVNIDKLWSLIPQDVKDKASPENAPLIDVTQFGYFKVLGKGALPESKPIVVKAKLVSKIAEKKIKEAGGAVVLTA

SEQ ID NO: 6235 - protein, 146 aa, Actinidia deliciosa
MTTRFKKNRKKRGHVSAGHGRIGKHRKHPGGRGNAGGMHHHRILFDKYHPGYFGKVGMRYFHKLRNKFYCPIVNVDKLWSLVPQHVKDQATPDNLPLIDVTQFGYFKVLGKGVLPPSKPVVVKAKIVSKNAEKKIKEAGGAVVLTA

SEQ ID NO: 6236 - protein, 146 aa, Lactuca sativa
MTTRLRKNRKKRGHVSAGHGRIGKHRKHPGGRGNAGGMHHHRILFDKYHPGYFGKVGMRYFHRLRNKFYCPIVNVDKLWSMVPQDAKEKASADKVPVVDVTQFGYFKVLGKGAVPLSHPMVVKAKLISKCAEKKIKEAGGAVVLTA

SEQ ID NO: 6237 - protein, 146 aa, Lactuca sativa
MTTRLRKNRKKRGHVSAGHGRIGKHRKHPGGRGNAGGMHHHRILFDKYHPGYFGKVGMRYFHRLRNKFHCPIVNVDKLWSMVPQDTKEKASADNVPVVDVSQFGYFKVLGKGMVPPSHPMVVKAKLISKTAEKKIKEAGGAVLLTA

SEQ ID NO: 6238 - protein, 146 aa, Parthenium argentatum
MTTSLRKNRKKRGHVSAGHGRIGKHRKHPGGRGNAGGMHHHRILFDKYHPGFFGKVGMRYFHRLRNKFHCPIVNVDKLWSMVPQDVKEKSSADKVPVIDVTQFGYFKVLGKGTVPASQPIVVKAKLISKTAEKKIKEAGGAVVLTA

SEQ ID NO: 6239 - protein, 146 aa, Platanus occidentalis
MTTRFKKNRKKRGHVSAGHGRIGKHRKHPGGRGNAGGMHHHRILFDKYHPGYFGKVGMRYFHRLRNKFYCPIVNIDKLWSMIPQDVKDKASPDNVPLIDVTQFGYFKVLGKGVLPSTQPIVVKAKTISKVAEKKIKEAGGAVVLTA

SEQ ID NO: 6240 - protein, 146 aa, Populus trichocarpa
MTTRFKKNRKKRGHVSAGHGRIGKHRKHPGGRGNAGGMHHHRILFDKYHPGYFGKVGMRYFHKLRNKFHCPIVNIDKLWSMVPQDVKDKATKDTVPMIDVTQFGYFKVLGKGVLPEKQPIVVKAKLVSKIAEKKIKEAGGAVVLTA

SEQ ID NO: 6241 - protein, 146 aa, Rosa hybrid cultivar
MTTRFKKNRKKRGHVSAGHGRIGKHRKHPGGRGNAGGMHHHRILFDKYHPGYFGKVGMRYFHKLRNKFHCPIVNLEKLWSMVPQEVKDKATKGEAPMLDVTQFGYFKVLGKGKLPGSQPLVVKTKLISKVAEKKIKEAGGAVVLTA

SEQ ID NO: 6242 - protein, 146 aa, Senecio madagascariensis
MTTRLRKNRKKRGHVSAGHGRIGKHRKHPGGRGNAGGMHHHRILFDKYHPGYFGKVGMRYFHKLRNKFYCPIVNVDKLWSMVPQEAKNSATSDKVPVVDVTQLGYFKVLGKGAVPVSHPMVVKAKLISKVAEKKIKEAGGAVLLTA

SEQ ID NO: 6243 - protein, 147 aa, Silene vulgaris
MTTRLRKNRKKRGHVSAGHGRIGKHRKHPGGRGNAGGMHHHRILFDKYHPGYFGKVGMRYFHRLRNKFHCPTVNLDKLWSMVPADVREKAAKEGKAPLLDVTQFGYFKVLGKGVLPEGQAVVVKSKLISKIAEKKIKQGGGAVLLTA

SEQ ID NO: 6244 - protein, 146 aa, Euphorbia esula
MTTRFKKNRKKRGHVSAGHGRVGKHRKHPGGRGNAGGMHHHRILFDKYHPGYFGKVGMRYFHKLRNKFYCPIVNIEKLWSMVPQEVKDKASKDNVPMLDVTQFGFFKVLGKGVLPENKPIVVKAKLISKIAEKKIKENGGAVVLTA

SEQ ID NO: 6245 - protein, 141 aa, Euphorbia esula
KKNRKKRGHVSAGHGRIGKHRKHPGGRGNAGGMHHHRILFDKYHPGYFGKVGMRYFHKLRNKFYCPIVNVEKLWSMIPQDVKEKASKDNAPMVDVTQFGFFKVLGKGVLPENQPIVVKAKLISKIAEKKIKEAGGAVVLTA

SEQ ID NO: 6246 - protein, 146 aa, Tragopogon dubius
MTTRLRKNRKKRGHVSAGHGRIGKHRKHPGGRGNAGGMHHHRILFDKYHPGYFGKVGMRYFHRLRNKFYCPIVNVDKLWSMVPQDVKEKSSADRVPVLDVTQFGYFKVLGKGSFPASQPLVVKAKLISKTAEKKIKEAGGAVVLTA

SEQ ID NO: 6247 - protein, 146 aa, Tragopogon dubius
MTTRLRKNRKKRGHVSAGHGRIGKHRKHPGGRGNAGGMHHHRILFDKYHPGYFGKVGMRYFHRLRNKFYCPIVNVDKLWSMVPQEVRDQATADKIPVVDVTQHGYFKVLGKGMVPPSQPMVIKAKLISKTAEKKIKEAGGAVLLTA

SEQ ID NO: 6248 - protein, 146 aa, Tripterygium wilfordii
MTTRLRKNRKKRGHVSAGHGRIGKHRKHPGGRGNAGGMHHHRILFDKYHPGYFGKVGMRYFHKLRNKFYCPIVNVDKLWSMVPQEVKDKASKDNVPMLDVTQFGYFKVLGKGVLPENKPIVVKAKLVSKIAEKKIKENGGAVVLAA

SEQ ID NO: 6249 - protein, 109 aa, Euphorbia peplus
MHHHRILFDKYHPGYFGKVGMRYFHKLRNKFYCPIVNVEKLWSMIPQDVKEKASKDSVPMVDVTQFGFFKVLGKGVLPENQPIVVKAKLISKIAEKKIKEAGGAVVLTA

SEQ ID NO: 6250 - protein, 155 aa, Flaveria ramosissima
MTTRLRKNRKKRGHVSAGHGRIGKHRKHPGGRGNAGGMHHHRILFDKYHPGYFGKVGMRYFHRLRNKFHCPIVNVDKLWSMVPEDVKEKASGDKVPVVDVTQYGYFKVLGKGTVPASQPIVVKAKLIRRMLRRRLRKLVVLLCSLLRFVVFILVD

SEQ ID NO: 6251 - protein, 154 aa, Fragaria vesca
MTTSLKKNRKKRGHVSAGHGRIGKHRKHPGGRGNAGGMHHHRILFDKYHPGYFGKVGMRYFHKLRNKFYCPIVNVDKLWSLVPQEVKDKASKNDVPLIDVTQHGYFKILGKGKLPADRPVVVKAKLISKVAEKKIKEAGGAVVLTALGFFFCLL

SEQ ID NO: 6252 - protein, 144 aa, Cedrus atlantica
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATADSAPLVDVTQFGYFKVLGKGELPSQPIVVKAKLISKLAEKKIKEAGGAVMLT

SEQ ID NO: 6253 - protein, 145 aa, Cycas rumphii
MTTRLKKNRKKRGHVSAGHGRVGKHRKHPGGRGNAGGLHHHRILFDKYHPGYFGKVGMRHFHLLRNKYYCPIVNVEKLWSLVPEDIKAKATSDNVPLLDVTQFGFFKVLGKGELPSQPLVVKAKLISKLAEKKIKEAGGAVLLTA

SEQ ID NO: 6254 - protein, 145 aa, Picea glauca
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATADSVPLIDVTQFGYFKVLGKGELPSQPIVVKAKLISKLAEKKIKEAGGAVMLTA

SEQ ID NO: 6255 - protein, 127 aa, Picea glauca
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATPDSVPLIDVTQFGYFKVLGKGELPSQPIVVKAKAYF

SEQ ID NO: 6256 - protein, 149 aa, Zostera marina
MTTRLKKNRKKRGHVSAGHGRVGKHRKHPGGRGNAGGMHHHRILFDKYHPGYFGKVGMRYFHKLRNKFYCPTVNIDRLWSLLPEEVKQKCFEAGENGAPLLDVTQFGYFKVLGKGILPEGKPIVVKTKLVSKNAEKKIKANGGAVVLTA

SEQ ID NO: 6257 - protein, 149 aa, Zostera marina
MTTRLKKNRKKRGHVSAGHGRVGKHRKHPGGRGNAGGMHHHRILFDKYHPGYFGKVGMRYFHKLRNKFYCPTVNIDRLWSLLPEETKAKCLKDGVNGAPLLDVTQFGYFKVLGKGMLPDGKPIVVKTKLVSKIAEKKIKANGGAVVLTA

SEQ ID NO: 6258 - protein, 143 aa, Amorphophallus konjac
KKNRKKRGHVSAGHGRIGKHRKHPGGRGNAGGMHHHRILFDKYHPGYFGKVGMRYFHKLRNKFYCPAVNVDRLWSLVPEEVKAKAKGDGSAAPLLDVTQFGFFKVLGKGALPPSQPIVVKAKLVSKIAEKKIKEAGGSVVLTA

SEQ ID NO: 6259 - protein, 148 aa, Theobroma cacao
MTTRFKKHRKKRGHVSAGHGRIGKHRKHPGGRGNAGGMHHHRILFDKYHPGYFGKVGMRYFHKLRNKFYCPIVNIDKLWSMVPQDVKDKAKCSKDSAPLIDVTQFGYFKVLGKGVLPENQPIVVKAKLVSKTAEKKIKEAGGAVVLTA

SEQ ID NO: 6260 - protein, 121 aa, Brassica napus
MTTRFKKNRKKRGHVSAGHGRIGKHRKHPGGRGNAGGMHHHRILFDKYHPGYFGKVGMRYFHKLRNKFYCPIVNLDRLWSLVPEDVKAKSTKDKVPLIDVTQHGFFKVLGKGHLPENKPFV

SEQ ID NO: 6261 - protein, 183 aa, Cirsium arvense
MIIPEKNRKAISKYLFQEGVCFAKKDYNLAKHPEIDVPNLQVIKLMQSFKSKEYVRETFAWMHYYWYLTNDGIEFLRTYLNLPSDIVPATLKKSAKPLGRPMGGPPGDRPRGPPRFEGDRPRFGDRDGYRGGPRGPPGEFGGEKGGAPADYQPAFNRGPGGRPSFGRGGGSYGGGAPPSSSFA

SEQ ID NO: 6262 - protein, 147 aa, Fagopyrum esculentum
RDDDRIEENRKKRGHVSAGHGRIGKHRKHPGGRGNAGGMHHHRILFDKYHPGYFGKVGMRYFHKLRNKFYCPKVNVENLWSLLPQEVKDKASKDNAPVIDVTQYGYFKVLGKGVLPPNQPIVVKAKLISKIAEKKIKETGGSVVLTA

SEQ ID NO: 6263 - protein, 148 aa, Thalictrum flavum
RRDDNRFKKNRKKRGHVSAGHGRIGKHRKHPGGRGNAGGMHHHRILFDKYHPGYFGKVGMRYFHKLRNKFYCPTVNIDKLWSLVPQEIKDKASADNAPLIDVTQLGFFKVLGKGMLPPSQPVVVKAKLISKNAEKKIKEAGGAVLLTA

SEQ ID NO: 6264 - protein, 171 aa, Thalictrum flavum
MTTRFKKNRKKRGHVSAGHGRIGKHRKHPGGRGNAGGMHHHRILFDKYHPGYFGKVGMRYFHKLRNKFYCPTVNIDKLWSLVPQEIKDKASADNAPLIDVTQLGFFKVLGKVCCLLLNPLLLKLNLFQRMLRRRSRKLVVLFYLLLSSFRSYVYGEGFRLCKHKFYHPYFK

SEQ ID NO: 6265 - protein, 146 aa, Ricinus communis
MTTRFKKNRKKRGHVSAGHGRIGKHRKHPGGRGNAGGMHHHRILFDKYHPGYFGKVGMRYFHKLRNKFYCPIVNIDKLWSMVPEDAKEKASKDNVPMVDVTEFGYFKVLGKGVLPENKPIVVKAKLVSKIAEKKIKENGGAVVLTA

SEQ ID NO: 6266 - protein, 146 aa, Mimulus guttatus
MTTHLRKNRKKRGHVSAGHGRIGKHRKHPGGRGNAGGMHHHRILFDKYHPGYFGKVGMRYFHKLRNQFFCPTINVDKLWSMVPQEVKDKATKDNAPLIDVTQFGYFKVLGKGLLPAGQPVVVKAKLISKTAEKKIKEAGGAVVLTA

SEQ ID NO: 6267 - protein, 146 aa, Ambrosia trifida
MTTRLRKNRKKRGHVSAGHGRIGKHRKHPGGRGNAGGMHHHRILFDKYHPGFFGKVGMRYFHRLRNKFYCPIVNVDKLWSMVPQDVKEKASADKVPVIDVTQHGYFKVLGKGTVPASQPFVVKAKLISKTAEKKIKEAGGAVVLTA

SEQ ID NO: 6268 - protein, 146 aa, Unknown
  Sequence found in Organisms: Ambrosia trifida, Helianthus annuus
MTTRLRKNRKKRGHVSAGHGRIGKHRKHPGGRGNAGGMHHHRILFDKYHPGFFGKVGMRYFHRLRNKFYCPIVNVDKLWSMVPQEVKDKASADKVPVVDVTQLGYFKVLGKGMVPPSQPMVVKAKLISKTAEKKIKEAGGAVVLTA

SEQ ID NO: 6269 - protein, 147 aa, Aquilegia formosa
MTTRFKKNRKKRGHVSAGHGRIGKHRKHPGGRGNAGGMHHHRILFDKYHPGYFGKVGMRYFHKLRNKFYCPTVNIDKLWSLVPQEIKDKANTTGNAPLIDVTQLGYFKVLGKGMLPPSQPVVVKAKLVSKNAEKKIKEAGGAVLLTA

SEQ ID NO: 6270 - protein, 146 aa, Brassica juncea
MTTRFKKNRKKRGHVSAGHGRIGKHRKHPGGRGNAGGMHHHRILFDKYHPGYFGKVGMRYFHKLRNKFYCPIVNLDRLWSLVPEDVKAKSTKDKVPLIDVTQHGFFKVLGKGHLPENRPFVVKAKLISKTAEKKIKEAGGAVVLTA

SEQ ID NO: 6271 - protein, 145 aa, Brassica juncea
MTTRFKKNRKKRGHVSAGHGRIGKHRKHPGGRGNAGGMHHHRILFDKYHPGYFGKVGMRYFHKLRNKFFCPIVNLDRLWSLVPEDVKAKATKDKVPLIDVTQHGFFKVLGKGHLPENKPFVVKAKLISKTAEKKIKEAGGAVVLT

SEQ ID NO: 6272 - protein, 146 aa, Brassica juncea
MTTRFKKNRKKRGHVSAGHGRIGKHRKHPGGRGNAGGMHHHRILFDKYHPGFFGKVGMRYFHKLRNKFFCPIVNLDRLWSLVPEDVKAKATKDKVPLIDVTQHGFFKVLGKGHLPENKPFVVKAKLISKTAEKKIKEAGGAVVLTA

SEQ ID NO: 6273 - protein, 146 aa, Unknown
  Sequence found in Organisms: Brassica napus, Brassica oleracea
MATALKKNRKKRGHVSAGHGRIGKHRKHPGGRGNAGGMHHHRILFDKYHPGYFGKVGMRYFHKLRNKFYCPIVNLDKLWSLVPEDVKAKAGKDKVPMIDVTQHGFFKVLGKGHLPENRPFVVKAKLISKTAEKKIKEAGGAVVLTA

SEQ ID NO: 6274 - protein, 146 aa, Unknown
  Sequence found in Organisms: Brassica napus, Brassica oleracea
MTTRFKKNRKKRGHVSAGHGRVGKHRKHPGGRGNAGGMHHHRILFDKYHPGYFGKVGMRYFHKLRNKFFCPIVNLDRLWSLVPEDVKAKATKDKVPLIDVTQHGFFKVLGKGHLPENKPFVVKAKLISKTAEKKIKEAGGAVVLTA

SEQ ID NO: 6275 - protein, 146 aa, Ocimum basilicum
MTTRFKKNRKKRGHVSAGHGRIGKHRKHPGGRGNAGGMHHHRILFDKYHPGYFGKVGMRYFHKLRNKFFCPTVNIDRLWALVPQEVKDKASKDNAPLIDVTQFGYFKVLGKGLLPADKPVVVKAKLVSKNAEKKIKEAGGAVVLTA

SEQ ID NO: 6276 - protein, 146 aa, Theobroma cacao
MTTRFKKHRKKRGHVSAGHGRIGKHRKHPGGRGNAGGMHHHRILFDKYHPGYFGKVGMRYFHKLRNKFYCPIVNIDKLWSLVPQDVKAKANKDAAPMIDVTQFGYFKVLGKGVLPENQPIVVKAKLVSKTAEKKIKEAGGAVVLTA

SEQ ID NO: 6277 - protein, 147 aa, Brassica napus
MATALKKNRKKRGHVSAGHGRIGKHRKHPGGRGNAGGMHHHRILFDKYHPGYFGKVGMRYFHKLRNKFYCPIVNLDRLWSLVPEDVKAKAGKDGKVPMIDVTQHGFFKVLGKGHLPEGKPFVVKAKLISKTAEKKIKEAGGAVVLTA

SEQ ID NO: 6278 - protein, 146 aa, Manihot esculenta
MTTRFKKNRKKRGHVSAGHGRIGKHRKHPGGRGNAGGMHHHRILFDKYHPGYFGKVGMRYFHKLRNKFYCPIVNIDKLWSMIPQEVKDKTSKDNVPLVDVTQFGYFKVLGKGALPENKPIVVKAKLVSKIAEKKIKEAGGAVVLTA

SEQ ID NO: 6279 - protein, 146 aa, Unknown
  Sequence found in Organisms: Castanea mollissima, Quercus alba
MATRFKKNRKKRGHVSAGHGRIGKHRKHPGGRGNAGGMHHHRILFDKYHPGFFGKVGMRYFHKLRNKFYCPIVNVDKLWSLLPNDVKDKASNDSAPVIDVTQFGYFKVLGKGVLPENKPVVVKAKLISKIAEKKIKEAGGAVVLTA

SEQ ID NO: 6280 - protein, 146 aa, Unknown
  Sequence found in Organisms: Cleome gynandra, Cleome spinosa
MTTRFKKNRKKRGHVSAGHGRIGKHRKHPGGRGNAGGMHHHRILFDKYHPGYFGKVGMRYFHKLRNKFYCPIVNLDKLWSLVPQEVKDKATKDNVPLIDVTQFGYFKVLGKGVLPENKPVVVKAKLVSKNAEKKIKEAGGAVVLTA

SEQ ID NO: 6281 - protein, 146 aa, Unknown
  Sequence found in Organisms: Gossypium hirsutum, Gossypium raimondii
MTTRFKKNRKKRGHVSAGHGRIGKHRKHPGGRGNAGGMHHHRILFDKYHPGYFGKVGMRYFHKLRNKFYCPIVNIDKLWSLVPQEVKTKANKDAAPMIDVTQFGYFKVLGKGVLPENQPIVVKAKLVSKTAEKKIKEAGGAVVLTA

SEQ ID NO: 6282 - protein, 146 aa, Eucalyptus grandis
MTTRFKKNRKKRGHVSAGHGRIGKHRKHPGGRGNAGGMHHHRILFDKYHPGYFGKVGMRYFHKLRNKFYCPIVNVEKLWSLVPQDAKDKASKDSVPVIDVTQYGFFKVLGKGVLPEKQPVVVKAKLISKIAEKKIKEAGGAVVLTA

SEQ ID NO: 6283 - protein, 146 aa, Fagopyrum esculentum
MTTGLKKNRKKRGHVSAGHGRIGKHRKHPGGRGNAGGMHHHRILFDKYHPGYFGKVGMRYFHKLRNKFFCPKVNVEKLWSLLPQEAKDKASKDNAPVIDVTQYGYFKVLGKGVLPPNQPIVVKAKLISKIAEKKIKEAGGSVVLTA

SEQ ID NO: 6284 - protein, 146 aa, Humulus lupulus
MTTRFKKNRKKRGHVSAGHGRVGKHRKHPGGRGNAGGMHHHRILFDKYHPGYFGKVGMRYFHKLRNKFYCPIVNIDKLWSMVPQEVKDKATKDNVPLIDVTQFGYFKVLGKGVLPENQPVVVKAKLISKIAEKKIKEAGGAVVLTA

SEQ ID NO: 6285 - protein, 146 aa, Ipomoea nil
MTTRFKKNRKKRGHVSAGHGRIGKHRKHPGGRGNAGGMHHHRILFDKYHPGYFGKVGMRYFHKLRNKFYCPIVNVDKLWSMVPPEVKAKASKDDVPLIDVTQLGFFKVLGKGVLPSNQPVVVKAKLVSKIAEKKIKEAGGAVLLTA

SEQ ID NO: 6286 - protein, 146 aa, Tropaeolum majus
MTTRFKKNRKKRGHVSAGHGRIGKHRKHPGGRGNAGGMHHHRILFDKYHPGYFGKVGMRYFHKLRNKFHCPIVNLDKLWSLVPQETKEKATKDAAPVIDVTQFGYFKVLGKGVLPENQPFVVKAKLISKIAEKKIKEAGGAVLLTA

SEQ ID NO: 6287 - protein, 146 aa, Cajanus cajan
MTTRFKKNRKKRGHVSAGHGRIGKHRKHPGGRGNAGGMHHHRILFDKYHPGYFGKVGMRYFHKLRNKFHCPIVNIDKLWSLLPQEAKDKASADKAPLLDVTQFGYFKVLGKGVLPQNQPLVVKAKLISKIAEKKIKEAGGAVVLTA

SEQ ID NO: 6288 - protein, 146 aa, Platanus occidentalis
MTTRFKKNRKKRGHVSAGHGRIGKHRKHPGGRGNAGGMHHHRILFDKYHPGYFGKVGMRYFHRLRNKFYCPIVNIDKLWSMIPQDVKDKASPDNAPCIDVTQFGYFKVLGKGVLPSSQPIVVKAKLVSKVAEKKIKEAGGSVVLTA

SEQ ID NO: 6289 - protein, 146 aa, Raphanus sativus
MTTRLRKNRKKRGHVSAGHGRIGKHRKHPGGRGNAGGMHHHRILFDKYHPGYFGKVGMRYFHKLRNKFFCPIVNLDRLWSLVPEDVKAKSTKDKVPLIDVTQHGFFKVLGKGHLPENKPFVVKAKLISKTAEKKIKEAGGAVVLTA

SEQ ID NO: 6290 - protein, 146 aa, Raphanus sativus
MATGLKKNRKKRGHVSAGHGRIGKHRKHPGGRGNAGGMHHHRILFDKYHPGYFGKVGMRYFHKLRNKFYCPIVNLDKLWSLVPEDVKGKATKDKVPMIDVTQHGFFKVLGKGHLPEGKPFVVKAKLISKTAEKKIKEAGGAVVLTA

SEQ ID NO: 6291 - protein, 146 aa, Raphanus sativus
MTTRLRKNRKKRGHVSAGHGRIGKHRKHPGGRGNAGGMHHHRILFDKYHPGYFGKVGMRYFHKLRNKFFCPIVNLDRLWSLVPEDVKAKATKDKVPMIDVTQHGFFKVLGKGHLPENKPFVVKAKLISKTAEKKIKEAGGAVVLTA

SEQ ID NO: 6292 - protein, 146 aa, Raphanus sativus
MTTRLRKNRKKRGHVSAGHGRIGKHRKHPGGRGNAGGMHHHRILFDKYHPGYFGKVGMRYFHKLRNKFYNPIVNLDRLWSLVPEDVKAKATKDKVPMIDVTQHGFFKVLGKGHLPEGKPFVVKAKLISKTAEKKIKEAGGAVVLTA

SEQ ID NO: 6293 - protein, 146 aa, Raphanus sativus
MTTRLRKNRKKRGHVSAGHGRIGKHRKHPGGRGNAGGMHHHRILFDKYHPGYFGKVGMRYFHKLRNKFYNPIVNLDRLWSLVPEDVKAKATKDKVPMIDVTQHGFFKVLGKGHLPENKPFVVKAKLISKTAEKKIKEAGGAVVLTA

SEQ ID NO: 6294 - protein, 146 aa, Senecio madagascariensis
MTTRLRKNRKKRGHVSAGHGRIGKHRKHPGGRGNAGGMHHHRILFDKYHPGYFGKVGMRYFHKLRNKFYCPIVNVDKLWSMVPQDVKEKDSGDKVPVIDVTQAGFFKVLGKGAVPASKPFVVKTKLISKTAEKKIKEAGGAVVLCA

SEQ ID NO: 6295 - protein, 146 aa, Helianthus annuus
MTTRLRKNRKKRGHVSAGHGRIGKHRKHPGGRGNAGGMHHHRILFDKYHPGFFGKVGMRYFHRLRNKFHCPIVNVDKLWSMVPQDVKEKSSTDKVPVIDVTQFGYFKVLGKGTVPASQPIVVKAKLISKTAEKKIKEAGGAVVLTA

SEQ ID NO: 6296 - protein, 146 aa, Tabernaemontana elegans
MTTRFKKNRKKRGHVSAGHGRIGKHRKHPGGRGNAGGMHHHRILFDKYHPGYFGKVGMRYFHKLRNKFYCPIVNIDKLWSLVPSDVKEKANGSNAPVIDVSQFGYFKVLGKGVLPQNQPVVVKAKLVSKTAEKKIKEAGGAVVLTA

SEQ ID NO: 6297 - protein, 146 aa, Thalictrum flavum
MTTRFKKNRKKRGHVSAGHGRIGKHRKHPGGRGNAGGMHHHRILFDKYHPGYFGKVGMRYFHKLRNKFYCPTVNIDKLWSLVPQEIKDKASAENAPLIDVTQLGFFKVLGKGMLPPSQPVVVKAKLISKNAEKKIKEAGGAVLLTA

SEQ ID NO: 6298 - protein, 146 aa, Triphysaria pusilla
MTTRFKKNRKKRGHVSAGHGRIGKHRKHPGGRGNAGGMHHHRILFDKYHPGYFGKVGMRYFHRLRNKFHCPTVNIDTLWSMVPQEVKDKATKDNAPLIDVTQFGYFKVLGKGLLPADRPVVVKAKLVSKVAEKKIKEAGGAVVLTA

SEQ ID NO: 6299 - protein, 146 aa, Citrullus lanatus
MTTRFKKNRKKRGHVSAGHGRIGKHRKHPGGRGNAGGMHHHRILFDKYHPGYFGKVGMRYFHKLRNKFYCPIVNVDKLWSLVPQEVKDKASKDNVPLIDVTQFGYFKVLGKGVLPENQPVVVKAKLISKIAEKKIKENGGAVVLTA

SEQ ID NO: 6300 - protein, 145 aa, Abies balsamea
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATPDSAPLIDVTQFGFFKVLGKGELPSQPLVVKAKLISKLAEKKIKEAGGAVMLTA

SEQ ID NO: 6301 - protein, 145 aa, Abies balsamea
MTTRLKKNRKKRGHVSAGHGRIGKHRKHPGGRGNAGGMHHHRILFDKYHPGYFGKVGMRHFHKLRNHYHCPIVNIEKLWSLIPEDVKAKATADSAPLIDVTQFGYFKVLGKGELPKQPIVVKAKLISKLAERKIKEAGGAVMLTA

SEQ ID NO: 6302 - protein, 145 aa, Cycas rumphii
  misc_feature (32)..(32): Xaa can be any naturally occurring amino acid
MTTRLKKNRKKRGHVSAGHGRVGKHRKHPGGXGNAGGLHHHRILFDKYHPGYFGKVGMRHFHLLRNQYYCPIVNVEKLWSLVPEDVKAKATSDNVPLLDVTQFGYFKVLGKGELPTQPLVVKAKLISKLAEKKIKEAGGAVLLTA

SEQ ID NO: 6303 - protein, 145 aa, Pinus pinaster
MTTRLKKNRKKRGHVSAGHGRIGKHRKHPGGRGNAGGMHHHRILFDKYHPGYFGKVGMRHFHKLRNHYHCPIVNIDKLWALVPEDVKAKATPDSAPLIDVTQFGYFKVLGKGELPSQPIVVKAKLISKLAEKKIKEAGGAVMLTA

SEQ ID NO: 6304 - protein, 145 aa, Tropaeolum majus
MTTRFKKNRKKRGHVSAGHGRIGKHRKHPGGRGNAGGMHHHRILFDKYHPGYFGKVGMRYFHKLRNKFHCPIVNLDKLWSLVPQETKDKATKDAAPVIDVTQFGYFKVLGKGVLPDQPFVVKAKLISKIAEKKIKAAGGAVQLTA

SEQ ID NO: 6305 - protein, 145 aa, Pinus taeda
MTTRLKKNRKKRGHVSAGHGRIGKHRKHPGGRGNAGGMHHHRILFDKYHPGYFGKVGMRHFHKLRNHYHCPIVNIDKLWSLVPEDVKAKATPDSAPLIDVTQFGFFKVLGKGELPSQPIVVKAKLISKLAEKKIKEAGGAVMLTA

SEQ ID NO: 6306 - protein, 145 aa, Picea glauca
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATPDSVPLIDVTQFGFFKVLGKGELPSQPIVVKAKLISKLAEKKIKEAGGAVMLTA

SEQ ID NO: 6307 - protein, 120 aa, Pinus taeda
MTTRLKKNRKKRGHVSAGHGRIGKHRKHPGGRGNAGGMHHHRILFDKYHPGYFGKVGMRHFHKLRNHYHCPIVNIDKLWSLVPEDVKAKATPDSAPLIDVTQFGFLRYWVRASCRRNPSS

SEQ ID NO: 6308 - protein, 72 aa, Picea glauca
MTTRLKKNRKKRGHVSAGHGRIGKHRKHPGGRGNAGGMHHHRILFDKYHPGYFGSWYEAFPQAQESLSLSHR

SEQ ID NO: 6309 - protein, 150 aa, Petunia hybrida
MTTRFKKNRKKRGHVSAGHGRIGKHRKHPGGRGNAGGMHHHRILFDKYHPGYFGKVGMRYFHKLRNKFYCPTVNIDKLWSLVPQDVKDKVAAGGAKGTAPLIDVTQYGYFKVLGKGVLPENQAVVVKAKLVSKNAEKKIKEAGGAVVLTA

SEQ ID NO: 6310 - protein, 149 aa, Euonymus alatus
MTTRLRKNRKKRGHVSAGHGRIGKHRKHPGGRGNAGGMHHHRILFDKYHPGYFGKVGMRYFHKLRNKFYCPSVNIEKLWSMVPQDVKEVVKSSKDGNVPVIDVTQFGYFKVLGKGVLPENQPIVVKAKLISKIAEKKIKENGGAVVLTA

SEQ ID NO: 6311 - protein, 148 aa, Glycyrrhiza uralensis
MTTRFKKNRKKRGHVSAGHGRIGKHRKHPGGRGNAGGMHHHRILFDKYHPGYFGKVGMRYFHKLRNKFYCPIVNIDKLWSLVPQEVKDKATKDNNTAPLLDVTQLGYFKVLGKGVLPPNQPLVVKAKLVSKIAEKKIKEAGGAVVLTA

SEQ ID NO: 6312 - protein, 148 aa, Glycyrrhiza uralensis
MTTRLKKNRKKRGHVSAGHGRIGKHRKHPGGRGNAGGMHHHRILFDKYHPGYFGKVGMRYFHKLRNKFYCPTLNIDKLWSLIPQEVKDQASTDKAKAPLIDVTSFGYFKVLGKGVLPPNQPVVVKAKLVSKIAEKKIKEAGGAVLLTA

SEQ ID NO: 6313 - protein, 148 aa, Arachis hypogaea
MTTRFKKNRKKRGHVSAGHGRIGKHRKHPGGRGNAGGMHHHRILFDKYHPGYFGKVGMRYFHKLRNKFHCPIVNIDKLWSLVPQELKDKASKDGTKAPLIDVTQFGYFKVLGKGILPENQPVVVKAKLVSKVAEKKIKEAGGAVVLTA

SEQ ID NO: 6314 - protein, 148 aa, Capsicum annuum
MTTRFKKNRKKRGHVSAGHGRIGKHRKHPGGRGNAGGMHHHRILFDKYHPGYFGKVGMRYFHKLRNKFYCPTVNIDKLWSLVPQEVKDKAAASKDSAPLIDVTQYGYFKVLGKGVLPENQPVVVKAKLISKNAEKKIKENGGAVVLTA

SEQ ID NO: 6315 - protein, 148 aa, Glycine max
MTTRFKKNRKKRGHVSAGHGRIGKHRKHPGGRGNAGGMHHHRILFDKYHPGFFGKVGMRYFHKLRNKFYSPIVNVEKLWSLIPQDAKEKALKSKDTAPLIDVTQHGYFKVLGKGVLPQNQPFVVKAKLISKIAEKKIKEAGGAVLLTA

SEQ ID NO: 6316 - protein, 51 aa, Gerbera hybrid cultivar
MTTRLRKNRKKRGHVSAGHGRIGKHRKHPGGRGNAGGMHHHRILFDKYHPG

SEQ ID NO: 6317 - protein, 115 aa, Vinca minor
MTTRFKKNRKKRGHVSAGHGRIGKHRKHPGGRGNAGGMHHHRILFDKYHPGYFGKVGMRYFHKMKNQFHCPIVNVDKLWSMVPQDVKDKAGKDKSAPVIDVTQFGYFKVLGKGFA

SEQ ID NO: 6318 - protein, 146 aa, Prunus mume
MTTRFKKNRKKRGHVSAGHGRIGKHRKHPGGRGNAGGMHHHRILFDKYHPGYFGKVGMRYFHKLRNKFYCPIVNVDRLWSLLPQEAKDKATKDSAPLIDVTQYGFFKVLGKGALPQNQPVVVKAKLISKTAEKKIKEAGGAVVLTA

SEQ ID NO: 6319 - protein, 146 aa, Acacia harpophylla
MTTRFKKNRKKRGHVSAGHGRIGKHRKHPGGRGNAGGMHHHRILFDKYHPGYFGKVGMRYFHKLRNKFYCPIVNIDKLWSLVPNEVKEKASKDSVPLIDVTQHGYFKVLGKGVLPENQPVVVKAKLVSKNAEKKIKEAGGAVVLTA

SEQ ID NO: 6320 - protein, 147 aa, Amsonia hubrichtii
MTTRFKKNRKKRGHVSAGHGRIGKHRKHPGGRGNAGGMHHHRILFDKYHPGYFGKVGMRYFHKLRNKFYCPIVNIDKLWSLVPSDVKEKANGSNNAPVIDVTQFGYFKVLGKGVLPQNQPVVVKAKLVSKTAEKKIKEAGGAVVLTA

SEQ ID NO: 6321 - protein, 146 aa, Antirrhinum majus
  misc_feature (59)..(59): Xaa can be any naturally occurring amino acid
  misc_feature (87)..(87): Xaa can be any naturally occurring amino acid
MTTRLKKNRKKRGHVSAGHGRIGKHRKHPGGRGNAGGMHHHRILFDKYHPGYFGKVGMXYFHRLRNKFHCPTVNVERLWSMVPQEVXDKASKESVPLIDVTQFGYFKVLGKGLLPDGQAVVVKAKLVSKSAEKKIKEAGGAVVLTA

SEQ ID NO: 6322 - protein, 146 aa, Malus domestica
MTTRFKKNRKKRGHVSAGHGRIGKHRKHPGGRGNAGGMHHHRILFDKYHPGYFGKVGMRYFHKLRNKFYCPIVNVDKLWSLLPQEAKDRATKDNAPLIDVTQYGFFKVLGKGELPQNQPIVVKAKLISKTAEKKIKEAGGAVVLTA

SEQ ID NO: 6323 - protein, 146 aa, Artemisia annua
MTTRLRKNRKKRGHVSAGHGRIGKHRKHPGGRGNAGGMHHHRILFDKYHPGYFGKVGMRYFHRLRNKFHCPIVNVDKLWSMVPQDAKEKSSADKVPVVDVTQFGYFKVLGKGAVPLTHPMVVKAKLISKTAEKKIKEAGGAVVLTA

SEQ ID NO: 6324 - protein, 146 aa, Unknown
  Sequence found in Organisms: Brassica napus, Brassica juncea
MATALKKNRKKRGHVSAGHGRIGKHRKHPGGRGNAGGMHHHRILFDKYHPGYFGKVGMRYFHKLRNKFYCPIVNLDKLWSLVPEDVKAKSTKDKVPMIDVTQHGFFKVLGKGHLPEGKPFVVKAKLISKTAEKKIKEAGGAVVLTA

SEQ ID NO: 6325 - protein, 146 aa, Brassica juncea
MATALKKNRKKRGHVSAGHGRIGKHRKHPGGRGNAGGMHHHRILFDKYHPGYFGKVGMRYFHKLRNKFFCPIVNLDKLWSLVPEDVKAKASKDKVPMIDVTQHGFFKVLGKGHLPEGKPFVVKAKLISKTAEKKIKEAGGAVVLTA

SEQ ID NO: 6326 - protein, 146 aa, Brassica juncea
MTTRFKKNRKKRGHVSAGHGRIGKHRKHPGGRGNAGGMHHHRILFDKYHPGFFGKVGMRYFHKLRNKFFCPIVNLDKLWSLVPEDVKAKATKDKVPLIDVTQHGFFKVLGKGHLPENKPFVVKAKLISKTAEKKIKEAGGAVVLTA

SEQ ID NO: 6327 - protein, 145 aa, Brassica juncea
MTTRFKKNRKKRGHVSAGHGRIGKHRKHPGGRGNAGGMHHHRILFDKYHPGYFGKVGMRYFHKLRNKFFCPIVNLDRLWSLVPEDVKAKATKDKVPLIDVTQHGFFKVLGKGHLPENKPFVVKAKLISKTAERKIKEAGGAVVLT

SEQ ID NO: 6328 - protein, 147 aa, Brassica oleracea
MATALKKNRKKRGHVSAGHGRIGKHRKHPGGRGNAGGMHHHRILFDKYHPGYFGKVGMRYFHKLRNKFYCPIVNLDRLWSLVPEDVKAKAGKDSKVPMIDVTQHGFFKVLGKGHLPENRPFVVKAKLISKTAEKKIKEAGGAVVLTA

SEQ ID NO: 6329 - protein, 146 aa, Brassica oleracea
MATALKKNRKKRGHVSAGHGRIGKHRKHPGGRGNAGGMHHHRILFDKYHPGYFGKVGMRYFHKLRNKFYCPIVNLDKLWSLVPDDVKAKSTKDKVPMIDVTQHGFFKVLGKGHLPEGKPFVVKAKLISKTAEKKIKEAGGAVVLTA

SEQ ID NO: 6330 - protein, 146 aa, Centaurea maculosa
MTTRLRKNRKKRGHVSAGHGRIGKHRKHPGGRGNAGGMHHHRILFDKYHPGYFGKVGMRYFHRLRNKFHCPIVNVDKLWSMVAEDVKEKASADKVPVVDVTQHGYFKVLGKGNVPLSHPMVVKAKLISKTAEKKIKEAGGSVLLTA

SEQ ID NO: 6331 - protein, 146 aa, Centaurea maculosa
MTTRLRKNRKKRGHVSAGHGRIGKHRKHPGGRGNAGGMHHHRILFDKYHPGYFGKVGMRYFHRLRNKFHCPIVNVDKLWSMVPQDVKEKSSADKVPVVDVTQFGYFKVLGKGAVPLTQPMVVKAKLISKTAEKKIKEAGGCVVLTA

SEQ ID NO: 6332 - protein, 146 aa, Unknown
  Sequence found in Organisms: Cirsium arvense, Cynara scolymus
MTTRLRKNRKKRGHVSAGHGRIGKHRKHPGGRGNAGGMHHHRILFDKYHPGYFGKVGMRYFHRLRNKFHCPIVNVDKLWSMVPQDVKEKSSADKVPVVDVTQFGYFKVLGKGAVPLTQPMVVKAKLISKTAEKKIKDAGGCVVLTA

SEQ ID NO: 6333 - protein, 146 aa, Citrus clementina
MTTRFKKNRKKRGHVSAGHGRIGKHRKHPGGRGNAGGMHHHRILFDKYHPGYFGKVGMRYFHKLRNKFHCPIVNIDKLWSMVPQDVKAKASKDNVPMIDVTQFGYFKVLGKGVLPENQPVVVKAKLVSKTAEKKIKEAGGAVVLTA

SEQ ID NO: 6334 - protein, 146 aa, Citrus clementina
MTTRFKKNRKKRGHVSAGHGRIGKHRKHPGGRGNAGGMHHHRILFDKYHPGYFGKVGMRYFHKLRNKFHCPIVNVDKLWSMVPQEVKAKASKDNVPMIDVTQFGYFKVLGKGVLPENQPVVVKAKLVSKTAEKKIKEAGGAVVLTA

SEQ ID NO: 6335 - protein, 146 aa, Cleome gynandra
MTTRFKKNRKKRGHVSAGHGRIGKHRKHPGGRGNAGGMHHHRILFDKYHPGYFGKVGMRYFHKLRNKFYCPIVNLDKLWSLVPQEVKDKATKDNVPMIDVTQFGYFKVLGKGVLPENKPVVVKAKLVSKNAEKKIKEAGGAVVLTA

SEQ ID NO: 6336 - protein, 146 aa, Unknown
  Sequence found in Organisms: Gossypium hirsutum, Gossypium raimondii
MTTRFKKNRKKRGHVSAGHGRIGKHRKHPGGRGNAGGMHHHRILFDKYHPGYFGKVGMRYFHKLCNKFYCPIVNIDKLWSLVPQDVKAKANKDSAPMIDVTQFGYFKVLGKGVLPQNQPMVVKAKLVSKTAEKKIKEAGGAVVLTA

SEQ ID NO: 6337 - protein, 146 aa, Unknown
  Sequence found in Organisms: Cucumis sativus, Cucurbita pepo, Cucumis melo, Citrullus lanatus
MTTRFKKNRKKRGHVSAGHGRIGKHRKHPGGRGNAGGMHHHRILFDKYHPGYFGKVGMRYFHKLRNKFYCPIVNVDKIWSLIPQEVKDKASKDNVPLVDVTQFGYFKVLGKGVLPENQPIVVKAKLVSKIAEKKIKEAGGAVVLTA

SEQ ID NO: 6338 - protein, 146 aa, Cucurbita pepo
MTTRFKRNRKKRGHVSAGHGRIGKHRKHPGGRGNAGGMHHHRILFDKYHPGYFGKVGMRYFHKLRNKFYCPIVNVDKLWSLVPQEVKDKASKDNVPLIDVTQFGYFKVLGKGGLPENQPVVVKAKLISKIAEKKIKENGGAVVLTA

SEQ ID NO: 6339 - protein, 146 aa, Euonymus alatus
MTTRLRKNRKKRGHVSAGHGRIGKHRKHPGGRGNAGGMHHHRILFDKYHPGYFGKVGMRYFHKLRNKFYCPIVNVDKLWSMVPQEVKDKATKDNVPIIDVTQFGYFKVLGKGVLPENKPFVVRAKLVSKIAEKKIKENGGAVVLTA

SEQ ID NO: 6340 - protein, 146 aa, Flaveria ramosissima
MTTRFRKNRKKRGHVSAGHGRIGKHRKHPGGRGNAGGMHHHRILFDKYHPGYFGKVGMRYFHKLRNKFYCPIVNVDKLWSMVPPEAKEKASVDNVPVVDVTQLGFFKVLGKGMVPPSQPLVVKAKLVSKTAEKKIKEAGGAVLLTA

SEQ ID NO: 6341 - protein, 146 aa, Guizotia abyssinica
MTTSLRKNRKKRGHVSAGHGRIGKHRKHPGGRGNAGGIHHHRILFDKYYPGYFGKVGMRYFRGLRNKFHCPTVNVDKLWSLVPEEAKAKVGGDKVPVIDVTQFGYFKVLGKGTVPPSHPIVVKAKLISKTAEKKIKEAGGAVVLTA

SEQ ID NO: 6342 - protein, 146 aa, Carpinus betulus
MTTRFKKNRKKRGHVSAGHGRIGKHRKHPGGRGNAGGMHHHRILFDKYHPGYFGKVGMRYFHRLRNKFHCPIVNVDKLWSLVPQEVKDKASKDNVPLLDVTQFGYFKVLGKGILPENQPFVVKAKLVSKTAEKKIKEAGGAVVLTA

SEQ ID NO: 6343 - protein, 146 aa, Orobanche aegyptiaca
MTTRFKKNRKKRGHVSAGHGRIGKHRKHPGGRGNAGGMHHHRILFDKYHPGYFGKVGMRYFHRLRNKFHCPTVNIDKIWSMVPQEVKDKATKDNAPLIDVTQFGYFKVLGKGLLPADKPVVVKAKLVSKNAEKKIKEAGGAVVLTA

SEQ ID NO: 6344 - protein, 146 aa, Carica papaya
MTTRFKKNRKKRGHVSAGHGRIGKHRKHPGGRGNAGGMHHHRILFDKYHPGYFGKVGMRYFHKLRNKYHCPIVNLDKLWSLVPEDVKAKATKDSAPLIDVTQFGYFKVLGKGVLPENQPVVVKAKLVSKTAEKKIKEAGGAVVLTA

SEQ ID NO: 6345 - protein, 147 aa, Arachis hypogaea
MTTRFKKNRKKRGHVSAGHGRIGKHRKHPGGRGNAGGMHHHRILFDKYHPGYFGKVGMRYFHKLRNKFHCPIVNIDKLWSLVPQEVKDKASKEKKAPLIDVTQHGYFKVLGKGVLPQDQPVVVKAKLISKVAEKKIKENGGAVLLTA

SEQ ID NO: 6346 - protein, 146 aa, Physcomitrella patens
MTTRLKKNRKKRGHVSAGHGRVGKHRKHPGGRGNAGGMHHHRILFDKYHPGYFGKVGMRYFHKTMNKFHCPIVNVDKLWSLVPEAVKEKADGDKSAPLLDVTQHGFFKVLGKGDLPTQPMVVKAKFFSKLAEKKIKEAGGAVVLTA

SEQ ID NO: 6347 - protein, 146 aa, Raphanus sativus
  misc_feature (42)..(42): Xaa can be any naturally occurring amino acid
MATGLKKNRKKRGHVSAGHGRIGKHRKHPGGRGNAGGMHHHXILFDKYHPGYFGKVGMRYFHKLRNKFYCPIVNLDKLWSLVPEDVKAKSTKDKVPLIDVTQHGFFKVLGKGHLPEGKPFVVKAKLISKTAEKKIKEAGGAVVLTA

SEQ ID NO: 6348 - protein, 146 aa, Raphanus sativus
MATALKKNRKKRGHVSAGHGRIGKHRKHPGGRGNAGGMHHHRILFDKYHPGYFGKVGMRYFHKLRNKFYSPIVNLDRLWSLVPEDVKAKATKDKVPMIDVTQHGFFKVLGKGHLPEGRPFVVKAKLISKTAEKKIKEAGGAVVLTA

SEQ ID NO: 6349 - protein, 146 aa, Raphanus sativus
  misc_feature (10)..(10): Xaa can be any naturally occurring amino acid
  misc_feature (59)..(59): Xaa can be any naturally occurring amino acid
MTTRLRKNRXKRGHVSAGHGRIGKHRKHPGGRGNAGGMHHHRILFDKYHPGYFGKVGMXYFHKLRNKFYCPIVNLDRLWSLVPEDVKAKSTKDKVPLIDVTQHGFFKVLGKGHLPENKPFVVKAKLISKTAEKKIKEAGGAVVLTA

SEQ ID NO: 6350 - protein, 146 aa, Rosa hybrid cultivar
MTTRFKKNRKKRGHVSAGHGRIGKHRKHPGGRGNAGGMHHHRILFDKYHPGYFGKVGMRYFHKLRNKFYCPIVNVDKLWSLVPQEAKDKATKDNVPLIDVTQHGYFKILGKGKLPVNQPVVVKAKLISKVAEKKIKEAGGAVVLTA

SEQ ID NO: 6351 - protein, 146 aa, Glycine max
MTTRFKKNRKKRGHVSAGHGRIGKHRKHPGGRGNAGGMHHHRILFDKYHPGFFGKVGMRYFHKLRNKFYCPIVNIDKLWSLLPQEAKDKATADKAPLLDVTQFGYFKVLGKGVLPQNQPLVVKAKLVSKIAEKKIKEAGGAVVLTA

SEQ ID NO: 6352 - protein, 146 aa, Fragaria vesca
MTTRFKKNRKKRGHVSAGHGRIGKHRKHPGGRGNAGGMHHHRILFDKYHPGYFGKVGMRYFHKLRNKFYCPIVNVDKLWSLVPQEAKDKATKDNVPLIDVTQHGYFKILGKGKLPVGHPVVVKAKLISKVAEKKIKEAGGAVVLTA

SEQ ID NO: 6353 - protein, 146 aa, Fragaria vesca
MTTRFKKNRKKRGHVSAGHGRIGKHRKHPGGRGNAGGMHHHRILFDKYHPGYFGKVGMRYFHKLRNKFYCPIVNVDKLWSLVPQEAKDKATKDNVPLIDVTQHGYFKILGKGKLPAGHPVVVKAKLISKVAEKKIKEAGGAVVLTA

SEQ ID NO: 6354 - protein, 146 aa, Tabernaemontana elegans
MTTRFKKNRKKRGHVSAGHGRIGKHRKHPGGRGNAGGMHHHRILFDKYHPGYFGKVGMRYFHKLRNKFYCPIVNIDKLWSMVPQDVKDKASKDNAPVIDVTQFGCLKVLGKGVLPENQPVVVKAKLVSKTAEKKIKEAGGAVVLTA

SEQ ID NO: 6355 - protein, 146 aa, Triphysaria pusilla
MTTRFKKNRKKRGHVSAGHGRIGKHRKHPGGRGNAGGMHHHRILFDKYHPGYFGKVGMRYFHRLRNKFHCPTVNIDTLWSMVPQEVKDKATKDNAPLIDVTQFGYFKVLGKGLLPADKPVVVKAKLVSRNAEKKIKEAGGAVVLTA

SEQ ID NO: 6356 - protein, 146 aa, Juglans hindsii x Juglans regia
MITRFKKNRKKRGHVSAGHGRIGKHRKHPGGRGNAGGMHHHRILFDKYHPGYFGKVGMRYFHKLRNKFYCPIVNVDKLWSLVPKDVKDKASKDKVPLIDVTQYGFFKVLGKGVLPENQPVVVKAKLVSKIAEKKIKEAGGAVVLTA

SEQ ID NO: 6357 - protein, 145 aa, Gnetum gnemon
MTTRLKKNRKKRGHVSAGHGRIGKHRKHPGGRGNAGGMHHHRILFDKYHPGYFGKVGMRHFHKLRNHYFCPTVNLDKLWSLVPEEVKAAAGSDKAPLIDVTQFGYFKVLGKGEAPAQPLVVKAKLVSKLAEKKIKEAGGAVVLAA

SEQ ID NO: 6358 - protein, 133 aa, Secale cereale
GHVSAGHGRVGKHRKHPGGRGNAGGMHHHRILFDKYHPGYFGKVGMRYFHKLSNRFYTPTINVERLWSMVPADKAAEAGGDKAPVVDVSQFGYFKVLGKGMLPEKPIVVKAKLISKIAEKKIKAAGGAVVLVA

SEQ ID NO: 6359 - protein, 145 aa, Tamarix hispida
MTTRFKKNRKKRGHVSAGHGRIGKHRKHPGGRGNAGGLHHHRILFDKYHPGYFGKVGMRYFHKLRNKFFCPTVNIDKLWSMVPEDVKSKATKDNVPMIDVTQFGYFKVLGKGVLPNQPVVVKAKLISKTAEKKIKENGGAVVLTA

SEQ ID NO: 6360 - protein, 149 aa, Euonymus alatus
MTTRLRKNRKKRGHVSAGHGRIGKHRKHPGGRGNAGGMHHHRILFDKYHPGYFGKVGMRYFHKLRNKFYCPSINVEKLWSMVPQDVKEKVKSSKDGNVPVIDVTQFGYFKVLGKGVLPENQPMVIKAKLISKIAEKKIKENGGAVVLTA

SEQ ID NO: 6361 - protein, 149 aa, Euonymus alatus
MTTRLRKNRKKRGHVSAGHGRIGKHRKHPGGRGNAGGMHHHRILFDKYHPGYFGKVGMRYFHKLRNKFYCPSINVEKLWSMVPQDVKEKVKSSKDGHVPVIDVTQFGYFKVLGKGVLPENQPMVIKAKLISKIAEKKIKENGGAVVLTA

SEQ ID NO: 6362 - protein, 149 aa, Capsicum annuum
MTTRFKKNRKKRGHVSAGHGRIGKHRKHPGGRGNAGGMHHHRILFDKYHPGYFGKVGMRYFHKLRNKFYCPTVNVDKLWSLIPQEVKDKAVANKGSAAPLIDVTQFGYFKVLGKGVLPTGQPVVVKAKLVSKNAEKKIKENGGAVVLTA

SEQ ID NO: 6363 - protein, 149 aa, Tripterygium wilfordii
MTTRLRKNRKKRGHVSAGHGRIGKHRKHPGGRGNAGGMHHHRILFDKYHPGYFGKVGMRYFHKLRNRFYCPSVNIDKLWSMVPQDVKEKVKSSKDGNVPVIDVTQFGYFKVLGKGVLPENQPIVVKAKLISKIAEKKIKENGGAVVLTA

SEQ ID NO: 6364 - protein, 148 aa, Cicer arietinum
MTTSLKKNRKKRGHVSAGHGRIGKHRKHPGGRGNAGGMHHHRILFDKYHPGYFGKVGMRYFHKLRNKFHCPTVNIDTLWSLLPQEVKDKASKSKETAPVIDVTQFGYFKVLGKGVLPKNQPVVVKAKLVSKIAEKKIKEAGGAVLLTA

SEQ ID NO: 6365 - protein, 146 aa, Elaeis guineensis
RFKKNRKKRGHVSAGHGRIGKHRKHPGGRGNAGGMHHHRILFDKYHPGYFGKVGMRYFHRLRNKFYCPTVNVDRLWSLVPDDVKEAAAAAASSSAPMIDVTQFGYFKVLGKGMMPPSFPVVVKAKLVSKIAEKKIKAAGGAVVLTA

SEQ ID NO: 6366 - protein, 148 aa, Ipomoea nil
MTTRFKKNRKKRGHVSAGHGRIGKHRKHPGGRGNAGGMHHHRILFDKYHPGYFGKVGMRYFHKLRNKFFCPTVNIDKIWSLLPPEVQEKAAKNKDSAPLIDVTQFGYFKVLGKGVLPPSQPVVVKAKLISKIAEKKIKEAGGAVVLTA

SEQ ID NO: 6367 - protein, 148 aa, Glycine max
MTTRFKKNRKKRGHVSAGHGRIGKHRKHPGGRGNAGGMHHHRILFDKYHPGFFGKVGMRYFHKLRNKFYSPIVNIDKLWSLIPQDAKDKALKSKDTAPLIDVTQHGYFKVLGKGVLPQNQPIVVKAKLISKIAEKKIKEAGGAVLLTA

SEQ ID NO: 6368 - protein, 146 aa, Glycine max
MTTRFKKNRKKRGHVSAGHGRIGKHRKHPGGRGNAGGMHHHRILFDKYHPGFFGKVGMRYFHKLRNKFYNPIINIDKLWSLLPQEAKDKATADKAPLLDVTQFGYFKVLGKGVLPQNQPLVVKAKLISKIAEKKIKEAGGAVVLTA

SEQ ID NO: 6369 - protein, 146 aa, Ambrosia trifida
MTTSLRKNRKKRGHVSAGHGRIGKHRKHPGGRGNAGGMHHHRILFDKYHPGFFGKVGMRYFHKLRNKFYCPIVNVDRLWSLVPQEVKDKATADKVPVIDVSQHGYFKVLGKGNVPASHPFVVKAKLVSKTAEKKIKEAGGSVLLTA

SEQ ID NO: 6370 - protein, 146 aa, Arabidopsis lyrata
MATALKKNRKKRGHVSAGHGRIGKHRKHPGGRGNAGGMHHHRILFDKYHPGYFGKVGMRYFHKLRNKFFCPIVNLDKLWSLVPEDVKAKSSKDNVPLIDVTQHGFFKVLGKGHLPENKPFVVKAKLISKTAEKKIKEAGGAVVLTA

SEQ ID NO: 6371 - protein, 146 aa, Unknown [sequence omitted]

SEQ ID NO: 6372 - protein, 146 aa, Arabidopsis thaliana
MATALKKNRKKRGHVSAGHGRIGKHRKHPGGRGNAGGMHHHRILFDKYHPGYFGKVGMRYFHKLRNKFFCPIVNLDKLWSLVPEDVKAKSSKDNIPLIDVTQHGFFKVLGKGHLPENKPFVVKAKLISKTAEKKIKEAGGAVVLTA

SEQ ID NO: 6373 - protein, 146 aa, Aristolochia fimbriata
MTTRFKKNRKKRGHVSAGHGRIGKHRKHPGGRGNAGGMHHHRILFDKYHPGYFGKVGMRYFHKLRNKFYCPVVNIDRLYSLLPEDVKAKADSDKVPLIDLTQFGYFKLLGKGVLPQGKPVVVKTKLVSKIAEKKIKQAGGAVMLTA

SEQ ID NO: 6374 - protein, 146 aa, Aristolochia fimbriata
MTTRFKKNRKKRGHVSAGHGRIGKHRKHPGGRGNAGGMHHHRILFDKYHPGYFGKVGMRYFHKLRNKFYCPVVNIDRLYSLLPDDVKAKADADKVPMIDLTQFGYFKLLGKGVLPQGKPVVVKTKLVSKIAEKKIKKAGGAVLLTA

SEQ ID NO: 6375 - protein, 146 aa, Arnica chamissonis
MTTRLRKNRKKRGHVSAGHGRIGKHRKHPGGRGNAGGMHHHRILFDKYHPGYFGKVGMRYFHRLRNKFYCPIVNVDKLWSMVPQEAKDSASADKVPVVDVTQLGYFKVLGKGTVPLSHPLVVKTKLISKTAEKKIKEAGGAVLLTA

SEQ ID NO: 6376 - protein, 146 aa, Brassica juncea
MATALKKNRKKRGHVSAGHGRIGKHRKHPGGRGNAGGMHHHRILFDKYHPGYFGKVGMRYFHKLRNKFFCPIVNLDKLWSLVPEDVKAKATKDNVPVIDVTQHGFFKVLGKGHLPENKPFVVKAKLISKTAEKKIKEAGGAVVLTA

SEQ ID NO: 6377 - protein, 146 aa, Brassica rapa
MATALKKNRKKRGHVSAGHGRIGKHRKHPGGRGNAGVMHHHRILFDKYHPGYFGKVGMRYFHKLRNKFYCPIVNLDKLWSLVPEDVKAKSTKDKVPMIDVTQHGFFKVLGKGHLPEGKPFVVKAKLISKTAEKKIKEAGGAVVLTA

SEQ ID NO: 6378 - protein, 146 aa, Brassica rapa
MTTRFKKNRKKGGHVSAGHGRIGKHRKHPGGRGNAGGMHHLRILFDKYHPGYFGKVGIRYFHKLRNKFFCPIVNLDRLWSLVPEDVKAKATKDKVPLIDVTQHGFFKVLGKGHLPENKPFVVKAKLISKTAEKKIKEAGGAVVLTA

SEQ ID NO: 6379 - protein, 146 aa, Fagus grandifolia
MTTRFKKNRKKRGHVSAGHGRIGKHRKHPGGRGNAGGMHHHRILFDKYHPGFFGKVGMRYFHKLRNKFHCPIVNLDKLWSLVPQQVKDKASNDNAPLIDVTQFGYFKVLGKGVLPQNQPIVVKAKLVSKTAEKKIKEAGGSVVLTA

SEQ ID NO: 6380 - protein, 146 aa, Vaccinium corymbosum
MTTRFKKNRKKRGHVSAGHGRIGKHRKHPGGRGNAGGMHHHRILFDKYHPGYFGKVGMRYFHKLRNKFYCPIVNVDKLWSLVPQEVKDKATPHNLPMIDVTQFGYFKVLGKGVLPASHPVVVKAKLVSKNAEKKIKEAGGAVVLTA

SEQ ID NO: 6381 - protein, 146 aa, Cannabis sativa
MTTRFKKNRKKRGHVSAGHGRVGKHRKHPGGRGNAGGMHHHRILFDKYHPGYFGKVGMRYFHKLRNKFYCPIVNIDKLWSMVPQEIKDKSTKDNVPLIDVSQFGYFKVLGKGTLPEDKPFVVKAKLISKIAEKKIKQAGGAVVLTA

SEQ ID NO: 6382 - protein, 146 aa, Manihot esculenta
MTTRFKKNRKKRGHVSAGHGRIGKHRKHPGGRGNAGGMHHHRILFDKYHPGYFGKVGMRYFHKLRNKFYCPIVNIDKLWSMIPQEAKDKSSKDNVPLVDVTQFGYFKVLGKGALPENQPIVVKAKLVSKIAEKKIKEAGGAVVLTA

SEQ ID NO: 6383 - protein, 146 aa, Unknown
  Sequence found in Organisms: Centaurea maculosa, Cirsium arvense
MTTRLRKNRKKRGHVSAGHGRIGKHRKHPGGRGNAGGMHHHRILFDKYHPGYFGKVGMRYFHRLRNKFHCPIVNVDKLWSMVPQDVKEKSSADKVPVVDVTQLGYFKVLGKGAVPLTHPMVVKAKLISKTAEKKIKEAGGCVVLTA

SEQ ID NO: 6384 - protein, 146 aa, Flaveria ramosissima
MTTRFRKNRKKRGHVSAGHGRIGKHRKHPGGRGNAGGMHHHRILFDKYHPGYFGKVGMRYFHRLRNKFYCPIVNVDKLWSMVPPEAKEKATVDNVPVVDVTQLGFFKVLGKGMVPPSQPLVVKAKLVSKTAEKKIKEAGGAVLLTA

SEQ ID NO: 6385 - protein, 146 aa, Vitis vinifera
MTTRFKKHRKKRGHVSAGHGRIGKHRKHPGGRGNAGGMHHHRILFDKYHPGYFGKVGMRYFHKLRNKFFCPIVNVDKLWSLIPQEVKAKASPENAPMIDVTQFGYVKVLGKGFLPESQPIVVKAKLISKVAEKKIKEAGGAVVLTA

SEQ ID NO: 6386 - protein, 146 aa, Actinidia deliciosa
MTTRFRKNRKKRGHVSAGHGRIGKHRKHPGGRGNAGGMHHHRILFDKYHPGYFGKVGMRYFHKLRNKFYCPIVNVDKLWSLVPQEVKDKASPSSAPVIDVTQFGYFKVLGKGVIPSAQPIVVKAKLVSKTAEKKIKEAGGAVVLTA

SEQ ID NO: 6387 - protein, 146 aa, Citrus sinensis
MTTRFKKNRKKRGHVSAGHGRIGKHRKHPGGRGNAGGMHHHRILFDKYHPGFFGKVGMRYFHKLRNKFHCPIVNIDKLWSMVPQDVKAKASKDNVPMIDVTQFGYFKVLGKGVLPENQPVVVKAKLVSKTAEKKIKEAGGAVVLTA

SEQ ID NO: 6388 - protein, 145 aa, Orobanche aegyptiaca
MTTRFKKNRKKRGHVSAGHGRIGKHRKHPGGRGNAGGMHHHRILFDKYHPGYFGKVGMRYFHRLRNKFHCPTVNIDKIWSMVPQEVKDKATKDNAPLIDVTQFGYFKVLGKGLLPADKPVVVKAKLVSKNAEKKIKEAGGAVVLT

SEQ ID NO: 6389 - protein, 147 aa, Arachis hypogaea
MTTRLKKNRKKRGHVSAGHGRIGKHRKHPGGRGNAGGMHHHRILFDKYHPGYFGKVGMRYFNKHRNKFYCPTVNIDQLWSLVPQEVKDKASQEKKAPLIDVTQNGYFKVLGKGVLPHNQPVVVKAKLISKLAEKKIKDNGGAVLLTA

SEQ ID NO: 6390 - protein, 147 aa, Arachis hypogaea
MTTRLKKNRKKRGHVSAGHGRIGKHRKHPGGRGNAGGMHHHRILFDKYHPGYFGKVGMRYFNKHRNKFYCPTVNIDQLWSLVPQEVKDKASEEKKAPLIDVTQNGYFKVLGKGVLPQNQPVVVKAKLISKLAEKKIKENGGAVLLTA

SEQ ID NO: 6391 - protein, 146 aa, Prunus persica
MTTRFKKNRKKRGHVSAGHGRIGKHRKHPGGRGNAGGMHHHRILFDKYHPGYFGKVGMRYFHKLRNKFYCPIVNVDKLWSLLPQEAKDKATKDSAPLIDVTQYGFFKVLGKGALPQNQPVVVKAKLISKTAEKKIKEAGGAVVLTA

SEQ ID NO: 6392 - protein, 146 aa, Helianthus annuus
MTTRLRKNRKKRGHVSAGHGRIGKHRKHPGGRGNAGGMHHHRILFDKYHPGFFGKVGMRYFHRLRNKFHCPIVNVDKIWSMVPQDVKDKSSTDKVPVIDVTQFGYFKVLGKGTVPASQPIVVKAKLISKTAEKKIKEAGGAVVLTA

SEQ ID NO: 6393 - protein, 146 aa, Eutrema halophilum
MATALKKNRKKRGHVSAGHGRIGKHRKHPGGRGNAGGMHHHRILFDKYHPGYFGKVGMRYFHKLRNKFFCPIVNLDKLWSLVPEDVKAKSTKDNVPLIDVTQHGFFKVLGKGHLPENKPFVVKAKLISKTAEKKIKEAGGAVVLTA

SEQ ID NO: 6394 - protein, 146 aa, Eutrema parvulum
MTTRFKKNRKKRGHVSAGHGRIGKHRKHPGGRGNAGGMHHHRILFDKYHPGYFGKVGMRYFHKLRNKFFCPIVNLDRLWSLVPEDVKAKSTKDNVPMIDVTQHGFFKVLGKGHLPENKPFVVKAKLISKTAEKKIKEAGGAVVLTA

SEQ ID NO: 6395 - protein, 146 aa, Eutrema parvulum
MATALKKNRKKRGHVSAGHGRIGKHRKHPGGRGNAGGMHHHRILFDKYHPGYFGKVGMRYFHKLRNKFFCPIVNLDRLWSLVPEDVKAKSTKDTVPMIDVTQHGFFKVLGKGHLPENKPFVVKAKLISKTAEKKIKEAGGAVVLTA

SEQ ID NO: 6396 - protein, 146 aa, Triphysaria pusilla
MTTRFKKNRKKRGHVSAGHGRIGKHRKHPGGRGNAGGMHHHRILFDKYHPGYFGKVGMRYFHRLRNKFHCPTVNIDTLWSMVPQEVKDKATKDNAPVIDVTQFGYFKVLGKGLLPADKPVVVKAKLVSRNAEKKIKEAGGAVVLTA

SEQ ID NO: 6397 - protein, 140 aa, Valeriana officinalis
NRKKRGHVSAGHGRIGKHRKHPGGRGNAGGMHHHRILFDKYHPGYFGKVGMRYFHKLRNKFHCPIVNIDKLWSMVPQDVKESAATSGKAPLLDVTQFGYFKVLGKGMLPLSQPIVVKAKLVSKTAERKIKEAGGAVVLTA

SEQ ID NO: 6398 - protein, 57 aa, Raphanus sativus
MATGLKKNRKKRGHVSAGHGRIGKHRKHPGGRGNAGGMLTTASSSTSTIPVTSGRSV

SEQ ID NO: 6399 - protein, 127 aa, Picea glauca
MTTRLKKNRKKRGHVSAGHGRIGKHRKHPGGRGNAGGMHHHRILFDKYHPGYFGKVGMRHFHKLRNHYHCPIVNIEKLWSLVPEDVKAKATADSVPLIDVTQFGYFKVLGKRRATLAAYRSQGQAYF

SEQ ID NO: 6400 - protein, 145 aa, Fagopyrum esculentum
MTTGLKKNRKKRGHVSAGHGRIGKHRKHPGGRGNAGGMHHHRILFDKYHPGYFGKVGMRYFHKLRNKFFCPKINIDQLWSLVPEDVKTKSNKDNAPLIDVTQFGYFKVLGKGVLPNQPLVVKAKLVSKIAEKKIKENGGSVILTA

SEQ ID NO: 6401 - protein, 144 aa, Adiantum capillus-veneris
MTTRLKKNRKKRGHVSAGHGRVGKHRKHPGGRGNAGGMHHHRILFDKYHPGYFGKVGMRYFHKTMNRFHCPIVNVDRLFSLLPDSAKSAPEGKGPLLDVTQFGYFKVLGKGDAPPTPLVVKAKFFSKLAEKKIKEAGGAVLLTA

SEQ ID NO: 6402 - protein, 146 aa, Marchantia polymorpha
MTTRLKKNRKKRGHVSAGHGRVGKHRKHPGGRGNAGGMHHHRILFDKWHPGYFGKVGMRYFHKTMNKFHCPIVNVDKLWSLVPEDIKAKANGDSAAPLLDVTQHGYFKVLGKGGLPTQPMVVKAKFFSKLAEKKIKDAGGAVILTA

SEQ ID NO: 6403 - protein, 146 aa, Marchantia polymorpha
MTTRLKKNRKKRGHVSAGHGRVGKHRKHPGGRGNAGGMHHHRILFDKWHPGYFGKVGMRYFHKTMNKFHCPIVNVDKLWSLVPEDVKAKANGESAAPLLDVTQHGYFKVLGKGGLPTQPMVVKAKFFSKLAEKKIKDAGGAVILTA

SEQ ID NO: 6404 - protein, 145 aa, Taxus baccata
MTTRLKKHRKKRGHVSAGHGRIGKHRKHPGGRGNAGGMHHHRILFDKYHPGYFGKVGMRHFHKLKNHYFCPIINIDKLWSLVPEDVKEKATPDNVPLLDVTHHGYFKVLGKGELPPQPLVVKAKLISKLAEKKIKEAGGAVLLTA

SEQ ID NO: 6405 - protein, 150 aa, Unknown
  Sequence found in Organisms: Curcuma longa, Zingiber officinale
MTTRFKKNRKKRGHVSAGHGRIGKHRKHPGGRGNAGGMHHHRILFDKYHPGYFGKVGMRYFHRLRNKFHCPIVNIDSLWSLVPEGVKDEASKSGSGPNAPLIDVTQFGYFKVLGKGALPPGRPIVVKAKLVSKIAEKKIKAAGGAVVLTA

SEQ ID NO: 6406 - protein, 148 aa, Trifolium pratense
  misc_feature (12)..(12): Xaa can be any naturally occurring amino acid
MTTRFKKNRKKXGHVSAGHGRIGKHRKHPGGRGNAGGMHHHRILFDKYHPGYFGKVGMRYFHKLRNKFYSPIVNIDKLWSLVPEDVKEKAAKSKSTAPVLDVTQHGFFKVLGKGVLPTNQPLVVKAKLISKIAEKKIKEAGGAVILTA

SEQ ID NO: 6407 - protein, 147 aa, Vaccinium corymbosum
MTTRFKKNRKKRGHVSAGHGRIGKHRKHPGGRGNAGGMHHHRILFDKYHPGYFGKVGMRYFHRLRNKFHCPIVNVDKLWSLIPQEVKDQATPDKAPIIDVTQFGYFKVLGKGVLAKSGQPVVVKAKLVSKAAEKKIKEAGGAVLLTA

SEQ ID NO: 6408 - protein, 148 aa, Unknown
  Sequence found in Organisms: Solanum lycopersicum, Solanum melongena
MTTRFKKNRKKRGHVSAGHGRIGKHRKHPGGRGNAGGMHHHRILFDKYHPGYFGKVGMRYFHKLRNKFYCPTVNIDTLWSLLPQEVKDKAAANKGTAPLIDVTQFGYFKVLGKGVLPTGQPVVVKAKLVSKNAEKKIKENGGAVVLTA

SEQ ID NO: 6409 - protein, 148 aa, Ipomoea batatas
MTTRFKKNRKKRGHVSAGHGRIGKHRKHPGGRGNAGGMHHHRILFDKYHPGYFGKVGMRYFHKLRNKFFCPTVNIDKIWSLLPPEVQEKAAKSKDTAPVIDVTQFGYFKVLGKGVLPPSQPVVVKAKLISKIAEKKIKEAGGAVVLTA

SEQ ID NO: 6410 - protein, 148 aa, Cajanus cajan
MTTRFKKNRKKRGHVSAGHGRIGKHRKHPGGRGNAGGMHHHRILFDKYHPGYFGKVGMRYFHKLRNKFHCPIVNIDKLWSLLPQEAKDKALKSKDAAPLIDVTQHGYFKVLGKGVLPLNQPIVVKAKLVSKIAEKKIKEAGGAVLLTA

SEQ ID NO: 6411 - protein, 148 aa, Cajanus cajan
MTTRLRKNRKKRGHVSAGHGRIGKHRKHPGGRGNAGGMHHHRILFDKYHPGYFGKVGMRYFHKLRNKFHCPILNIDKLWSLVPQHVKDSASTDGSKTPLIDVTQFGYFKVLGKGLLPHNQPLVVKAKLVSKIAEKKIKEAGGAVLLTA

SEQ ID NO: 6412 - protein, 146 aa, Olea europaea
MTTRFRKNRKKRGHVSAGHGRIGKHRKHPSGRGNAGGMHHHRILFDKYHPGYFGKVGMRYFHKLRNKFHCPIVNIDKLWSMVPKEAKDAASKEKVPVIDVTQFGYFKVLGKGVLPENQPVVVKAKLVSKIAEKKIKEAGGAVLLTA

SEQ ID NO: 6413 - protein, 146 aa, Arnica chamissonis
MTTRLRKNRKKRGHVSAGHGRIGKHRKHPGGRGNAGGMHHHRILFDKYHPGYFGKVGMRYFHRLRNKFYCPIVNVDKLWSLVPQEAKDSASADKVPVVDVTQLGYFKVLGKGTVPLSHPLVVKTKLISKTAEKKIKEAGGAVLLTA

SEQ ID NO: 6414 - protein, 146 aa, Fagus grandifolia
MTTRFKKNRKKRGHVSAGHGRIGKHRKHPGGRGNAGGMHHHRILFDKYHPGFFGKVGMRYFHKLRNKFYCPIVNVDKLWSLIPNEVKDKATKDNAPLIDVTQFGYFKVLGKGVLPENQPFVVKAKTVSKIAERKIKEAGGAVVLTA

SEQ ID NO: 6415 - protein, 146 aa, Manihot esculenta
MTTRFKKNRKKRGHVSAGHGRIGKHRKHPGGRGNAGGMHHHRILFDKYHPGYFGKVGMRYFHKLRNKFYCPIVNIDKLWSLIPQEVKDKASKDNVPIIDVTQHGYFKVLGKGALPENKPIVVKAKLVSKIAEKKIKENGGAVVLTA

SEQ ID NO: 6416 - protein, 146 aa, Ceratodon purpureus
MTTRLKKNRKKRGHVSAGHGRVGKHRKHPGGRGNAGGMHHHRILFDKYHPGYFGKVGMRYFHKTMNKFHCPIVNIDKLWSLVPEAVKEKVDGDKSAPLLDVTQHGFFKVLGKGDLPTQPMVVKAKFFSKLAEKKIKEAGGAVILTA

SEQ ID NO: 6417 - protein, 146 aa, Ceratodon purpureus
MTTRLKKNRKKRGHVSAGHGRVGKHRKHPGGRGNAGGMHHHRILFDKYHPGYFGKVGMRYFHKTMNKFHCPIVNIDKLWSLVPEAVKEQTDGAKSAPLLDVTQHGYFKVLGKGDLPTQPMVVKAKFFSKLAEKKIKEAGGAVILTA

SEQ ID NO: 6418 - protein, 144 aa, Cleome spinosa
TRFKKNRKKRGHVSAGHGRIGKHRKHPGGRGNAGGMHHHRILFDKYHPGYFGKVGMRYFHKLRNKFYCPIVNLDKLWALVPQEVKDKASKDNVPLIDVTQFGYFKVLGKGVLPDNMPVVVKAKLISKNAEKKIKEAGGAVILTA

SEQ ID NO: 6419 - protein, 146 aa, Unknown
  Sequence found in Organisms: Gossypium hirsutum, Gossypium raimondii
MTTRFKKNRKKRGHVSAGHGRIGKHRKHPGGRGNAGGMHHHRILFDKYHPGYFGKVGMRYFHRLRNKFHCPIVNIDKLWSLIPEDVKAKATKDAAPMIDVTQFGYFKVLGKGVLPENQPVVVKAKLVSKTAEKKIKEAGGAVVLTA

SEQ ID NO: 6420 - protein, 146 aa, Hevea brasiliensis
MTTRFKKNRKKRGHVSAGHGRIGKHRKHPGGRGNAGGMHHHRILFDKYHPGYFGKVGMRYFHKLRNKFYCPIVNIDKLWSLIPQEVKDKASKDNVPMIDVTQYGYFKVLGKGALPENKPIVVKAKLVSKIAEKKIKENGGAVVLTA

SEQ ID NO: 6421 - protein, 146 aa, Humulus lupulus
MTTRFKKNRKKRGHVSAGHGRVGKHRKHPGGRGNAGGMHHHRILFDKYHPGYFGKVGMRYFHKLRNKFYCPIVNIDKLWSMVPQEIKDKATKDNVPMIDVSQFGYFKVLGKGTLPEDRPFVVKAKLISKIAEKKIKEAGGAVVLTA

SEQ ID NO: 6422 - protein, 146 aa, Lotus japonicus
MTTRFKKNRKKRGHVSAGHGRIGKHRKHPGGRGNAGGMHHHRILFDKYHPGYFGKVGMRYFHKLRNQFHCPIVNIEKLWSLLPQDVKDKASKDAAPVVDVTQYGYFKVLGKGVLPSNQPLVVKAKLVSKIAEKKIKEAGGAVVLTA

SEQ ID NO: 6423 - protein, 146 aa, Physcomitrella patens
MTTRLKKNRKKRGHVSAGHGRVGKHRKHPGGRGNAGGMHHHRILFDKYHPGYFGKVGMRYFHKTMNKFHCPIVNIDKLWSLVPEAVKENADGEKSAPLLDVTQHGFFKVLGKGDLPAQPMVVKAKFFSKLAEKKIKEAGGAVILTA

SEQ ID NO: 6424 - protein, 146 aa, Physcomitrella patens
MTTRLKKNRKKRGHVSAGHGRVGKHRKHPGGRGNAGGMHHHRILFDKYHPGYFGKVGMRYFHKTMNKFHCPIVNIDKLWSLVPEAVKEKADGDMSAPLLDVTQHGFFKVLGKGDLPSQPMVVKAKFFSKLAEKKIKVAGGAVILTA

SEQ ID NO: 6425 - protein, 146 aa, Physcomitrella patens
MTTRLKKNRKKRGHVSAGHGRVGKHRKHPGGRGNAGGLHHHRILFDKYHPGYFGKVGMRYFHKTMNKFHCPIVNVDKLWSLVPEAVKEKTDGDKCAPLLDVTQHGFFKVLGKGDLPTQPMVVKAKFFSKLAEKKIKEAGGAVILTA

SEQ ID NO: 6426 - protein, 146 aa, Physcomitrella patens
MTTRLKKNRKKRGHVSAGHGRVGKHRKHPGGRGNAGGMHHHRILFDKYHPGYFGKVGMRYFHKTMNKFHCPIVNIDKLWSLVPEAVKEKADGEKSAPLLDVTQHGFFKVLGKGDLPSQPMVVKAKFFSKLAEKKIKEAGGAVILTA

SEQ ID NO: 6427 - protein, 147 aa, Glycine max
MTTRFKKNRKKRGHVSAGHGRIGKHRKHPGGRGNAGGMHHHRILFDKYHPGFFGKVGMRYFHKLRNKFYSPILNIDKLWSLVPQEVKDKASKENKAPLIDVTQFGYFKVLGKGVLPQNQPVVVKAKLISKIAEKKIKEAGGAVVLTA

SEQ ID NO: 6428 - protein, 146 aa, Camellia sinensis
MTTRLKKHRKKRGHVSAGHGRIGKHRKHPGGRGNAGGMHHHRILFDKYHPGYFGKVGMRYFHRLRNKFYCPIVNIDKLWSLVPQEIMAKASPTNAPMIDVTQFGYFKVLGKGVLPQSMPIVVKAKIVSKTAEKKIKEAGGAVVLTA

SEQ ID NO: 6429 - protein, 146 aa, Triphysaria pusilla
MTTRFKKNRKKRGHVSAGHGRIGKHRKHPGGRGNVGGMHHHRILFDKYLPGYFGKVGMRYFHRLRNKFHCPTVNIDTLWSMVPQEVKDKATKDNAPLIDVTQFGYFKVLGKGLLPADKPVVVKAKLVSRNAEKKIKEAGGAVVLTA

SEQ ID NO: 6430 - protein, 146 aa, Valeriana officinalis
MTTRLKKNRKKRGHVSAGHGRIGKHRKHPGGRGNAGGMHHHRILFDKYHPGYFGKVGMRYFHKLRNKFHCPIVNIDKLWSLLPQEAKDKATADNVPLIDVTQHGYFKVLGKGMLPISQPVVVKAKFVSKTAEKKIKEAGGAVLLTA

SEQ ID NO: 6431 - protein, 163 aa, Tropaeolum majus
MTTRFKKNRKKRGHVSAGHGRIGKHRKHPGGRGNAGGMHHHRILFDKYHPGYFGKVGMRYFHKLRNKFHCPIVNLDKLWSLVPQEAKDKANKDSAPVIDVTQFGYFKVLGKGVLPSDQPVVVKAKLISRSRRRRSRRLVALLFSLLRSFFISIIVISHRLSHF

SEQ ID NO: 6432 - protein, 119 aa, Thalictrum flavum
TRFKKNRKKRGHVSAGHGRIGKHRKHPGGRGNAGGMHHHRILFDKYHPGYFGKVGMRYFHKLRNKFYCPTVNIDKLWSLVPQEIKDKASADNAPLIDVTQLGFFKVLVRYVASFSTCCC

SEQ ID NO: 6433 - protein, 121 aa, Triticum aestivum
MATALKKNRKKRGHVSAGHGRIGKHRKHPGGRGNAGGMHHHRILFDKYHPGYFGKVGMRYFHKLRNKFYCPIVNLDKLWSLVPEDVKAKSTKDKVPMIDVTQHGFLRFLEKVICLRASLSL

SEQ ID NO: 6434 - protein, 146 aa, Amborella trichopoda
MTTRFKKNRKKRGHVSAGHGRIGKHRKHPGGRGNAGGLHHHRILMDKYHPGYFGKVGMRYFHKLRNKFYCPIVNVDKLWSLLPEEAKKSAGSGSEAPLLDVTKYGYFKVLGKGEVPNQPLVVKAKLISKRAEKKIKEAGGAVMLTA

SEQ ID NO: 6435 - protein, 150 aa, Coffea canephora
MTTRFKKTRKSRGHVSAGHGRIGKHRKHPGGRGNAGGMHHHRILFDKYHPGYFGKVGMRYFHKLRNKFHCPIVNIDKLWSLVPSDLKEKAVSEGKSGKAPLIDVTQFGYFKVLGKGVLPENQPVVVKAKLVSKTAEKKIKEAGGAVLLTA

SEQ ID NO: 6436 - protein, 145 aa, Fagopyrum esculentum
MTTGLKKNRKKRGHVSAGHGRIGKHRKHPGGRGNAGGMHHHRILFDKYHPGYFGKVGMRYFHKLRNKFFCPKINIDQLWSLVPEDVKAKSNKDNAPLIDVTQFGYFKVLGKGVLPNQPLVIKAKLVSKIAEKKIKENGGSVILTA

SEQ ID NO: 6437 - protein, 144 aa, Adiantum capillus-veneris
MTTRLKKNRKKRGHVSAGHGRVGKHRKHPGGRGNAGGMHHHRILFDKYHPGYFGKVGMRYFHRTMNKFHCPIVNVDRLFSLLPESAKSAPEGKGPLLDVTQFGYFKVLGKGDAPPTPLVVKAKFFSKLAEKKIKEAGGAVLLTA

SEQ ID NO: 6438 - protein, 145 aa, Zamia vazquezii
  misc_feature (92)..(92): Xaa can be any naturally occurring amino acid
MTTRLKKNRKKRGHVSAGHGRIGKHRKHPGGRGNAGGLHHHRILFDKFHPGYFGKVGMRHFHKLRNHYFCPIVNVDKLWSLVPEGVKAKATXDNVPLLDVTQFGYFKVLGKGELPSQPLVVKAKLVSKLAEKKIKEAGGAVVLTA

SEQ ID NO: 6439 - protein, 148 aa, Lotus japonicus
MTTRFKKNRKKRGHVSAGHGRIGKHRKHPGGRGNAGGMHHHRILFDKYHPGYFGKVGMRYFHKLRNQFHCPIVNVEKLWSLLPQEAKDKAAKSKGTAPVVDVTQYGFFKVLGKGVLPENQPLVVKAKLISKIAEKKIKEAGGAVLLTA

SEQ ID NO: 6440 - protein, 473 aa, Panicum virgatum
MDAGSHSISSEKSRAAAAPPPPLQEAGSRPYMPSLSSGSRNPSAKCYGDRFIPDRSAMDMDMAHYLLTEPRKDKENAAGVAASPSKEAYRRLLAEKLLNNRTRILAFRNKPPEPENVSCAEAASNLQAKPAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGVHEARVGSLAWNNSILTTGSMDGKIVNNDVRIRNHVVQTYEGHSQEVCGLKWSGSGQQLASGGNDNLLHIWDASMASSMPSAGRNQWLHRLEDHMAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 6441 - protein, 474 aa, Panicum virgatum
MDAGSHSISSEKSRAAAAPPPPLQEAGSHPYMPSLSTGSRNPSAKCYGDRFIPDRSAMDMDMAHYLLTEPRKDKENAAGVAASPSKEAYRRLLAEKLLNNRTRILAFRNKPPEPENVSFAEAASSNLQAKAAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGVHEARVGSLAWNNSILTTGSMDGKIVNNDVRIRNHVVQTYEGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 6442 - protein, 471 aa, Sorghum bicolor
MDAGSHSISSEKSRAAAAPRPPLQEAVSRPYMPSLGSGCRNPSAKCYGDRFIPDRSAMDMDMAHFLLTEPRKDKENAAASPSKEAYRRLLAEKLLNNRTRILAFRNKPPEPENVSFADAASSNLQAKPAKQRRHIPQSAERTLDAPELVDDYYLNLLDWGSNNVLSIALGDTLYLWDASSGSTSELVTIDEDSGPITSVSWAPDGRHIAVGLNSSDVQLWDTSSNRLLRTLRGVHEARVGSLAWNNSILTTGGMDGKIVNNDVRIRDHVVQTYEGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 6443 - protein, 473 aa, Panicum virgatum
MDAGSHPISSEKSRVAAPRPPLQEAGSHPYMPSLSMGSRNPSAKCYGDRFIPDRSAMDMDMAHYLLTEPRKDKENAAGVAASPSKEAYRRLLAEKLLNNRTRILAFRNKPPEPENVSFAEAASSNLQAKAAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGVHEARVGSLAWNNSILTTGSMDGKIVNNDVRIRNHVVQTYEGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEVPKPAAKASHTGMFNSFNHIR

SEQ ID NO: 6444 - protein, 470 aa, Setaria italica
MDVGSRSISSVKSRAAAAPRPPLQEAGSRPYMPPLSSGSRNPSAKCYGDRFIPDRSAMDMDMAHYLLTEPKKDKENAAASPSKEAYRRLLAEKLLNNRTRILAFRNKPPEPENVTGADAASSHHAKPAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGMHEARVGSLAWNNSILTTGSMDGKIVNNDVRIRNHVVQTYEGHSQEVCGLKWSGSGQQLASGGNDNLLHIWDVSMASSMPSAGRNQWLHRLDDHMAAVKALAWCPFQSNLLATGGGGSDRCIKFWNTHTGACLNSVDTGSQVCALLWNKNERELLSSHGFTHNQLTLWKYPSMVKMAELTGHTSRVLFMAQSPDGCTVASAAADETLRFWNVFGAPEAPKPAAKASHTGMFNSFNHIR

SEQ ID NO: 6445 - protein, 473 aa, Setaria italica
MDAGSLSISSEKSRAAAPRPPLQEAGSRPYMPSLSTGSRNPSAKCYGDRFIPDRSAMDMDMAHYLLTEPKKDKENAAGVVASPSKEAYRRLLAEKLLNNRTRILAFRNKPPEPENVSFADAASSNLQAKPAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGVHEGRVGSLAWNNSILTTGSMDGNIVNNDVRIRNHVVQTYEGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCALLWNKNERELLSSHGFTQNQLTLWKYPSMVKTAELTGHTSRVLFMAQSPDGCTVASAAADETLRFWNVFGAPEAPKPAAKASYTGMFNSFNHIR

SEQ ID NO: 6446 - protein, 473 aa, Pennisetum glaucum
MDAGSHSISSEKSRAAAPRPPLQEACSRPYMPSLSTGSRNPSAKCYGDRFIPDRSAMDMDMAHYLLTEPKKDKENAVGVVASPSKEAYRRLLAEKLLNNRTRILAFRNKPPEPENISFADAASSNLQAKPAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGVHEARVGSLAWNNSILTTGSMDGKIVNNDVRIRNHVVQTYEGHSQEVCGLKWSGSGQQLASGGNDNLLHIWDVSMASSVPSAGRNQWLHRLEDHMAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 6447 - protein, 470 aa, Saccharum officinarum
MDAGSHSISSEKSRAVAPRPPLQEAVSRPYMPSLGSGCRNPSAKCYGDRFIPDRSAMDMDMAHYLLTEPKKDKENVAASPSKEVYRRLLAEKLLNNRTRILAFRNKPPEPENVSFADAASSNLQAKPAKQRRHIPQSAERTLDAPELGDDYYLNLLDWGSNNVLSIALGDTLYLWDASSGSTSELVTIDEDSGPITSVSWAPDGRHIAVGLNSSDVQLWDTSSNRLLRTLRGVHEARVGSLAWNNSILTTGGMDGKIVNNDVRIRDHVVQTYEGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPETPKPAAKASHTGMFNSFNHIR

SEQ ID NO: 6448 - protein, 469 aa, Oryza sativa
MDAGSHSISSEKSHGLAPRPPLQEAGSRPYMPSLSTASRNPSAKCYGDRFIPDRSAMDMDMAHYLLTEPKKDKENAAASPSKEVYRRLLAEKLLNNRTRILAFRNKPPEPENVSAADTASTHQAKPAKQRRYIPQSAERTLDAPDLVDDYYLNLLDWGSKNVLSIALGDTVYLWDASSGSTSELVTVDEDSGPITSVSWAPDGQHVAVGLNSSDIQLWDTSSNRLLRTLRGVHESRVGSLAWNNNILTTGGMDGNIVNNDVRIRNHVVQTYQGHSQEVCGLKWSGSGQQLASGGNDNLLHIWDVSMASSVPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGSPEAPKPAAKASHTGMFNSFNHLR

SEQ ID NO: 6449 - protein, 471 aa, Zea mays
MDAGTYSISSEKSHTAAAARPPLQEAGTRPYMPSLSTGSRNPSAKCYGDRFIPDRSAMDMDMAHYLLTEPRRDKENAVAASPSKEAYRRLLAEKLLNNRTRILAFRNKPPVSENVSAAITASSHHAKLVKQRRHIPQSAERTLDAPELVDDYYLNLLDWGSNNVLSIALGDTVYLWDASSGSTSELVTIHEDSGPITSVNWAPDGHHIAIGLNSSDIQLWDTSSNRLLRTLRGVHEERVGSLAWNNNILTTGSMDGKIVNNDVRIRNHVVQTYEGHSQEVCGLKWSGSGQQLASGGNDNLLHIWDVSMASPMSTAGRNQWLHRLEDHMSAVKALAWCPFQSNLLATGGGGSDRCIKFWNTHTGACLNSVNTGSQVCALLWNKNERELLSSHGFTQNQLTLWKYPSMVKMAELSGHTSRVLFMAQSPDGCTVASAAADETLRFWNVFGDPEVAKPAAKASHTGMFNSFNHIR

SEQ ID NO: 6450 - protein, 477 aa, Zea mays
MDAGSRSISSAKNRAAAVAAAPRPPLQEAGSRPYMPSLSSGPRNPSAKCYGDRFIPDRSAMDMDLAHYLLTEPRRDKENASGMAASPSKEAYRRLLAEKLLNNRTRILAFRSKPPEPENVSFADTTSSNLQAKPAKQRRHIPQSAERTLDAPELVDDYYLNLLDWGSNNVLSIALGDTVYLWDASSGSTSELVTVGEDSGPVTSVSWAPDGRHMAVGLNSSDVQLWDTSSNRLLRTLRGAHEARVGSLAWNNSVLTTGCMDGKIVNNDVRIRDHVVQRYEGHSQEVCGLKWSGSGQQLASGGNDNLLHIWDVSMASSMPSAGRNQWLHRLEDHMAAVKALAWCPFQSNLLATGGGGSDRCIKFWNTHTGVCLNSVDTGSQVCALLWNKNERELLSSHGFTQNQLTLWKYPSMVKMAELNGHTSRVLFMAQSPDGCTVASAAADETLRFWNVFGTPETPKPAAKASHTGMFNSFKHIR

SEQ ID NO: 6451 - protein, 470 aa, Brachypodium distachyon
MDAGSRSISSEKSRAAVQRPPLQEAGSRPYMPSLSTSSRDPSAKCYGDRFIPNRSAMDMDMAHYLLTEPKKDKENMAASPSKEAYRRLLAEKLLNNRTRILAFRNKPPEPENTLAADTVSSHQAKPAKQRRYIPQSAERTLDAPDLVDDYYLNLMDWGSSNVLSIALGDTMYLWDASSGSTSELVTVDEDNGPITSVSWAPDGRHLAIGLNSSDIQLWDTSSSRLLRTLKGVHESRVGSLAWNNNILTTGGMDGRIVNNDVRIRDHAVQTYQGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGTPEVAKPAAKASSHTGMFNSFNHIR

SEQ ID NO: 6452 - protein, 816 aa, Brachypodium distachyon
MGGGSEGGGDGEEGCCSVGDTSPGTIVWVRRRNGSWWPGRILGQDELPPSQIMSPRSGTPVKLLGREDASVDWYNLEKSKRVKAFRCGEFDACIERAEATQGTLAKKREKYARREDAILHALELERKLLASKHQTQGFRPAYFSACTKHRKDLGSTRYKSKKRKRKDVSALPDTKKEADQYFLHAGSKKNFSGSLSQGTTENLTSNHLGDLSNARHIQGGASSESKEKYTVVKKNRSDGSDFDESIEKGVRRRPLVQVLQSSTKLPQHSRHNDDYGAILIGADKDPSPATYRAKRSRYTYLPSDSGETHSLSDLPSAQIASTGTDFETESYLQHPNCSSEEHTSSDFVEKHISESSERECSESETEDDAELLQSANMILPPELRPRDPYFLRASDKFGHADNNGDEANYSTYSHQLNESEEEDGYSEHGVSQWHMKGKRNNRGAVKRSMPMTDGNSCLDKPNGLTKGSVYKTNGINHRKESVQTSNQQLLRHQIKEESNYDSDETDLFEDTSRTEVNLYHSRTYPSSLKATRDLSRSYIYYDDYENDSSKISPVNCDAGQIFRVDRNAYWDRPSFYQRNYSSRLGGLGPMLFDVDLKVQASYHGEHVPLVSLMSRLDGKAIVGHPIQIEILEDGTTDHLVSGGDISMEESTGTPPAWRTGRRTAMQRVPRSNPSGASLDGDNEGGLAYPDWEMKPVVRKYSTSNHQVKVNKKIVSNPRRASVSKSQKKPSKKASLSSQKVRTISSISTGRRQNRGGGQHSRSSIFGGLIKAEGTIPLVTCVPAKVVFTRILEAVGRPLLTVTHRVRMDSHAVQDPS

SEQ ID NO: 6453 - protein, 205 aa, Secale cereale
MPCRRTEGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCSLLWNKNERELLSSHGFTQNQLTLWKYPSMVKMAELTGHTSRVLFMAQSPDGCTVASASADETLRFWNVFGTPEVAKPAPKASHTGMFSSSFAHIR

SEQ ID NO: 6454 - protein, 468 aa, Brachypodium distachyon
MDAGYRSISSEKSRAVQRPPLQEAGSRPYMPSLSTSSRDPSAKCYGDRFIPNRSAMDMDMAHYLLTEPKKDKENMASSPSKEAYRKLLTEKLLNNRTRILAFRNKPPEPENILAADTVSSHQAKPAKQRRYIPQSAERTLDAPDLVDDYYLNLMDWGSSNVLSIALGDTMYLWEASSGSTSELVTVDEDKGPITSVSWAPDGRHLAIGLNSSDIQLWDTSSSRLLRTLKGVHESRVGSLAWNNNILTTGGMDGRIVNNDVRIRDHAVQTYQGHSQEVCGLKWSGSGQQLASGGNDNLLHIWDVPMASSMPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGTPEVAKPAAKASHTGMFNSFNHIR

SEQ ID NO: 6455 - protein, 474 aa, Triticum aestivum
MDAGSHSISSGKNSAAAVQRPPLQEAGSRPYMPPLSTTSRNPAAKCYGDRFIPDRSAMDMDMAHYLLTETKKDKENAAAIAASPSKEAYRRLLAEKLLNNRTRILAFRNKPPEPENVFAADTVSSHQAKPAKQRRYIPQSAERTLDAPDLVDDYYLNLMDWGSSNVLSIALGDTMYLWDASSGSTSELVTVEEDNGPITSVSWAPDGRHLAIGLNSSDIQLWDTSSNRLLRTLKGVHESRVGSLAWNNNILTTGGMDGRIVNNDVRIRDHAVQTYQGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCSLLWNKNERELLSSHGFTQNQLTLWKYPSMVKMAELTGHTSRVLFMAQSPDGCTVASAAADETLRFWNVFGTPEVTKPAPKASQSGMFSSSFAHIR

SEQ ID NO: 6456 - protein, 468 aa, Triticum aestivum
MDAGSRSISSGKNRAAVQRPPLQEAGSRPYMPSLSTRNPSAKCYGDRFIPDRSAMDMDVAHYLLTEGKKDKENAAASPSKEAYRRLLAEKLLNNRTRILAFRNKPPEPENVFAADTVSSHQAKPAKQRRYIPQSAERTLDAPDLVDDYYLNLMDWGSSNVLSIALGDTMYLWDASSGSTSELVTVEEDNGPITSVSWAPDGRHLAIGLNSSDIQLWDTSSSRLLRTLKGVHESRVGSLAWNNNILTTGGMDGRIVNNDVRIRDHAVQTYQGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCSLLWNKNERELLSSHGFTQNQLTLWKYPSMVKMAELTGHTSRVLFMAQSPDGCTVASASADETLRFWNVFGTPEVAKPAPKASHSGMFNSSFAHIR

SEQ ID NO: 6457 - protein, 475 aa, Hordeum vulgare
MDAGSHSISSSKSSAAAVQRPPLQEAGSRPYMPPLSTTSRNPSAKCYGDRFIPDRSAMDMDMAHYLLTETKKDKENAAAIAASPSKEAYRRLLAEKLLNNRTRILAFRNKPPEPENVFAADTVSSHLQAKPAKHRRYIPQSAERTLDAPDLVDDYYLNLMDWGSSNVLSIALSDTMYLWDASSGSTSELVTVEEDNGPITSVSWAPDGRHLAIGLNSSDIQLWDTSSNRLLRTLKGVHESRVGSLAWNNNVLTTGGMDGRIVNNDVRIRDHAVQMYQGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCSLLWNKNERELLSSHGFTQNQLTLWKYPSMVKMAELTGHTSRVLFMAQSPDGCTVASAAADETLRFWNVFGTPEVAKPAPKASHSGMFSSSFAHIR

SEQ ID NO: 6458 - protein, 475 aa, Setaria italica
MDAGSNSISSQKCGSRRAAPPRPALQEAGSRPYMPPLSTGPRNPSAKCYGDRFIPERSAMDMDFAHYLLTEPRKGKENPAAAVSPAKEAYRKLLAEKLLNNRTRILAFRNKPPEPQNVLTDLRSDVVQAKPAKQRRHIPQSSERTLDAPELADDYYLNLLDWGSSNVLSIALGSTVYLWDASSGSTSELVTIDEDFGPVTSVSWAPDGRHIAVGLNSSDVQLFDTTSNRLLRTLRGVHELRVGSMAWNDSILTTGGMDGKIVNNDVRIRNSVVQTYHGHEQEVCGLKWSGSGQQLASGGNDNLLHIWDVSMSSSVQSAGRTQWLHRLQDHLAAVKALAWCPFQSNLLASGGGGGDRCIKFWNTHTGACLNSVDTGSQVCALLWNKNERELLSSHGFTQNQLTLWKYPSMVKMAELNGHTSRVLFMAQSPDGCTVASAAADETLRFWNVFGTPEAAPKAAAKASHTGIFNSFNHIR

SEQ ID NO: 6459 - protein, 474 aa, Panicum virgatum
MDAGSNSISSQRSGSRRAAPPRPVLQEAGSRPYMPPLSSGPRNPSAKCYGDRFIPERSAMDMDLAHYLLTEPRKGKENPVAASPAKEAYRKLLAEKLLNNRTRILAFRNKPPEPENMLTDLRSDAVQAKPAKQRRHIPQSSERTLDAPDLVDDYYLNLLDWGSSNVLSIALGSTVYLWDASSGSTSELVTVDDDYGPVTSVSWAPDGRHIAVGLNSSDVQLWDTTSNRLLRTLRRVHELRVGSLAWNNSILTTGGMDGKIVNNDVRIRNNVVQTYHGHEQEVCGLKWSGSGQQLASGGNDNLLHIWDVSMSSSVQSAGRTQWLHRLQDHLAAVKALAWCPFQSNLLASGGGGGDRCIKFWNTHTGACLNSVDTGSQVCALLWNKNERELLSSHGFTQNQLTLWKYPSMVKMAELNGHTSRVLFMAQSPDGCTVASAAADETLRFWNVFGTPEAAPKAAAKASHTGIFNSFNHIR

SEQ ID NO: 6460 - protein, 474 aa, Oryza sativa
MDAGSHSISSEKSSRYVAPRQPLQEAGSRPYMPSLSTASRNPSAKCYGDRFIPDRSAMDMDMAHYLLTEPRKDKENAAASPAKEAYRKLLAEKILNNRTRILSFRNKPPEPESILTELRADAASIQAKPAKQRRYIPQSAERTLDAPELVDDYYLNLLDWGSSNVLSIALGNSVYLWDATNSSTSELVTVDEDNGPVTSVSWAPDGRHIAVGLNSSDVQLWDTSSNRLLRTMRGVHDSRVGSLAWNNNILTTGGMDGKIVNNDVRIRNHVVQTYQGHQQEVCGLKWSGSGQQLASGGNDNLLHIWDVSMASSMPSAGRTQWLHRLEDHLAAVKALAWCPFQSNLLASGGGGSDRCIKFWNTHTGACLNSIDTGSQVCSLVWNKNERELLSSHGFAQNQLTLWKYPSMVKMAELTGHTSRVLFTAQSPDGLTVASAAADETLRFWNVFGAPEAPKTATKGSHTGMFNNSNHIHIR

SEQ ID NO: 6461 - protein, 468 aa, Hordeum vulgare
MDAGSRSISSGKNRAGAVQRPPLQEAGSRPYMPSLSTRNPSAKCYGDRFIPDRSAMDMDVAHYLLTEGKKDKENAAASPSKEAYRRLLAEKLLNNRTRILAFRNKPPEPEKVFAADTVSSHQAKPSKQRRYIPQSAERTLDAPDLVDDYYLNLMDWGSRDVLSIALGDTMYLWDASSGSTSELMTVEEDNGPITSVSWAPDGQHLAIGLNSSDIQLWDTSSNRLLRTLKGVHESRVGSLAWNDNILTTGCMDGRIVNNDVRIRDHAVQTYQGHSQEVCGLKWSGSGQQLASGGNDNLLHIWDASMASSMPSPGRNQWLHRLEDHMAAVKALAWCPFQSNLLATGGGASDRCIKFWNTHTGACLNSVDTGSQVCSLLWNKNERELLSSHGFTHNQLTLWKYPSMVKMAELSGHTSRVLFMAQSPDGCTVASASADETLRFWDVFGTPEVAKPAPKASHTGMFNSFKHIR

SEQ ID NO: 6462 - protein, 474 aa, Brachypodium distachyon
MDAGSNSISSEKSSRYAAPRSPLKEAGSRPYMPSLSTASRNPNAKCYGDRFIPNRSAMDMDMAHYLLTEPKRDEKNVGTASPSNEMYRKLLAEKLLNNRTRILAFQNKPPEPENILTELRADTASIQAKPTKQRRHIPQTAERTLDAPDLVDDYYLNLLDWGSSNVLSIALGNTVYLWDGSNGSTSELVTVDEDNGPVTSVSWAPDGRHIAVGLNSSIVQLWDPSSNRLLRTLRGVHESRVGSLAWNNNILTTGGMDGKIVNNDVRIRNHAVQTYHGHEQEVCGLKWSGSGQHLASGGNDNLLHIWDVSMASSVQSAGRTQWLHRLDDHLAAVKALAWCPFQSNLLASGGGGSDRCIKLWNTHTGACLNSVDTGSQVCALLWNKNERELLSSHGFTQNQLTLWKYPSMVKMAELTGHSSRVLFMTQSPDGCTVASAAADETLRFWNVFGTPDTPKATKVKASHTGMFNSYNHIR

SEQ ID NO: 6463 - protein, 419 aa, Panicum virgatum
MPPLSSGSRNPSAKCYGDRFIPDRSAMDMDMAHYLLTEPRKDNENAVVSPSKEAYRRLLAEKLLKNRTRILAFRNKPPEPENVAAANPASSHHAKPAKQRRHIPRSAERTLDAPELVDDYYLNLLDWGSNNVLSIALGDTVYLWDASSGSTSELVTVDEDSGPITSVSWAPDGRHIALRTLRGVHEARVGSLAWNILTTGSMDGRIVNNDVRIRNHVVQTYEGHSQEVCGLKWSGSGQQLTRGGNDNLLHIWDVSMASSMPSAGRNQWLHRLDYHMAAVKALAWCPFQSNLLATGGGGSDQCIKFWNTHTGACLNSVDTGSQVCSLLWNKNERELLSSHGFTHNQLTLWKYPSMVKMAELTGHTSRVLFMAQSPDGCTVASAAADETLRFWNVFGTPEAPKPTAKASHTGMFNSFNHIR

SEQ ID NO: 6464 - protein, 475 aa, Elaeis guineensis
MDAGSFSSSISSEKTRPASRHPLQEVGSRPYMPSLRSSSKDLSSRQSGGDRFIPDRSAMDFDMAYYLLTEPRKEKENTAAASPSKETYRRLLAENLLNNRTRILAFKSKPPAPAEGVLQEAYSNASSHQAKLAKPRRYIPQSAERTLDAPDLVDDYYLNLLDWGSSNVLSIALGNTVYLWDASDGSTSELVTVDEDVGPVTSVSWAPDGRHIAVGLNSSDIQLWDSSSNRLLRTLRGVHGSRVGSLAWNNNILTTGGMDGKIVNNDVRVRSHMVQTYRGHQQEVCGLKWSGSGQQLASGGNDNLLHIWDISMASSNPSPGQNQWLHRFEDHMAAVKALAWCPFQSNLLASGGGGGDRCIKFWNTHTGACLNSVDTGSQVCSLLWNKNERELLSSHGFTQNQLTLWKYPSMVKIAELTGHTSRVLFMAQSPDGCTVASAAGDETLRFWNVFGTPEAPKPAAKTASTGPFTSFNHIR

SEQ ID NO: 6465 - protein, 545 aa, Sorghum bicolor
MDPAQYFQPRTFSIKLWPPSESTRLMLVERMTKNLSTESESIFSRKYGTLGKEEAHENAKRIEELCFASADEHFKREPDGDGSSAVQLYAKETSKMMLEVLKKGPRTTAELEAPVADTPLVPADTVLDISGGKRAFIEADEAKELLSPLTKPGNSYQRICFSNRSFGIGAANVAGPILESVKNQLTEVDISDFVAGRPEDEALDVMRIFSKALEGSVLRYLNISDNALGEKGVRAFSELLKSQESLEELYVMNDGISEEAAKALSELIPATEKLKVLHFHNNMTGDEGAMYIAEMVKRSPNVESFRCSATRIGSDGGVALSEALGTCTRLKKLDLRDNLFGVDAGLALSKTLPKLPDLVELYLSDLNLENEGTIAIVKALKQSAPQLEVLEMAGNEINAKAAPDLAECLTAMQSLKKLTLAENELKDGGAVIIAKSLEDGHTDLKELDVSTNMLQRVGARCFARAVADKPAFVQLNINGNFISDEGIDEVKEILKAGKKSLDVLGSLDENEPDGEPDDEEEDQDAEDNEDELDSKLQSVKVEQDD

SEQ ID NO: 6466 - protein, 541 aa, Zea mays
MDSAQDFQPRTFSIKLWPPSESTRIMLVDRMTNNLSTESIFSRKYRLLGKQEAHENAKTIEELCFALADEHFREEPDGDGSSAVQLYAKETSKMMLEVLKKGPRTTAELEAPVADTPLVSADTVLDISGGKRAFIEADEAKELLSPLTKPGNSYKRICFSNRSFGIGAANVAGPILESVKNQLTEVDISDFVAGRSEDEALDVMRIFSKALDGSVLRYLNISDNALGEKGVRAFSELLKSQESLEELYVMNDGISEEAAKALSELIPATEKLKVLHFHNNMTGDEGAMYIAEMVKRSPNVESFRCSATRIGSDGGVALSEALGTCTRLKKLDLRDNLFGVDAGLALSETLPKLPDLVELYLSDLNLENKGTIAIAKALKQSALQLEVLEIAGNEINAKAAPDLAECLAVMQSLKKLTLAENELKDNGAVIIAKSLEDGHSDLKELDVSTNMLQRVGARCFTRAVANKPDFVQLNINGNFISDEGVDEVKEILKAGKKSLDVLGPLDENEPDGEPDDEDAEDDEDELDLKLQSVKVEQDEDD

SEQ ID NO: 6467 - protein, 555 aa, Panicum virgatum
MDSAAQNFQPRTFSIKLWPPSESTRLKLVERMTKNLSTESIFSRKYGLLGKEEAHENAERIEQLCFGSADEHFKKEPDGDGSSAVQLYAKETSKMMLEVLKKGPRITAELEASVADTPLAPGDTVLDISGGKRAYIEADEAKQLLSPLTKPGNSYKRICFSNRSFGVDAANVAGSILESVKNQLTEVDISDFVAGRPEDEALDVMRIFSKALEGSVLRYLNISDNALGEKGVRAFSELLKSQENLEELYVMNDGISEDAAKALSELIPSTEKLKVLHFHNNMTGDEGAVYVAEMVKRSPNLESFRCSATRIGSDGGVALSEALGTCTHLKKLDLRDNLFGVDAGIALSKTLPKLPDLVELYLSDLNLENKGTVAIVNALKQSAPQLEVLELAGNEINAKAAPDLAECLTAMQSLKKLTLAENELKDAGAVIIAKSLEDGHVDLKEFDVSTNMFQRAGARCFARAVANKPGFVQLNIDGNFISDEGIDEVKDILKAGKNSLDVLGSLDENEPEGQPDDGDEDDDDDEGAKDDDVEDRLDSKLQNVQVEQDDEPCLG

SEQ ID NO: 6468 - protein, 555 aa, Panicum virgatum
MDSAAQNFQPRTFSIKLWPPSESTRLKLVERMTKNLSTESIFSRKYGLLGKEEAHENAERIEQLCFGSADEHFKKEPDGDGSSAVQLYAKETSKMMLEVLKKGPRITAELEASVADTPLAPGDTVLDISGGKRAFIEADEAKQLLSPLTKPGNSYKRICFSNRSFGVDAANVAGSILESVKNQLTEVDISDFVAGRPEDEALDVMHIFSKALEGSILRYLNISDNALGEKGVRAFSELLKSQENLEELYVMNDGISEDAAKALSELIPSTEKLKVLHFHNNMTGDEGAVYVAEMVKRSPNLESFRCSATRIGSDGGVALSEALGTCTHLKKLDLRDNLFGVDAGIALSKTLPKLPDLVELYLSDLNLENKGTVAIVNALKQSAPQLEVLELAGNEINAKAAPDLAECLTAMQSLKKLTLAENELKDAGAVIIAKSLEDGHVDLKELDVSTNMFQRAGARCFARAVANKPGFVQLNIDGNFISDEGIDEVKDILKAGKNSLDVLGSLDENEPEGQPDDGDEDDDDDEGAKDDDVEDRLDSKLQNVQVEQDDEPCLG

SEQ ID NO: 6469 - protein, 551 aa, Brachypodium distachyon
MDSIAQDFQPRTFSIKLWPPSESTRLMLVERMTKNLSNESIFSRKYGLLGKEEAHENAKRIEDMCFASADEHFKKEPDGDGSSAVQLYAKETSKLMLDVLKRGPKTTVEPEAPVIDTPPEPADTVFDISGGKRAFIEAEEAKELLSPLTKPGNSYKRICFSNRSFGIGAANVAGPILESIKTQLTEVDISDFVAGRPEDEALDVMRIFSRALEGSVLRYLNISDNALGEKGVRAFKELLESQGNLEELYVMNDGISEEAAKALSELIPSTEKLKVLHFHNNMTGDEGAMSIAEMVKRSPNLESFRCSATRIGSDGGVALAEALGTCTHLKKLDIRDNLFGVEAGVALSKTLPKLHDLVELYLSDLNLENEGTVAIVNVLKLSAPQLEILEMAGNEITAEATQDIAACLKAMQSLKKLTLAENELKDAGAVVIAQSLEGGHADLKELDVSTNMFQRAGARCFAQAITNKPGFMQLNINGNFISDEGIDEVKAILKGGKNSLEVLGPLDENEPDGEQEYDDEEEDGSDGDGQVENGEDGLDTKLQHLKVEQDD

SEQ ID NO: 6470 - protein, 500 aa, Pennisetum glaucum
MDTAAQDFQPRTFSIKLWPPSESTRLMLVERMTKNLSTESIFSRKYGLLGKEEAHENAKRIEQLCFASADEHFKKEPDGDGSSAVQLYAKETSKMIMEVLKKGPMTTAEPEAPVADTPLQPGDTVLDISGGNRAFIEADEAKELLSPLTKPGNSYKRICFSNRSFGIDAANVARPILESVKNQLTEVDISDFVAGRPEDEALDVMRIFSKALEGSVLRYLNISDNALGEKGVRAFSELLKSQEKLEELYVMNDGISEDAAKALSELIPSTEKLKVLHFHNNMTGDEGAVYVAEMVKRSPNLESFRCSATRIGADGGVALSEALGTCTHLKKLDLRDNLFGVDAGIALSKTLPKLPDLVELYLSDLNLENKGTIAIVNVLKQSAPRLEVLELAGNEINAKAAPALAECLTSMQSLKKLILAENELKDDGAVTIAQSLEVGHGDLKELDVSTNMLQRVGARCFARAVANKPGFVQLNMNGNFISDEGIDEVKRVIEVVTKHK

SEQ ID NO: 6471 - protein, 539 aa, Brachypodium distachyon
MDSPVWGFSIKLWPLSESTRLMVIDRMTENPSTETLFSRKYGRLDKEEARENAKRIEETCFASVDEHFKEEPDGDGSSAVQLYARETSKLMVEVLKRGPRASAELEAPVVIDAPLEPADTVLDISGGKRAFIDTDEAKELLIPLTKPGNSYKRICFSNRSFGIDAANVAGPILESIKKQITEVDISDFVAGRPEDEALDVMRIFSKALEGSVLRYLNISDNALGEKGVRAFEELLKSQDNLEEFSVMNDGISEEAAKALSELIPSTEILKVLHFHNNMTGDEGALSIAEMVKRSSNLESFRCSATRIGSDGGVALAEALGTCTRLKKLDLRDNLFGVEAGIALSKTLPKLPDLVELYLSDLNLENKGTIAIANALKQSAPRLEVLEMAGNEITAKATQALAECLTVMQSLKKLTLAENELEDRGAVVIAKTLENSHPDLKELDVSTNMLRRAGARCFAQAIADKPGFVQLNINGNFISDEGIEEVKKILKSGKNSLSVLGSLDENDPEGEPGDGDEEGDEEDDEGGLDSKLQNLNVEQD

SEQ ID NO: 6472 - protein, 442 aa, Saccharum officinarum
MASELTYRGGGASTAASAGAGGYSPKPSKPLAWLPRAARYAVAEHRPLFALAGMLIAAAVISIASPSASSTSTGAASSYSNNNYNNNPLARFSVEPAHHRDVATRHFVGGKVPLGLKRKALRVLVTGGAGFVGSHLVDRLLERGDSVIVVDNFFTGRKDNILHHLNDPNFEMIRHDVVEPILLEVDQIYHLACPASPVHYKYNPIKTIKTNVVGTLNMLGLAKRINAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELAKVVQDTIDPNAQIEFRQNTQDDPHKRKPDISRAKELLGWEPKIPLREGLPLMVNDFRKRIFGDQDTAATTGNQQG

SEQ ID NO: 6473 - protein, 438 aa, Zea mays
MASELTYRGGGAFTAASAGAGGYSPKPSKPLAWLPRAARYAVAENRPLFALAGMLIAAAVISIASPSASSSSSAASSYSNNNPLARFSVEPAHHRDVATRHFVGGKVPLGLKRKVLRVLVTGGAGFVGSHLVDRLLQRGDSVIVVDNFFTGRKDNVLHHLGDPNFEMIRHDVVEPILLEVDQIYHLACPASPVHYKYNPIKTIKTNVVGTLNMLGLAKRINARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHVGPFNLGNPGEFTMLELAKVVQDTIDPNARIEFRQNTQDDPHKRKPDIGRAKELLGWEPKIPLREGLPLMVTDFRKRIFGDQDTAAATTGNQQG

SEQ ID NO: 6474 - protein, 459 aa, Zea mays
MASELTYRGGGTSTAAGAGAGGYSPKPSKPLAWLPRAARYAVAEHRPLFALAGMLIAAAVISIASPSASSSSSTSTSTGGAASSYSNNNNPLARFPVEPAHHRDVATRHFVGGKVPLGLKRKALRVLVTGGAGFVGSHLVDRLLERGDSVIVVDNFFTGRKDNVLHHLNDPNFEMIRHDVVEPILLEVDQIYHLACPASPVHYKYNPIKTIISFLYEFLQFSSHKTNVVGTLNMLGLAKRINARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHVGPFNLGNPGEFTMLELAKVVQDTIDPNARIEFRKNTQDDPHKRKPDISRAKEFLGWEPKIPLREGLPLMVSDFRKRIFGDQDAAATTTGNQQG

SEQ ID NO: 6475 - protein, 446 aa, Panicum virgatum
MASELTYRGGGASPVAGAGAGAGGYSAKPSKPLAWLPRAARYAAAEHRPVFALAGMLIAAAVICIASPSAPSSSAAAAVSSYSSSSSTNNPLARFSVEPAHHRDLASTRHFVGGKVPLGLKRKALRVLVTGGAGFVGSHLVDRLLERGDSVIVVDNLFTGRKDNVVHHFANPNFEMIRHDVVEPILLEVDQIYHLACPASPVHYKYNPVKTIKTNVVGTLNMLGLAKRINARFLLTSTSEVYGDPLQHPQVETYWGNVNPIGVRSCYDEGKRTAETLTMDYHRGANLQVRIARIFNTYGPRMCIDDGRVVSNFVAQALRKEPLTVYGDGKQTRSFQYVSDLVEGLMKLMEGDHVGPFNLGNPGEFTMLDLAKVVQDTIDPNARIEFRQNTQDDPHKRKPDISRAKELLGWEPKIPLREGLPLMVTDFRKRIFGDQDSAATTGNQQG

SEQ ID NO: 6476 - protein, 447 aa, Setaria italica
MASELTYRGGGASPVAGAGASSGGYSAKPSKPLAWLPRAARYAAAEHRPVFALAGMLIAAAVITIASPSTSSSTGAAVASYSSSNSHHNSNPLARFSVEPAHHRDLASTRHFVGGKVPLGLKRKALRVLVTGGAGFVGSHLVDRLLERGDSVIVVDNLFTGRKDNVVHHFGNPNFEMIRHDVVEPILLEVDQIYHLACPASPVHYKYNPVKTIKTNVVGTLNMLGLAKRINARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHIGPFNLGNPGEFTMLELAKVVQDTIDPNARIEFRQNTQDDPHKRKPDISRAKELLGWEPKIPLREGLPLMVTDFRKRIFGDQDSAATTGNQQG

SEQ ID NO: 6477 - protein, 448 aa, Panicum virgatum
MASELTYRGGGASPVAGAGAGAEGYSAKPSKPLAWLPRAARYAAAEHRPVFALAGMLIAAAVICIASPSAPSSSAAAAAVSSYSSSGITNNPLARFSVEPAARHRELAGARHFVGGKVPLGLKRKALRVLVTGGAGFVGSHLVDRLLERGDSVIVVDNLFTGRKDNVVHHFANPNFEMIRHDVVEPILLEVDQIYHLACPASPVHYKYNPVKTIKTNVVGTLNMLGLAKRIGAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELAKVVQDTIDPNARIEFRQNTQDDPHKRKPDISRAKELLGWEPKIPLREGLPLMVTDFRKRIFGDQDSTATTGNQQG

SEQ ID NO: 6478 - protein, 426 aa, Pennisetum glaucum
AGAGGYSAKPSKPLAWLPRAARYAAAEHRPVFALAGMLIAAAVITIASPSSSTSTTGAAVASHSSSNSNPLARFSVEPAARHRDLASTRHFVGGKVPLGLKRKALRVLVTGGAGFVGSHLVDRLLERGDSVIVVDNLFTGRKDNVVHHFGNPNFEMIRHDVVEPILLEVDQIYHLACPASPVHYKYNPVKTIKTNVVGTLNMLGLAKRINAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHIGPFNLGNPGEFTMLELAKVVQDTIDPNARIEFRQNTQDDPHKRKPDISRAKELLGWEPKIPLREGLPLMVTDFRKRIFGDQDSAATTANQQG

SEQ ID NO: 6479 - protein, 447 aa, Oryza sativa
MASELTYRGGGGATLAGEAEAAVAAGGYSPKPSKPLAWLPRAARYAAGEHRPLFALAGMLVAAAIFSLATPYSSSTPAAAAAGSTAANPLARFSVEPAVSRRQQQLPARQFVGGKVPLGLKRKGLRVLVTGGAGFVGSHLVDRLVERGDSVIVVDNLFTGRKENVVHHFGNPNFEMIRHDVVEPILLEVDQIYHLACPASPVHYKYNPVKTIKTNVVGTLNMLGLAKRINARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMRLMEGEHVGPFNLGNPGEFTMLELAKVVQDTIDPNAKIEFRPNTQDDPHKRKPDIGRAKELLGWEPKIPLHKGLPLMVTDFRKRIFGDQDSTATTTGGQQG

SEQ ID NO: 6480 - protein, 445 aa, Brachypodium distachyon
MASELTYRGGAASPSAAGAGAAGYAPKPSNSKPLAWLPRAARYAAAEHRPLFALVGMLFAAAVFCIAAPSSSSAPATASSYSSGARAVTNPLARFSLDSSAAAAHHPARHFVGGKVPLGLKRKGLRVLVTGGAGFVGSHLVDRLVERGDSVIVVDNLFTGRKENVVHHFGNPNFEMIRHDVVEPILLEVDQIYHLACPASPVHYKYNPVKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMRLMEGEHVGPFNLGNPGEFTMLELAKVVQDTIDPNARIEHRENTQDDPHKRKPDINRAKELLGWEPKIPLREGLPLMVTDFRKRIFGDQDSATTATGGQ

SEQ ID NO: 6481 - protein, 407 aa, Panicum virgatum
MASELTYRGGGASPVAGAGAGAGGYSAKPSKPLAWLPRAARYAAAEHRPVFALAGMLIAAAVICIASPSAPSSSAAAAVSSYSSSSSTNNPLARFSVEPAHHRDLASTRHFVGGKVPLGLKRKALRVLVTGGAGFVGSHLVDRLLERGDSVIVVDNLFTGRKDNVVHHFANPNFEMIRHDVVEPILLEVDQIYHLACPASPVHYKYNPVKTIKTNVVGTLNMLGLAKRIGAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELAKVVQDTIDPNARIEFRQNTQDDPHKRKPDISRAKEL

SEQ ID NO: 6482 - protein, 443 aa, Secale cereale
MASELTYRGGASSPSAGAAGAAGEYSSPKPASSKPLAWLPRAARYAAAEHRPLFALVGMLVAAAVFCLAAPSGSGTATTPYSSGRAAAVSGALTRFSVDPAAHNPGRQFVAGKVPLGLKRKGLRVLVTGGAGFVGSHLVDRLVARGDSVIVVDNLFTGRKENVMHHFGNPNFEMIRHDVVEPILLEVDQIYHLACPASPVHYKYNPVKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMRLMEGDHIGPFNLGNPGEFTMLELAKVVQDTIDPNARIEFRENTQDDPHKRKPDITKAKEQLGWEPKIALRDGLPLMVTDFRKRIFGDQDSATTATEGQ

SEQ ID NO: 6483 - protein, 442 aa, Secale cereale
ASELTYRGGAASPSAGAGGAAGEYSSPKPASSKPLAWLPRAARYAAAEHRPLFALVGMLVAAAVFCLAAPSGSGTATTPYSSGRAAAVSGALTRFSVDPAAHNPGRQFVAGKVPLGLKRKGLRVLVTGGAGFVGSHLVDRLVARGDSVIVVDNLFTGRKENVMHHFGNPNFEMIRHDVVEPILLEVDQIYHLACPASPVHYKYNPVKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMRLMEGDHIGPFNLGNPGEFTMLELAKVVQDTIDPNARIEFRENTQDDPHKRKPDITKAKEQLGWEPKIALRDGLPLMVTDFRKRIFGDQDSATTATEGQ

SEQ ID NO: 6484 - protein, 443 aa, Triticum aestivum
MASELTYRGGAASPSAGAAGAAGEYSSAKPACSKPLAWLPRAARYAAAEHRPLFALVGMLVAAAIFCLAAPSGSGPAATPYSSGRAAAVSGALTRFSVDPAARNPGRQFVAGKVPLGLKRKGLRVLVTGGAGFVGSHLVDRLVARGDSVIVVDNLFTGRKENVMHHFGNPNFEMIRHDVVEPILLEVDQIYHLACPASPVHYKYNPVKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMRLMEGDHIGPFNLGNPGEFTMLELAKVVQDTIDPNARIEFRENTQDDPHKRKPDITKAKEQLGWEPKIALRDGLPLMVTDFRKRIFGDQDSATTATEGQ

SEQ ID NO: 6485 - protein, 441 aa, Avena sativa
MASELTYRGGASPSAGAGAGAYAAPKPASSKASWLSRAARYAAGEHRPVFALAGMLFAAALFCFAGPSSTTGPATGAYSSGGAAAAVSGSLSRFSVDPAAHNPARHFVGGKVPLGLKRKGLRVLVTGGAGFVGSHLVDRLVARGDSVIVVDNLFTGRKENVMHHFGNPNFEMIRHDVVEPILLEVDQIYHLACPASPVHYKYNPVKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHIGPFNLGNPGEFTMLELAKVVQDTIDPNARIEFRENTQDDPHKRKPDITKAKELLGWEPKIPLRDGLPLMVTDFRKRIFGDQDGDGTTSGGQ

SEQ ID NO: 6486 - protein, 429 aa, Saccharum officinarum
MASELTYRGGSAAPGSASNGGEYSPKPSKPLSWLSRAARYAAAEHRPVFALAGMLFAAALFTFSSPSTSSPSEPAASVGFNHLAVAGHPSFRGSVGGKVPLGLRRRALRVLVTGGAGFVGSHLVDRLVERGDSVIVVDNFFTGRKGNVAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPDARIEFRPNTADDPHKRKPDISRAKELLGWEPKVPLREGLPRMVTDFRKRIFGDQGESTEAAGGLS

SEQ ID NO: 6487 - protein, 429 aa, Sorghum bicolor
MASELTYRGGSAAPGSASNGGEYSPKPSKPLSWLSRAARYAAAEHRPVFALAGMLFAAALFTFSSPSTSSPSEPAASVGFNHLAVTGHPSFRESVGGKVPLGLRRRALRVLVTGGAGFVGSHLVDRLVERGDSVIVVDNFFTGRKGNVAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLREGLPRMVTDFRKRIFGDQGESTEAAGGLS

SEQ ID NO: 6488 - protein, 425 aa, Oryza sativa
MASELTYRGGAGAPGSASDGGEYSPKPSKPLSWLTRAARYAAAEHRPAFALAGMLLAAALFSLYAPSSDASSSAATTTTTTFSHLSSLPSSSAASLHESAGGKVPLGLRRRALRVLVTGGAGFVGSHLVDRLVERGDSVIVVDNFFTGRKDNVAHHLANPRFEVIRHDVVEPILLEVDQIYHLACPASPVHYKYNPIKTIKTNVVGTLNMLGLAKRIGAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMSLMEGEHIGPFNLGNPGEFTMLELAKVVQDTIDPNARIEFRPNTADDPHKRKPDITRAKELLGWEPKVPLREGLPLMVTDFRKRIFGDQEA

SEQ ID NO: 6489 - protein, 429 aa, Zea mays
MASELTYRGGSVAPGSASNGGEYSPKSSKPLSWLARAARYAAAEHRPVFALAGMLFAAAIFTFSSPSTLSPSEPAASVGFNHLAVSGHPSFRESVGGKVPLGLRRRALRVLVTGGAGFVGSHLVDRLLERGDSVIVVDNFFTGRKGNVAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHIGPFNLGNPGEFSMLELAKVVQDTIDPEAHIEFRPNTADDPHKRKPDISRAKELLGWEPKVPLREGLPRMVTDFRKRIFGDQEGSTESAGGLS

SEQ ID NO: 6490 - protein, 433 aa, Panicum virgatum
MASELTYRGAAAAHGSASNGGEYSPKPSKPLSWLSRAARYAAAEHRPVFALAGMLFAAALFTFSSSSSSSTSDSSYAAASAGFRHLAIAGHPSFRESSVGGKVPLGLRRRALRVLVTGGAGFVGSHLVDRLVERGDSVIVVDNFFTGRKGNIAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLHEGLPLMVTDFRKRIFGDQEKSTEAAGGLS

SEQ ID NO: 6491 - protein, 431 aa, Panicum virgatum
MASELTNRRGAAAHGSASNGGEYSPKPSKPLSWLSRAARYAAAEHRPVFALAGMLFAAALFTFSSSSSTSTSSYPAASAGFGHLAIGGHPSFRESSVGGKVPLGLRRRALRVLVTGGAGFVGSHLVDRLVERGDSVIVVDNFFTGRKGNVAHHLRNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLHEGLPLMVTDFRKRIFGDQEESTEAAGGLS

SEQ ID NO: 6492 - protein, 431 aa, Brachypodium distachyon
MASELTYRGGAATGSASDGGEYSPKPSKPLSWLTRAARYATAEHRPLFALVGMLFAAALFTFSSSSSSAGYTSPSGPAAVSFKHLANIAHPSLHESVGGKMPLGLRRRGLRVLVTGGAGFVGSHLVDRLMERGDSVIVVDNFFTGRKGNVAHHLGNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHIGPFNLGNPGEFTMLELAKVVQDTIDSSASIEYRPNTADDPHKRKPDITRAKELLGWEPKVPLHEGLPLMVTDFRKRIFGDQEESTTTAGGMS

SEQ ID NO: 6493 - protein, 431 aa, Setaria italica
MASELTYRGGAAAPGSASNGGEYSPKPSKPLSCLSRAARYAAAEHRPIFALAGMLFAAALFTFSSSTTSTSSPSYPAASVGFNHLAVAGHPSFRESVGGKVPLGLRRRALRVLVTGGAGFVGSHLVDRLVERGDSVIVVDNFFTGRKGNVAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHIGPFNLGNPGEFTMLELAKVVQDTIDKEARIEFRPNTADDPHKRKPDISRAKELLGWEPKVPLHEGLPLMVTDFRKRIFGDQGEFTEAAGGLS

SEQ ID NO: 6494 - protein, 430 aa, Panicum virgatum
MASELTNRRGAAAHGSASNGGEYSPKPSKPLSWLSRAARYAAAEHRPVFALAGMLFAAALFTFSSSSTPTSSYPAASAGFGHLAIGGHPSFRESSVGGKVPLGLRRRALRVLVTGGAGFVGSHLVDRLVERGDSVIVVDNFFTGRKGNVAHHLRNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLHEGLPLMVTDFRKRIFGDQEESTEAAGGLS

SEQ ID NO: 6495 - protein, 142 aa, Unknown
  Sequence found in Organisms: Prunus persica, Prunus mume
MSYLLPHLHSGWAVDQAILAEEERLVIIRFGHDWDETCMQMDEVLAAVAETLKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6496 - protein, 142 aa, Panicum virgatum
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETAYRGARKGRGLVIAPKDYSTKYRY

SEQ ID NO: 6497 - protein, 142 aa, Panicum virgatum
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETLYRGARKGRGLVIAPKDYSTKYRY

SEQ ID NO: 6498 - protein, 142 aa, Unknown
  Sequence found in Organisms: Cannabis sativa, Vigna unguiculata, Humulus lupulus
MSYLLPHLHSGWAVDQAILAEEERLVIIRFGHDWDETCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6499 - protein, 142 aa, Cynodon dactylon
MSYLLPHLHSGWAVDQAILAEEERLVIIRFGHDWDETCMQMDEVLAGVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6500 - protein, 142 aa, Setaria italica
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFVDIVETVYRGARKGRGLVIAPKDYSTKYRY

SEQ ID NO: 6501 - protein, 142 aa, Pennisetum glaucum
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFTDIVETVYRGARKGRGLVIAPKDYSTKYRY

SEQ ID NO: 6502 - protein, 142 aa, Pennisetum glaucum
MSYLLPHLHSGWAVDQAILAEEERLVIIRFGHDWDETCMQMDEVLAAVAETVKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6503 - protein, 75 aa, Elaeis guineensis
FALLAIVPVLLVCLAAREQSEIGVAVCARERERMSYLLPHLHSGVGGGSGHPGRGGAPRHHPLRPRLGRNLHADG

SEQ ID NO: 6504 - protein, 142 aa, Unknown
  Sequence found in Organisms: Phaseolus vulgaris, Ipomoea nil
MSYLLPHLHSGWAVDQAILAEEERLVIIRFGHDWDETCMQMDEVLASVAETLKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6505 - protein, 142 aa, Unknown
  Sequence found in Organisms: Glycine max, Amborella trichopoda, Musa acuminata, Theobroma cacao, Ricinus communis, Cleome gynandra, Cyamopsis tetragonoloba, Eucalyptus grandis, Euphorbia peplus and additional organisms as disclosed in Tables 1 and 2
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6506 - protein, 142 aa, Unknown
  Sequence found in Organisms: Solanum melongena, Olea europaea
MSYLLPHLHSGWAVDQAILAEEERLVIIRFGHDWDDTCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6507 - protein, 142 aa, Amsonia hubrichtii
MSYLLPHLHSGWAVDQAILAEEERLVIIRFGHDWDETCMQMDEVLASVAETIKNFAVIYLVDITEVPDFNTMYELYDPSTVMFFFRNKHIMIDLGTGNNNKINWALKDKQEFIDIVETVFRGARKGRGLVIAPKDYSTKYRY

SEQ ID NO: 6508 - protein, 142 aa, Ocimum basilicum
MSYLLPHLHSGWAVDQAILAEEERLVIIRFGHDWDETCMQMDEVLASVAETIKNFAVIYLVDITEVPDFNTMYELYDPSTCMFFFRNKHIMIDLGTGNNNKINWALKDKQEFIDIVETVYRGARKGRGLVIAPKDYSTKYRY

SEQ ID NO: 6509 - protein, 142 aa, Unknown
  Sequence found in Organisms: Beta vulgaris, Catharanthus roseus, Catharanthus roseus, Platanus occidentalis, Tabernaemontana elegans
MSYLLPHLHSGWAVDQAILAEEERLVIIRFGHDWDETCMQMDEVLASVAETIKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6510 - protein, 142 aa, Cannabis sativa
MSYLLPHLHSGWAVDQSILAEEERLVIIRFGHDWDETCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6511 - protein, 142 aa, Cynodon dactylon
MSYLLPHLHSGWAVDQAILAEEERLVIIRFGHDWDETCMQMDEVLAGVAETIKNFAVIYLVDITEVPDFNTMYELYDPSTVMFFFRNKHIMIDLGTGNNNKINWALKDKQEFIDIVETVYKGARKGRGLVIAPKDYSTKYRY

SEQ ID NO: 6512 - protein, 142 aa, Unknown
  Sequence found in Organisms: Fagopyrum esculentum, Plantago ovata
MSYLLPHLHSGWAVDQAILAEEERLVIIRFGHDWDETCMQMDEVLSSVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6513 - protein, 142 aa, Mesembryanthemum crystallinum
MSYLLPHLHSGWAVDQAILAEEERLVIIRFGHDWDETCMQMDEVLASVAETTKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6514 - protein, 142 aa, Unknown
  Sequence found in Organisms: Actinidia deliciosa, Lippia dulcis
MSYLLPHLHSGWAVDQAILAEEERLVIIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6515 - protein, 142 aa, Silene vulgaris
MSYLLPHLHSGWAVDQSILAEEERLVIIRFGHDWDETCMQMDEVLAGVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6516 - protein, 142 aa, Utricularia gibba
MSYLLPHLHSGWAVDQAILAEEERLVIIRFGHDWDETCMQMDEVLASVADTIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6517 - protein, 142 aa, Mimulus guttatus
MSYLLPHLHSGWAVDQAILAEEERLVIIRFGHDWDETCMQMDEVLASVAETLKNFAVIYLVDISEVPDFNTMYELYDPSTVMFFFRNKHIMIDLGTGNNNKINWALKDKQEFIDIVETVYRGARKGRGLVIAPKDYSTKYRY

SEQ ID NO: 6518 - protein, 142 aa, Mimulus guttatus
MSYLLPHLHSGWAVDQAILAEEERLVIIRFGHDWDETCMQMDEVLASVAETLKNFAVIYLVDIAEVPDFNTMYELYDPSTVMFFFRNKHIMIDLGTGNNNKINWALKDKQEFIDIVETVYRGARKGRGLVIAPKDYSTKYRY

SEQ ID NO: 6519 - protein, 142 aa, Unknown
  Sequence found in Organisms: Prunus persica, Prunus mume
MSYLLPHLHSGWAVDQAILAEEERLVLIRFGHDWDETCMQMDEVLASVAETLKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6520 - protein, 142 aa, Ambrosia trifida
MSYLLPHLHSGWAVDQAILAEEERLVVIRFGHDWDETCMQMDEVLAAVAETLKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6521 - protein, 142 aa, Unknown
  Sequence found in Organisms: Gossypium hirsutum, Persea americana, Manihot esculenta, Cicer arietinum, Cleome spinosa, Eschscholzia californica, Gossypium raimondii, Hevea brasiliensis and additional organisms as disclosed in Tables 1 and 2
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6522 - protein, 142 aa, Vaccinium corymbosum
MSYLLPHLHSGWAVDQAILAEEERLVIIRFGHDWDETCMQMDEVLASVAETIKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6523 - protein, 142 aa, Unknown
  Sequence found in Organisms: Castanea mollissima, Quercus alba
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFVDIVETVYRGARKGRGLVIAPKDYSTKYRY

SEQ ID NO: 6524 - protein, 142 aa, Unknown
  Sequence found in Organisms: Cichorium intybus, Taraxacum officinale, Flaveria ramosissima, Gerbera hybrid cultivar, Lactuca sativa, Helianthus annuus, Tragopogon dubius
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6525 - protein, 142 aa, Euphorbia peplus
MSYLLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6526 - protein, 142 aa, Jatropha curcas
MSYLLPHLHSGWAVDQAILAEEERLVVIRFGHDWDETCMQMDEVLASVAETIKNFAVIYLVDITEVPDFNTMYELYDPSTVMFFFRNKHILIDLGTGNNNKINWALKDKQEFIDIVETVYRGARKGRGLVIAPKDYSTKYRY

SEQ ID NO: 6527 - protein, 142 aa, Carica papaya
MSYLLPHLHSGWAVDQAILAEEERLVVIRFGHDWDETCMQMDEVLASVAETLKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6528 - protein, 142 aa, Petunia hybrida
MSYLLPHLHSGWAVDQAILAEEERLVVIRFGHDWDDTCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6529 - protein, 142 aa, Primula obconica
MSYLLPHLHSGWAVDQGILAEEERLVIIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6530 - protein, 142 aa, Sarracenia psittacina
MSYLLPHLHSGWAVDQAILAEEERLVIIRFGHDWDETCMQMDEVLASVAETIKNFAVIYLVDITEVPDFNTMYELYDPSTVMFFFRNKHIMIDLGTGNNNKINWAMKDKQEFIDIVETIYRGARKGRGLVIAPKDYSTKYRY

SEQ ID NO: 6531 - protein, 142 aa, Valeriana officinalis
MSYLLPHLHSGWAVDQSILAEEERLVIIRFGHDWDETCMQMDEVLASVAETIKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6532 - protein, 142 aa, Unknown
  Sequence found in Organisms: Solanum lycopersicum, Nicotiana benthamiana, Petunia hybrida, Solanum tuberosum, Solanum phureja, Nicotiana tabacum
MSYLLPHLHSGWAVDQAILAEEERLVIIRFGHDWDETCMQMDEVLASVADTLKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6533 - protein, 142 aa, Olea europaea
MSYMLPHLHSGWAVDQAILAEEERLVIIRFGHDWDETCMQMDEVLASVAETLKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6534 - protein, 142 aa, Aquilegia formosa
MSYLLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6535 - protein, 142 aa, Unknown
  Sequence found in Organisms: Arabidopsis lyrata, Papaver somniferum
MSYLLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6536 - protein, 142 aa, Arabidopsis thaliana
MSYLLPHLHSGWAVDQSILAEEERLVVIRFGHDWDETCMQMDEVLASVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6537 - protein, 142 aa, Musa acuminata
MSYLLPHLHSGWAVDQAILAEEERLVVIRFGHDWDETCMQMDEVLASVAETIKNFAVLYLVDITEVPDFNTMYELYDPSTVMFFFRNKHIMIDLGTGNNNKINWALKDKQEFIDIVETIYRGARKGRGLVIAPKDYSTKYRY

SEQ ID NO: 6538 - protein, 142 aa, Unknown
  Sequence found in Organisms: Brachypodium distachyon, Avena sativa
MSYLLPHLHSGWAVDQAILAEEERLVMIRFGHDWDETCMQMDEVLAGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 6539 - protein, 142 aa, Manihot esculenta
MSYLLPHLHSGWAVDQAILAEEERLVVIRFGHDWDETCMQMDEVLASVAETIKNFAVMYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6540 - protein, 142 aa, Chelidonium majus
MSYLLPHLHSGWAVDQAILAEEERLVVIRFGHDWDETCMQMDEVLASVAETIKNFAVIYLVDITEVPDFNTMYELYDPSTVMFFSRNKHIMIDLGTGNNNKINWALKDKQEFIDIIETVYRGARKGRGLVIAPKDYSTKYRY

SEQ ID NO: 6541 - protein, 142 aa, Unknown
  Sequence found in Organisms: Citrus clementina, Citrus sinensis
MSYLLPHLHSGWAVDQAILAEEERLVVIRFGHDWDETCMQMDEVLSSVAETIKNFAVIYLVDISEVPDFNTMYELYDPSTVMFFFRNKHIMIDLGTGNNNKINWALKDKQEFIDIVETVYRGARKGRGLVIAPKDYSTKYRY

SEQ ID NO: 6542 - protein, 142 aa, Cleome gynandra
MSYLLPHLHSGWAVDQAILAEEERLVVIRFGHDWDETCMQMDEVLASVAETIKNFSVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6543 - protein, 142 aa, Cleome spinosa
MSYLLPHLHSGWAVDQAILAEEERLVVIRFGHDWDETCMQMDEVLASVAETLKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6544 - protein, 142 aa, Unknown
  Sequence found in Organisms: Cucumis sativus, Citrullus lanatus
MSYLLPHLHSGWAVDQAILAEEERVVIIRFGHDWDDTCMQMDEVLASVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6545 - protein, 142 aa, Flaveria ramosissima
MSYLVPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6546 - protein, 141 aa, Flaveria ramosissima
SYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6547 - protein, 142 aa, Gerbera hybrid cultivar
MSYLLPHLHSGWAVDQAILAEEERLVVIRFGHDWDESCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6548 - protein, 142 aa, Unknown
  Sequence found in Organisms: Leymus cinereus x Leymus triticoides, Secale cereale, Triticum aestivum
MSYLLPHLHSGWAVDQAILAEEERLVIIRFGHDWDETCMQMDEVLSGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 6549 - protein, 142 aa, Lotus japonicus
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6550 - protein, 102 aa, Mimulus guttatus
MDEVLASVAETLKNFAVIYLVDIAEVPDFNTMYELYDPSTVMFFFRNKHIMIDLGTGNNNKINWALKDKQEFIDIVETVYRGARKGRGLVIAPKDYSTKYRY

SEQ ID NO: 6551 - protein, 142 aa, Nuphar advena
MSYLLPHLHSGWAVDQAILAEEERLVIIRFGHDWDDTCMQMDEVLSSVAETIKNFAVIYLVDITEVPDFNTMYELYDPSTVMFFFRNKHIMIDLGTGNNNKINWALKDKQEFINIVETVYRGARKGRGLVIAPKDYSTKYRY

SEQ ID NO: 6552 - protein, 142 aa, Orobanche aegyptiaca
MSYLLPHLHSGWAVDQAILAEEERLVIIRFGHDWDETCMQMDEVLSSVAETIKNFAVIYLVDITEVPDFNTMYELYDPSTVMFFFRNKHIMIDLGTGNNNKINWAMKDKQEFIDIVETVYHGARKGRGLVIAPKDYSTKYRY

SEQ ID NO: 6553 - protein, 142 aa, Unknown
  Sequence found in Organisms: Rosa hybrid cultivar, Fragaria vesca
MSYLLPHLHSGWAVDQAILAEEERLVVIRFGHDWDETCMQMDEVLANVAETLKNFAVIYLVDITEVPDFNTMYELYDPSTVMFFFRNKHIMIDLGTGNNNKINWALKDKQEFIDVVETVYRGARKGRGLVIAPKDYSTKYRY

SEQ ID NO: 6554 - protein, 142 aa, Scabiosa columbaria
MSYLLPHLHSGWAVDQSILAEEERLVVIRFGHDWDETCMQMDEVLSSVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6555 - protein, 142 aa, Helianthus annuus
MSYLLPHLHSGWAVDQAILAEEERLVVIRFGHDWDETCMQMDEVLASVAETIKNFAVIYLVGITEVPDFNTMYELYDPSTVMFFFRNKHIMIDLGTGNNNKINWAMKDKQEFIDIVETVYRGARKGRGLVIAPKDYSTKYRY

SEQ ID NO: 6556 - protein, 142 aa, Helianthus annuus
MSYLLPHLHSGWAVDQAILAEEERLVVIRFGHDWDETCMQMDEVLASVAETIKNFAVVYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6557 - protein, 141 aa, Panicum virgatum
MSYLLPHLHSGWAVDQAILAEEERLVIIRFGHDWDETCMQMDEVLATVAETIKNFAVIYLVDITEVPDFNTMYELYDPSTVMFFLRNKHIMIDLGTGNNNKINWALKDKQEFIDIVETVYRGARKGRGLVIAPKDYSKYCY

SEQ ID NO: 6558 - protein, 142 aa, Camellia sinensis
MSYLLPHLHSGWAVDQAILAEEERLVIIRFGRDWDETCMQMDEVLASVAETIKNFAVLYLVDITEVPDFNTMYELYDPSTVMFFFRNKHIMIDLGTGNNNKINWALKDKQEFIDVVETVYRGARKGRGLVIAPKDYSTKYRY

SEQ ID NO: 6559 - protein, 142 aa, Nicotiana tabacum
MSYLLPHLHSGWAVDQAILAEEERLVIIRFGHDWDDNCMQMDEVLASVAETIKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6560 - protein, 90 aa, Amorphophallus konjac
MSYLLPHLHSGWAVDQAILAEEERLVVIRFGHDWDETCMQMDEVLASVAETIKNFAVIYLVDITEVPDFNTMYELYDPSTVMFSFATSIS

SEQ ID NO: 6561 - protein, 104 aa, Flaveria ramosissima
MQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6562 - protein, 90 aa, Flaveria ramosissima
MSYLLPHLHSGWAVDQAILAEEERLVVIRFGHDWDETCMQMDEVLASVAETIKNFAVIYLVDITEVPDFNTMYELYDPSTVMFFLGTNIS

SEQ ID NO: 6563 - protein, 142 aa, Unknown
  Sequence found in Organisms: Abies balsamea, Zingiber officinale, Medicago truncatula, Pinus taeda, Pseudotsuga menziesii, Picea glauca, Trigonella foenum-graecum, Tripterygium wilfordii
MSYLLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6564 - protein, 142 aa, Ambrosia trifida
MSYLLPHLHSGWAVDQAILAEEERLVVIRFGHDWDETCMQMDEVLASVADTLKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6565 - protein, 142 aa, Antirrhinum majus
MSYLLPHLHSGWAVDQAILAEEERLVIIRFGHDWDETCMQMDEVLASVADTLKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6566 - protein, 142 aa, Unknown
  Sequence found in Organisms: Brassica napus, Brassica juncea, Brassica oleracea, Brassica rapa, Raphanus sativus
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETVFRGARKGRGLVIAPKDYSTKYRY

SEQ ID NO: 6567 - protein, 142 aa, Unknown
  Sequence found in Organisms: Hordeum vulgare, Festuca arundinacea, Avena sativa, Pseudoroegneria spicata, Secale cereale, Triticum aestivum
MSYLLPHLHSGWAVDQAILAEEERLVMIRFGHDWDETCMQMDEVLSGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 6568 - protein, 142 aa, Fagus grandifolia
MSYLLPHLHSGWAVDQAILAEEERLVVIRFGHDWDETCMQMDEVLASVAETIKNFAVLYLVDITEVPDFNTMYELYDPSTVMFFFRNKHIMIDLGTGNNNKINWALKDKQEFIDVVETVFRGARKGRGLVIAPKDYSTKYRY

SEQ ID NO: 6569 - protein, 141 aa, Bupleurum chinense
SYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6570 - protein, 142 aa, Unknown
  Sequence found in Organisms: Centaurea maculosa, Cirsium arvense
MSYLLPHLHSGWAVDQAILAEEERLVVIRFGHDWDETCMQMDEVLASVAETLKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6571 - protein, 142 aa, Coffea canephora
MSYLLPHLHSGWAVDQAILAEEERLVLIRFGHDWDETCMQMDEVLASVAETIKNFAVLYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6572 - protein, 142 aa, Cucurbita pepo
MSYLLPHLHSGWAVDQAILTEEERLVVIRFGHDWDETCMQMDEVLASVAETIKNFAVIYLVDITEVPDFNTMYELYDPSTVMFFFRNKHIMIDLGTGNNNKINWALKDKQEFINIIETVYRGARKGRGLVIAPKDYSTKYRY

SEQ ID NO: 6573 - protein, 142 aa, Unknown
  Sequence found in Organisms: Distylium racemosum, Sciadopitys verticillata
MSYLLPHLHSGWAVDQAILAEEERLVVIRFGHDWDDTCMQMDEVLSSVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6574 - protein, 142 aa, Linum usitatissimum
MSYLLPHLHSGWAVDQSILAEEERLVVIRFGHDWDETCMQMDEVLAGVADTLKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6575 - protein, 142 aa, Fraxinus spp
MSYMLPHLHSGWAVDQAILAEEERLVIIRFGHDWDETCMQMDEVLASVAETLKNFSVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6576 - protein, 142 aa, Gossypium raimondii
MSYLLPHLHSGWAVDQAILAEEERVVIIRFGHDWDETCMQMDEVLASVAEKIKNFAVIYVVDITEVPEFNTMYELYDPSTVMFFFRNKHIMIDLGTGNNNKINWALKDKQEFIDIVETVYRGARKGRGLVIAPKDYSTKYRY

SEQ ID NO: 6577 - protein, 142 aa, Lotus japonicus
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETIYRGARKGRGLVIAPKDYSTKYRY

SEQ ID NO: 6578 - protein, 142 aa, Allium cepa
MSYLLPHLHSGWAVDQAILAEEERLVVIRFGHDWDETCMQMDEVLASVAETIKNFAVIYLVDITEVPDFNTMYELYDPSTIMFFFRNKHIMIDLGTGNNNKINWAMKDKQEFIDIVETVFRGARKGRGLVIAPKDYSTKYRY

SEQ ID NO: 6579 - protein, 142 aa, Phalaenopsis aphrodite
MSYLLPHLHSGWAVDQAILAEEERLVVIRFGHDWDETCMQMDEVLASVAETIKNFAVLYLVDITEVPDFNTMYELYDPSTVMFFFRNKHIMIDLGTGNNNKINWAMKDKQEFIDIVETVFRGARKGRGLVIAPKDYSTKYRY

SEQ ID NO: 6580 - protein, 142 aa, Unknown
  Sequence found in Organisms: Lippia dulcis, Salvia sclarea
MSYLLPHLHSGWAVDQAILAEEERLVLIRFGHDWDETCMQMDEVLASVAETLKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6581 - protein, 142 aa, Pseudoroegneria spicata
MSYLLPHLHSGWAVDQAILAEEERLVLIRFGHDWDETCMQMDEVLSGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 6582 - protein, 142 aa, Solanum phureja
MSYLLPHLHSGWAVDQAILAEEERLVIIRFGHDWDDTCMQMDEVLSSVAETIKNFAVIYLVDITEVPDFNTMYELYDPSTIMFFFRNKHIMIDLGTGNNNKINWALKDKQEFVDIVETVYRGARKGRGLVIAPKDYSTKYRY

SEQ ID NO: 6583 - protein, 142 aa, Fragaria vesca
MSYLLPHLHSGWAVDQAILAEEERVVIIRFGHDWDDTCMQMDEVLAAVADKIKNFAVIYLVDISEVPDFNTMYELYDPSTVMFFFRNKHIMIDLGTGNNNKINWALKDKQEFIDIVETVYRGARKGRGLVIAPKDYSTKYRY

SEQ ID NO: 6584 - protein, 142 aa, Thalictrum flavum
MSYLLPHLHSGWAVDQSILAEEERLVVIRFGHDWDETCMQMDEVLSSVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6585 - protein, 142 aa, Eutrema parvulum
MSYLLPHLHSGWAVDQAILAEEERLVVIRFGHDWDETCMQMDEVLASVAETIKNFAVIYLVDISEVPDFNTMYELYDPSTVMFFFRNKHIMIDLGTGNNNKINWALKDKQEFIDIIETVFRGARKGRGLVIAPKDYSTKYRY

SEQ ID NO: 6586 - protein, 142 aa, Solanum lycopersicum
MSYLLPHLHSGWAVDQAILAEEERLVLIRFGHDWDDTCMQMDEVLSSVAETIKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6587 - protein, 142 aa, Vinca minor
MSYLLPHLHSGWAVDQAILAEEERLVMIRFGHDWDETCMQMDEVLASVAETLKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6588 - protein, 142 aa, Zostera marina
MSYLLPHLHSGWAVDQAILAEEERLVVIRFGHDWDETCMQMDEVLASVAETIKNFAVIYLVDITEIPDFNTMYELYDPSTIMFFFRNKHIMIDLGTGNNNKINWAMKDKQEFIDIVETVYRGARKGRGLVIAPKDYSTKYRY

SEQ ID NO: 6589 - protein, 104 aa, Bupleurum chinense
MQMDEVLASVAETIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6590 - protein, 87 aa, Cedrus atlantica
MSYLLPHLHSGWAVDQAILAEEERLVVIRFGHDWDETCMQMDEVLSSVAETIKNFAVIYLVDITEVPDFNTMYELYDPSTVMFFFPQ

SEQ ID NO: 6591 - protein, 71 aa, Gossypium hirsutum
MYELYDPSTVMFFFRNKHIMIDLGTGNNNKINWALKDKQEFIDIVETVYRGARKGRGLVIAPKDYSTKYRY

SEQ ID NO: 6592 - protein, 105 aa, Fraxinus spp
MSYMLPHLHSGWAVDQAILAEEERLVIIRFGHDWDETCMQMDEVLASVAETLKNFAVIYLVDITEVPDFNTMYELYDPSTIMFFFRNKHIMIDLGTETTTRSTGH

SEQ ID NO: 6593 - protein, 90 aa, Papaver somniferum
MSYLLPHLHSGWAVDQAILAEEERLVVIRFGHDWDETCMQMDEVLSSVAETIKNFAVIYLVDITEVPDFNTMYELYDPSTVMFFSVTNTL

SEQ ID NO: 6594 - protein, 142 aa, Brassica juncea
MSYLLPHLHSGWAVDQSILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETVFRGARKGRGLVIAPKDYSTKYRY

SEQ ID NO: 6595 - protein, 142 aa, Cenchrus ciliaris
MSYLLPHLHSGWAVDQAILAEEERLVIIRFGHDWDETCMQMDEVLAGVAETIKNFAVIYLVDITEVPDFNTMYELYDPSTVMFFFRNKRVMIKIGTGNNNKINWALKDKQEFTDIVETVYRGARKGRGLVIAPKDYSTKYRY

SEQ ID NO: 6596 - protein, 142 aa, Cephalotaxus harringtonia
MSYLLPHLHSGWAVDQAILAEEERLVVIRFGHDWDDTCMQMDEVLSNVAESIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6597 - protein, 142 aa, Unknown
  Sequence found in Organisms: Cryptomeria japonica, Sequoia sempervirens
MSYLLPHLHSGWAVDQAILAEEERLVVIRFGHDWDDTCMQMDEVLSSVAESIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6598 - protein, 142 aa, Euonymus alatus
MSYLLPHLHSGWAVDQAILSEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETLYRGARKGRGLVIAPKDYSTKYRY

SEQ ID NO: 6599 - protein, 142 aa, Guizotia abyssinica
MSYLLAHRQSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6600 - protein, 142 aa, Unknown
  Sequence found in Organisms: Medicago truncatula, Trigonella foenum-graecum
MSYMLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6601 - protein, 140 aa, Capsicum annuum
YLLPHLHSGWAVDQAILAEEERLVIIRFGHDWDETCMQMDEVLASVADTLKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6602 - protein, 142 aa, Triphysaria pusilla
MSYLLPHLHSGWAVDQAILAEEERLVIIRFGHDWDETCMQMDEVLSSVADTLKNFAVIYLVDITEVPDFNTMYELYDPSTVMFFFRNKHIMIDLGTGNNNKINWAMKDKQEFIDIVETIYRGARKGRGLVIAPKDYSTKYRY

SEQ ID NO: 6603 - protein, 104 aa, Ambrosia trifida
MQVDEVLAAVAETLKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6604 - protein, 107 aa, Fraxinus spp
MSYMLPHLHSGWAVDQAILAEEERLVIIRFGHDWDETCMQMDEVLASVAETLKTLLLSTWWISQRCQILTRCMSYMTRHHHVLLQKQAHYDRSWHWKQQQDQLGTEG

SEQ ID NO: 6605 - protein, 200 aa, Phaseolus vulgaris
MSYLLPHLHSGWAVDQAILAEEERLVIIRFGHDWDETCMQMDEVLASVAETLKNFAVVSTQSGHYGGAGFQHDVRALRSFNCYVLFQEQTHHDRSRHWQQQQDQLGSQGQAGVHRHCRDCLPRREEGSWSCHCSQRLLHQIPLLSSSYYALCKDEHVQFIPKNMLTLLTTLSTYLSELIAHVCYSENLFYLSFDEFVVPL

SEQ ID NO: 6606 - protein, 142 aa, Brassica oleracea
  misc_feature (47)..(47): Xaa can be any naturally occurring amino acid
  misc_feature (81)..(81): Xaa can be any naturally occurring amino acid
MSYLLPHLHSGWAVDQAILAEEERLVVIRFGHDWDETCMQMDEVLAXVAETIKNFAVIYLVDISEVPDFNTMYELYDPSTXMFFFRNKHIMIDLGTGNNNKINWAMKDKQEFIDIIETVFRGARKGRGLVIAPKDYSTKYRY

SEQ ID NO: 6607 - protein, 142 aa, Guizotia abyssinica
MSYLLPHLHSGWAVDQAILAEEERLVVIRFGHDWDETCMQMDEVLASVAETIKNFAVIYLVDITEVPDFNTMYERYDPSTVMGCFRNKHIMIDLGTGNNNKINWAMKDKQEFIDIIETVYRGARKGRGLVIAPKDYSTKYRY

SEQ ID NO: 6608 - protein, 142 aa, Tropaeolum majus
MSYLLPHLHSGWAVDQAILAEEERLVVIRFGHDWDETCMQMDEVLASVAETLKNFAVLYLVDITEVPDFNTMYELYDPSTIMFFFRNKHIMIDLGTGNNNKINWAMKDKQEFIDIVETIYRGARKGRGLVIAPKDYSTKYRY

SEQ ID NO: 6609 - protein, 142 aa, Cajanus cajan
MSYLLPHLHSGWAVDQAILSEEERVVVIRFGHDWDDTCMQMDEVLASVAETIKNFAVIYLVDITEVPDFNTMYELYDPCTVMFFFRNKHIMIDLGTGNNNKINWALKDKQEFIDIVETVYRGARKGRGLVISPKDYSTKYRY

SEQ ID NO: 6610 - protein, 142 aa, Podocarpus macrophillus
MSYLLPHLHSGWAVDQAILSEEERLVVIRFGHDWDDTCMQMDEVLSSVAETIKNFAVIYLVDITEVPDFNTMYELYDPSTVMFFFRNKHIMIDLGTGNNNKINWALKDKQEFIDIIETLYRGARKGRGLVIAPKDYSTKYRY

SEQ ID NO: 6611 - protein, 142 aa, Taxus baccata
MSYLLPHLHSGWAVDQAILAEEERLVVIRFGHDWDDTCMQMDEVLSSVAESIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6612 - protein, 142 aa, Vinca minor
MSYLLPHLHSGWAVDQAILAEEERLVIIRFGHDWDETCMQMDEVLASVADTLKNFAVIYLVDITEVPDFNTMYELYDPLTIMFFFRNKHIMIDLGTGNNNKINWAMKDKQEFVDIVETVYRGARKGRGLVIAPKDYSTKYRY

SEQ ID NO: 6613 - protein, 90 aa, Gnetum gnemon
MSYLLPHLHSGWAVDQAILGEEERLVIIRFGHDWDDTCMQMDEVLSSVAETVKNFAVIYLVDITEVPDFNTMYELYDPSTVMFFSATSIL

SEQ ID NO: 6614 - protein, 90 aa, Allium cepa
MSYLLPHLHSGWAVDQAILAEEERLVVIRFGHDWDETCMQMDEVLASVAETIKNFAVIYLVDITEVPDFNTMYELYDPSTIMFFSVTSIS

SEQ ID NO: 6615 - protein, 142 aa, Aquilegia formosa
MSYLVPHLRSGWVVDQAILAEEERLVIIRFGHDWDETCMQMDEVLASVAETVKNFAVIYLVDISEVPDFNTMYELYDPSTVMFFFRNKHMMIDLGTGNNNKINWALKDKQEFIDIVETVYRGAKKGRGLVIAPKDYSTKYRY

SEQ ID NO: 6616 - protein, 140 aa, Arnica chamissonis
YLLPHLHSGWAVDQAILAEEERLVVIRFGHDWDETCMQMDEVLSSVAETLKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6617 - protein, 142 aa, Unknown
  Sequence found in Organisms: Ceratodon purpureus, Physcomitrella patens
MSYLLPHLHSGWAVDQAILAEEERAVVIRFGHDWDETCMQMDEVLASVAETIKNFAVIYLVDISEVPDFNTMYELYDPCTIMFFFRNKHIMIDLGTGNNNKINWALKDKQEFIDIVETVYRGARKGRGLVVSPKDYSTKYRY

SEQ ID NO: 6618 - protein, 139 aa, Gossypium hirsutum
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIIETVYRGARKGRGLVIALKDYLTK

SEQ ID NO: 6619 - protein, 142 aa, Pteridium aquilinum
MSYLLPHLHSGWAVDQAILGEEERAVVIRFGHDWDETCMQMDEVLASVAETIKNFAVIYLVDITEVQDFNTMYELYDPCTIMFFFRNKHIMIDLGTGNNNKINWALKDKQEFIDIVETVYRGARKGRGLVISPKDYSTKYRY

SEQ ID NO: 6620 - protein, 136 aa, Pteridium aquilinum
HLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6621 - protein, 131 aa, Artemisia annua
MALEWVVLGYAAAAEAVMILLLTLPGLTPIRKGLISVTSSLLKPFLSIVPFCLFLLADIYWKYETRPSCNDSDNCSPSEFLRHQKSIMKSQRNALLIATALVFYWILYSVTKLVVKVDVLSARIEKLKNKE

SEQ ID NO: 6622 - protein, 138 aa, Zostera marina
LPHLHSGWAVDQAILAEEERLVVIRFGHDWDETCMQMDEVLASVAETIKNFAVIYLVDITEIPDFNTMYELYDPSTIMFFFRNKHIMIDLGTGNNNKINWAMKDKQEFIDIVETVYRGARKGRGLVIAPKDYSTKYRY

SEQ ID NO: 6623 - protein, 142 aa, Marchantia polymorpha
MSYLLPHLHSGWAVDQAIMAEEERAVVIRFGHDWDETCMQMDEVLASVAETIKNLAVIYLVDITEVPDFNTMYELYDPCTIMFFFRNKHIMIDLGTGNNNKINWALKDKQEFIDIVETVYRGARKGRGLVVSPKDYSTKYRY

SEQ ID NO: 6624 - protein, 142 aa, Medicago truncatula
MSYLLPHLHSGWAVDQAILCEEERLVVIRFGHDWDDTCMQMDEVLASVAETIKNFAVIYLVDITEVPDFNTMYELYDPCTVMFFFRNKHIMIDLGTGNNNKINWALRDKQEFIDIVETVFHGARKGRGLVISPKDYSTKYRY

SEQ ID NO: 6625 - protein, 142 aa, Brachypodium distachyon
MSYLLPHLHSGWAVDQAIMAENERLVMIRFGHDWDETCMQMDEVLAGVAEKIKNFAVTYLVDITEVPDFNTLYELYDPSTVMFFFRNKHIMIDLGTGNNNKINWAMKDKHEFVDIVETVYRGARKGRGLAIAPKDYSTKYRY

SEQ ID NO: 6626 - protein, 136 aa, Epimedium sagittatum
HLHSGWAVDQAILAEEERLVVIRFGHDWDETCMQMDEVLASVAETIKNFAVIYLVDITEVPDFNTMYELYDPSTVMFFFRNKHMMIDLGTGNNNKINWAMKDKQEFIDIIETVYRGARKGRGLVIAPKDYSTKYRY

SEQ ID NO: 6627 - protein, 135 aa, Zostera marina
LHSGWAVDQAILAEEERLVVIRFGHDWDETCMQMDEVLASVAETIKNFAVIYLVDISEVPDFNTMYELYDPSTIMFFFRNKHIMIDLGTGNNNKINWAMKDKQEFIDIVETVYRGARKGRGLVIAPKDYSTKYRY

SEQ ID NO: 6628 - protein, 142 aa, Brachypodium distachyon
MSYLLPHLHSGWAVDQAIMAENERLVMIRFGHDWDETCMQMDEVLAGVAEKIKNFAVTYLVDITEVPDFNTLYELYDPSTVMFFFRNKHIMIDLGTGNNNKINWAMKDKHDFVDIVETVYRGARKGRGLAIAPKDYSTKYRY

SEQ ID NO: 6629 - protein, 146 aa, Senecio madagascariensis
VNQTISYLLPHLHSGCVVYQAILAEEERLVVIRFGHDWDETCMQMDEVLASVAETLKNFAVIYLVDITEVPDFNTMYELYDPSTIMFFFRNKHIMIDLGTGNNNKINWAMKDKQEFIDIVETVYRGARKGRGLVIAPKDYSTKYRY

SEQ ID NO: 6630 - protein, 143 aa, Pinus pinaster
MSYLLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWAMKDKQEFIDIIETVYRGARKGRGLVIAPRIILPSTDTR

SEQ ID NO: 6631 - protein, 142 aa, Brachypodium distachyon
MSYLLPHLHSGWAVDQAIMAENERLVMIRFGHDWDETSMQMDEVLAGVAEKIKNFAVTYLVDITEVPDFNTLYELYDPSTVMFFFRNKHIMIDLGTGNNNKINWAMKDKHEFVDIVETVYRGARKGRGLAIASKDYSTKYRY

SEQ ID NO: 6632 - protein, 105 aa, Brassica rapa
MSYLLPHLHSGRAVDQAILAAEERLVVIRFGHDWDETCMQMDEVLASVAETIKNFAVIYLVDISEVPDFNTMYELYDPLTIMFFFRNKDIMIDLGTGTTTRLIGL

SEQ ID NO: 6633 - protein, 142 aa, Brachypodium distachyon
MSYLLPHLHSGWAVDQAIMAENERLVMIRFGHDWDETCMQMDEVLAGVADKINNFAVTYLVDITEVPDFNTLYELYDPSTVMFFFRNKHIMIDLGTGNNNKINWAMKDKHEFLDIVETVYRGARKGRGLAIAPKDHSTKYRY

SEQ ID NO: 6634 - protein, 145 aa, Carthamus tinctorius
GGEDVVFEPHLHSGWAVDQAILAEEERPVVIRFGHDWDETCMQMDEVLASVAETLKNFAVIYLVDITEVPDFNTMYNLYDPSTIMFFFRNKHIMIDLGTGNNNKINWAMKDKQEFIDIVETVYRGARKGRGLVIAPKDYSTKYRY

SEQ ID NO: 6635 - protein, 102 aa, Arachis hypogaea
MDEVLAAVAETIKSFAVIYLVDITEVPDFNTMYELYDPCTVMFFFRNKHIMIDLGTGNNNKINWALKDKQEFIDIVETVYRGARKGRGLVISPKDYSTKYRY

SEQ ID NO: 6636 - protein, 142 aa, Volvox carteri
MSYLLPHLHSGYAVDQAILAEEDRVVIIRFGHDWEPNCMQMDEVLASVSDQIKNFAVIYLVDITEVPDFNTMYELYDPCTIMFFFRNKHIMIDLGTGNNNKINWAMTDKQEFIDIVEVVYRGARKGRGLVVSPKDYSTKYRY

SEQ ID NO: 6637 - protein, 128 aa, Cirsium arvense
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRG

SEQ ID NO: 6638 - protein, 142 aa, Mesostigma viride
MSYLLPHLHSGWAVDQAILSEEDRVVVIRFGHDWDETCMRMDEVLAGVADVIKNFAVIYCVDTTEIPDFNTMYELYDPCTVMFFFRNKHMMIDLGTGNNNKINWAFTDKQEFIDIVETVYRGARKGRGLVVSPKDYSTKYRY

SEQ ID NO: 6639 - protein, 144 aa, Cirsium arvense
RRRCRTCYRTCTRWAVDQAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIVETVYRGARKGRGLVIAPKDYSTKYRY

SEQ ID NO: 6640 - protein, 102 aa, Medicago truncatula
MDEVLASVAETIKNFAVIYLVDITEVPDFNTMYELYDPCTVMFFFRNKHIMIDLGTGNNNKINWALRDKQEFIDIVETVFHGARKGRGLVISPKDYSTKYRY

SEQ ID NO: 6641 - protein, 132 aa, Glycine max
MSYLLPHLHSEEERVVVIRFGHDWDDTCMQMDEVLASVAEKIKNFAVIYLVDITEVPDFNTMYELYEPCTVMFFFRNKHIMIDLGTGNNNKINWALKDKQEFIDIVETVYRGARKGRGLVISPKDYSTKYRY

SEQ ID NO: 6642 - protein, 136 aa, Selaginella moellendorffii
HLHSGYVVDQAILTEDERVVVIRFGHDWDETCMQMDEVLANVAEPLKNFAVIYLVDITEVPDFNTMYELYDPCTVMFFFRNKHIMIDLGTGNNNKINWALKDKQEFIDIVETVYRGARKGRGLVVSPKDYSTKYRY

SEQ ID NO: 6643 - protein, 143 aa, Capsicum annuum
MSYLLPHLHSGWAVDQAILAEEERLVIIRFGHDWDDTCMQMDEVLSSVAETIKNFAVIYLVDITEVPDFNTMYELYDPSTVMFFFRNKHIMIDLGTGNNNKINWALKDKQEFIDIVRRQCNTRCKKGSWFSYCTKDYSTKYRY

SEQ ID NO: 6644 - protein, 84 aa, Cannabis sativa
MSYLLPHLHSGWAVDQSILAEEERLVIIRFGHDWDETCMQMDEVLASVAETIKNFAVIYPPPPLYGHVFLQEQAHYDRSRNWKQ

SEQ ID NO: 6645 - protein, 127 aa, Trifolium pratense
QAILAEEERLVVIRFGHDWDETCMQMDEVLASVAETIKNFAVIYLVDITEVPDFNTMYELYDPSTVMFFFRNKHIMIDLGTGNNNKINWAMKDKQEFIDIIETVYRGARKGRGLVIAPKDYSTKYRY

SEQ ID NO: 6646 - protein, 126 aa, Avena sativa
AILAEEERLVMIRFGHDWDETCMQMDEVLAGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 6647 - protein, 142 aa, Aquilegia formosa
MSYLVKHLNTGWEVDQEIVREEERLVIIRFGHDWDTTCMQMDEVLVSVAETIKNFAVTYLVDISKVPDFNTMYELYDPCTVMFFYRNKHILIDLGTGNNNKINWALNNKQEFIDIVETVFRGARKGRGLVISPKDYSTKYRY

SEQ ID NO: 6648 - protein, 142 aa, Chlamydomonas reinhardtii
MSYLLPHLRSGYAVDQAILAEEDRVVIIRFGHDWEPNCMQMDEVLAGVADQIKNFACTYLVDISEVPDFNTMYELYDPCTIMFFFRNKHIMIDLGTGNNNKINWPMTDKQEFIDIVEVVYRGARKGRGLVVSPKDYSTKYRY

SEQ ID NO: 6649 - protein, 143 aa, Pinus pinaster
MSYLLPHLHSGWAVDQAILAEEERLVVIRFGHDWDETCMQMDEVLSSVAETIKNFAVIYLVDITEVPDFNTMYELYDPSTVMFFFRNKHIMIDLGTGNNNKINWAMKDKQEFIDIIETVYRGPGRAGVWSLPPRIILPSTDTR

SEQ ID NO: 6650 - protein, 123 aa, Papaver somniferum
SEEERLVVIRFGHDWDETCMQMDEVLASVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6651 - protein, 142 aa, Picea glauca
MSYMLPHLHNGWQVDQAILSEEDRVLVIRFGHDWDPTCMKMDEVLYSIAEKVKNFAVIYLVDITEVPDFNKMYELYDPCTVMFFFRNKHIMIDLGTGNNNKINWTMEDKQEMIDIVETVYRGARKGRGLVVSPKDYSTKYRY

SEQ ID NO: 6652 - protein, 120 aa, Silene vulgaris
ERLVIIRFGHDWDETCMQMDEVLASVAETIKNFAVIYLVDITEVPDFNTMYELYDPSTIMFFFRNKHIMIDLGTGNNNKINWALKDKQEFIDIVETVYRGARKGRGLVIAPKDYSTKYRY

SEQ ID NO: 6653 - protein, 142 aa, Ostreococcus lucimarinus
MSYLLPHLRNGWAVDQAILSEEDRVVVIRFGSDADDTCMRMDETLAGVADKIKNFAIIYLVDISEVPDFNAMYELYDPCTVMFFFRNKHIQIDLGTGNNNKVNWAMDDKQEFIDIVETVYTGARKGRGLVISPRDYSTKYRY

SEQ ID NO: 6654 - protein, 119 aa, Scabiosa columbaria
MSYLLPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIVETV

SEQ ID NO: 6655 - protein, 142 aa, Picea glauca
MSYMLQHLHNGWQVDQAILSEEDRALVIRFGHDWDPTCMKMDEVLYSIAEKVKNFAVIYLVDITEVPDFNKMYELYDPCTVMFFFRTKHIMIDLGTGNNNKINWTMEDKQEMIDIVETVYRGARKGRGLVVSPKDYSTKYRY

SEQ ID NO: 6656 - protein, 51 aa, Adiantum capillus-veneris
MSYLLPHLHFGWAVDQAFLVKKSVSSSSVLAMIGMRLVCRWMRYWPQLQKQ

SEQ ID NO: 6657 - protein, 164 aa, Rhizophora mangle
LKLKSQLLRWAEREEKKEAEGRDVYLPPHLHSGWAVDQAILAEEERLVVIRFGHDWDETCMQMDEVLASVAETIKNFAVIYLVDITEVPDFNTMYELYDPSTVMFFFRNKHIMIDLGTGNNNKINWALKDKQEFIDIIETVYRGARKGRGLVIAPKGYSTKYRY

SEQ ID NO: 6658 - protein, 169 aa, Cucumis sativus
MSYLLPHLHSGWAVDQAILAEEERLVVIRFGHDWDETCMQVFISSIPYSSIPLSQHNWFIIKFNVDHMDEVLASVAETIKNFAVIYLVDITEVPDFNTMYELYDPSTVMFFFRNKHIMIDLGTGNNNKINWALKDKQEFIDIIETVYRGARKGRGLVIAPKDYSTKYRY

SEQ ID NO: 6659 - protein, 102 aa, Manihot esculenta
MDEVLASVAEKIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 6660 - protein, 123 aa, Tamarix hispida
MSYLLPHLHSGWAVDQAILAEEERVVIIRFGHDWDETCMQMDEVLASVAETIKNFAVIYLVDITEVSDFNTMYESYDPCTVMSFFRNKHIMIDLGTGNNNKIDWALKNKQEFIDIVETVYRGA

SEQ ID NO: 6661 - protein, 119 aa, Panax ginseng
MSYLLPHLHSGWAVDQAILAEEERLVVIRFGHDWDETCMQMDEVLASVAETIKNFAVIYLVDITEVPDFNTMYELYDPSTVVFFFRNKHIMIDLGTGNNNKINWAMKDKQEFIDIIETV

SEQ ID NO: 6662 - protein, 140 aa, Conyza canadensis
ILAEEERLVVIRFGHDWDETCMQMDEVLSSVADTLKNFAVIYLVDITEVPDFNTMYELYDPSTVMFFFRNKHIMIDLGTGNNNKINWAMKDKQEFIDIVETVYRGARKGRGLVIAPKDYSPLLKPFSCHWWCMAWTMSCN

SEQ ID NO: 6663 - protein, 118 aa, Pseudoroegneria spicata
MEKENHKEGEGATAWMTVPAFGDWDMKNGAMPDYSMDFSKIREMRKQNKKELSRASLGGDDDLLAHHKQQQQQQQPAKAPQPTKLGAPAKDHGPLHGRDDSPTGRKRFLSYFQCCIKA

SEQ ID NO: 6664 - protein, 119 aa, Secale cereale
MEKDNHKEGEGATAWMTVPAFGDWDMKNGAMPDYSMDFSKIREMRKQNKKELSRASLGGDDDLLAHHKQHQQQQQKPVKAPQPTKLGAPAKDHGPLHGRDDSPTGRKRFLSYFQCCIKA

SEQ ID NO: 6665 - protein, 119 aa, Secale cereale
MEKDGHKEGEGATAWMTVPAFGDWDMKNGAMPDYSMDFSKIREMRKQNKKELSRASLGGDDDLLAHHKQHQQQQQKPAKAAQPTKLGAPAKDHGPLHGRDDSPTGRKRFLSYFQCCIKA

SEQ ID NO: 6666 - protein, 119 aa, Secale cereale
MEKDSHKEGEGATAWMTVPAFGDWDMKNGAMPDYSMDFSKIREMRKQNKKELSRASLGGDDDLLAHHKQHQQQQQKPVKAPQPTKLGAPAKDHGPLHGRDDSPTGRKRFLSYFQCCIKA

SEQ ID NO: 6667 - protein, 523 aa, Triticum aestivum
MEQTSFLFQQASKVGFSHSRILRTIVQHACSRFPSLVTSNNAWTALSRKMQSAKQALIIPNGTCKQKAFVIFGGDTSERQVSLMSGTNVWLNLQGFDDLDVTPCLLAPSNGYSPHNEDFSGSARDVWTLPYSLVLRHTTEEVHAACFEAIEPERVEITTRLRDQVMKELERALSKQDWFAGFDITDEQPIKYSLQQWIDYVKEAKAVVFIAVHGGIGEDGTIQSLLESAGVPYTGPGPIASRTCMDKVATSLAVDHLASYGIHTIPKDVRATEELLKSSLVDIWNDLKAKLQTETVCVKPARDGCSTGVARLRCPEDLEVYANALRGKLPRLPANCLSRAHGVIEMPVPPPESLIFEPFIETDEIIISNKSRNDSTRHLVWKGENEWLEVTVGVVGKRGEMHSLNPSITVKESGDILSLEEKFQGGTGINLTPPPATIMSEDALEKCKKCIEMMANTLGLEGFSRIDAFVNVRSGEVLLIEVNTVPGMTPSTVLIHQALTEEPPIYPHKFFRTLLDLAFARAD

SEQ ID NO: 6668 - protein, 860 aa, Secale cereale
RGISLNSARSVLDHIQGEDLLVSCYYIDCGMNAFAISPAQLYSNTPSDFDFKLESLAQEFGSLAEFAEHLAANVDIVFPVIHGKFGEDGGIQELLEKANVPFVGTPSNECLRAFDKHNASLELNAQGFLTVPNFLVEKDKLARSELEEWFGSIGLNKENGKVIVKPTRAGSSIGVVVAYGANDAAEKAKGIFSEEIDDKVIIEVFLEGGCEFTAIVLDVGTANNSEPIVLLPTEVELQSSITSDIQEDTIFNYRRKYLPTQQVAYHTPPRFPAEVIDCIRQGVSLLFRHFGLRDFARIDGWFLPTPATSLTSSENGGKFGNTEYGTVLFTDINLISGMEQTSFLFQQASKVGFSHSRILRTIVQHACSRFPSLVPSNNAWTALSRKMQSAKQAEIIQNGTCKQKAFVIFGGDTSERQVSLMSGTNVWLNLQGFDDLDVTPCLLAPSNGYSSHNQDFSEISCDVWTLPYSLVLRHTTEEVHAACFEAIEPERVEITSRLRDQVMKELERALSKQDWFAGFDITDEQPVKYSLQQWIDYVKEAKAVVFIAVHGGIGEDGTMQSLLESAGVPYTGPGPIASRTCMDKVATSLAVDHLASYGIHTIPKDVRATEELLKSSLVDIWNDLKAKLQTETVCVKPARDGCSTGVARLRCSEDLEVYANALRGKLPRLPANCLSRAHGVIEMPVPPPESLIFEPFIETDEIIISNKSRNDSTRHLVWKGENEWLEVTVGVVGKRGEMHSLNPSITVKESGDILSLEEKFQGGTGINLTPPPATIMSEDALQKCKGCIEMMANTLGLEGFSRIDAFVNVRSGEVLLIEVNTVPGMTPSTVLIHQALTEEPPIYPHKFFRTLLDLAFARAD

SEQ ID NO: 6669 - protein, 943 aa, Hordeum vulgare
MLLSLAQPRLPSPATTTASTARPRALALAPRRALPSAAKTASATGRLHAVVSERAVDGMAPAPAGREGWPLRVGLVCGGPSAERGISLNSARSVLDHIQGEDLLVSCYYIDCGMNAFAISPAQLYSNTPSDFDFKLESLAQEFGSLTEFAEHLAANVDIVFPVIHGKFGEDGGIQGLLEKANVPFVGTPSNECLRAFDKHNASLELNAQGFLTVPNFLVEKDKLVSSELEEWFGRIGLNKENGKVIVKPTRAGSSIGVVVAYGANEAVEKAEGIFSEEIDDKVIIEVFLEGGCEFTAIVLDVGTANNSEPIVLLPTEVELQSSITSDIQEDTIFNYRRKYLPTQQVAYHTPPRFPAEVIDCIRQGVSLLFRHFGLRDFARIDGWFLPTPATSLTSSENGGKFGNTEYGTVLFTDINLISGMEQTSFLFQQASKVGFSHSRILRTIVQHACSRFPSLVPSNNAWTALSRRIQSAKQAEIIQNGTCKQKAFVIFGGDTSERQVSLMSGTNVWLNLQGFDDLDVTPCLLAPSNGYSSHNENFSESSRDVWTLPYSLVLRHTTEEVHAACFEAIEPERVEITSRLRDQVMKELERALSKQDWFAGFDITDEQPIKYSLQQWIDHVKEAKAVVFIAVHGGIGEDGTIQSLLESAGVPYTGPGPIASRTCMDKVATSLAVDHLASYGIHTIPKDVRATKELLKSSLVDIWNDLKAKLQTETVCVKPARDGCSTGVARLRCPEDLKVYANALRGKLPRLPANCLSRAHGVIEMPVPPPESLIFEPFIETDEIIISNKSRSDSTRHLVWKGENEWLEVTVGVVGRRGEMHSLNPSITVKESGDILSLEEKFQGGTGINLTPPPATIMSEDALQKCKKCIEMMANTLGLEGFSRIDAFVNVRSGEVLLIEVNTVPGMTPSTVLIHQALTEEPPIYPHKFFRTLLDLAFARAG

SEQ ID NO: 6670 - protein, 869 aa, Triticum aestivum
LVCGGPSAERGISLNSARSVLDHIQGEDLLVSCYYIDCGMNAFAISPAQLYSNTPSDFDFKLESLAQEFSTLSEFAEHLATNVDIVFPVIHGKFGEDGGIQELLEKANVPFVGTPSNECLRAFDKHNASLELDAQGFLTVPNFLVEKDKLARSELEEWFGSINLNKENGKVIVKPTRAGSSIGVVVAYGANEAAEKAEGIFSEGIDDKVIIEVFLEGGCEFTAIILDVGTANNSEPIVLLPTEVELQSSISSDIQEDTIFNYRRKYLPTQQVAYHTPPRFPAEVIDCIRQGVSLLFRHFGLRDFARIDGWFLPTPATSLTSSENGGKFGNTEYGTVLFTDINLISGMEQTSFLFQQASKVGFSHSRILRTIVQHACSRFPSLVPSNNAWTALSRKMQSAKQAEIIQNDTCKQKAFVIFGGDTSERQVSLMSGTNVWLNLQGFDDLDVTPCLLAPSNGYSPHNEDFSGSARDVWTLPYSLVLRHTTEEVHAACFEAIEPERVEITTRLRDQVMKELERALSKQDWFAGFDITDEQPIKYSLQQWIDYVKEAKAVVFIAVHGGIGEDGTIQSLLESAGVPYTGPGPIASRTCMDKVATSLAVDHLASYGIHTIPKDVRATEDLLKSSLADIWIDLKAKLQTETVCVKPARDGCSTGVARLRCLEDLEVYANALSGKLPRLPANCLSRAHGVIEMPVPPPESLIFEPFIETDEIIISNKSRNDSTRHLVWKGENEWLEVTVGVVGKRGEMHSLNPSITVKESGDILSLEEKFQGGTGINLTPPPATIMSEDALQKCKNCIEMMANTLGLEGFSRIDAFVNVHSGEVLLIEVNTVPGMTPSTVLIHQALTEEPPIYPHKFFRTLLDLAFARAD

SEQ ID NO: 6671 - protein, 912 aa, Triticum aestivum
RRAHSSAAETAAAGRLRAVVSERAVDGMAPAAAGQEGRPLRVGLVCGGPSAERGISLNSARSVLDHIQGDDLLVSCYYIDCGMNAFAISPAQLYSNTPSDFDFKLESLAQEFSTLSEFAEHLATNVDIVFPVIHGKFGEDGGIQELLEKANVPFVGTPSNECLRAFDKHNASLELDAQGFLTVPNFLVEKDKLARSELEEWFGSIGLNKENGKVIVKPTRAGSSIGVVVAYGANEAAEEAEGIFSEEIDDKVIIEVFLEGGCEFTAIILDVGTANNSEPIVLLPTEVELQSSITNDIQEDTIFNYRRKYLPTQQVAYHTPPRFPAEVIDCIRQGVSLLFRHFGLRDFARIDGWFLPTPATSLTSSENGGKFGNTEYGTVLFTDINLISGMEQTSFLFQQASKVGFSHSRILRTIVQHACSRFPSLVPSNNAWTALSRKMQSAKQAEIIQNDTCKQKAFVIFGGDTSERQVSLMSGTNVWLNLQGFDDLDVTPCLLAPSNGYSPHNEDFSGSARDVWTLPYSLVLRHTTEEVHAACFEAIEPERFEITTRLRDQVMKELERALSKQDWFAGFDITDEQPIKYSLQQWIDYVKEAKAVVFIAVHGGIGEDGTIQSLLESAGVPYTGPGPIASRTCMDKVATSLAVDHLASYGIHTIPKDVRATEDLLKSSLADIWIDLKAKLQTETVCVKPARDGCSTGVARLRCLEDLEVYANALSGKLPRLPANCLSRAHGVIEMPVPPPESLIFEPFIETDEIIISNKSRNDSTRHLVWKGENEWLEVTVGVVGKRGEMHSLNPSITVKESGDILSLEEKFQGGTGINLTPPPATIMSEDALQKCKSCIEMTANTLGLEGFSRIDAFVNVHSGEVLLIEVNTVPGMTPSTVLIHQALTEEPPIYPHKFFRTLLDLAFARAG

SEQ ID NO: 6672 - protein, 695 aa, Triticum aestivum
PTRAGSSIGVVVAYGANEAAEKAEGIFSEGIDDKVIIEVFLEGGCEFTAIVLDVGTANNSEPIVLLPTEVELQSSISSDIQEDTIFNYRRKYLPTQQVAYHTPPRFPAEVIDCIRKGVSLLFRHFGLRDFARIDGWFLPSPATSLPSSENGVKFGNTEYGAVLFTDINLISGMEQTSFLFQQASKVGFSHSRILRTIVQHACSRFPSLVTSNNAWTALSRKMQSAKQALIIPNGTCKQKAFVIFGGDTSERQVSLMSGTNVWLNLQGFDDLDVTPCLLAPSNGYSSHNEDFSESSRDVWTLPYSLVLRHTTEEVHAACFEAIEPERVEITSRLRNQVMKELERALSKQDWFAGFDITDEQPIKYSLQQWIDYVKEAKAVVFIAVHGGIGEDGTIQSLLESAGVPYTGPGPIASRTCMDKVATSLAVDHLASYGIHTIPKDVRAREELLKSSLVDIWNDLKAKLQTETVCVKPARDGCSTGVARLRCPEDLEVYANALRGTLPRLPANCLSKAHGVIEMPVPPPESLIFEPFIETDEIIISNKSWNDSTRHLVWKGENEWLEVTVGVVGKRGEMHSLNPSITVKESGDILSLEEKFQGGTGINLTPPPATIMSEDALQKCKSCIEMTANTLGLEGFSRIDAFVNVHSGEVLLIEVNTVPGMTPSTVLIHQALTEEPPIYPHKFFRTLLDLAFARAG

SEQ ID NO: 6673 - protein, 946 aa, Brachypodium distachyon
MLLLSLAQAPPLLLPATTPRAPSRRREPASASLRRLASRARGVSVAPRPVRAVVAGREAEGMAAAGAEQEGRPLRVGLVCGGPSAERGISLNSARSVLDHIQGEDLLVSCYYIDCGMNAYGISPAQLYSNTPSDFDFKLESLAQEFRSLSEFTEHLAANVDIVFPVIHGKFGEDGSIQELLEKTNVPFVGTPSNECRRAFDKHSASIELNAQGFLTVPNFLVEKDKLAKSELEQWFQSINLNKENGKVVVKPTRAGSSIGVVVAYGANDAAEKAEGIISEGIDDKVIVEVFLEGGCEFTAIVIDVGTANTSEPVVLLPTEVELQSSGNNDIQEDTIFNYRRKYLPTRQVTYHTPPRFPPEVIGCIRQGVSLLFRHLGLRDFARIDGWFLPTPVSTLSSGENGGRFGNTEYGTVLFTDINLISGMEQTSFLFQQASKVGFSHSRILRTIVQHACSRFPSLVPCNNSWTALSRKMQSAKQAEVIQNGTHKQKAFVIFGGDTSERQVSLMSGTNVWLNLQGFEDLDVTPCLLTPANGYSSSHNQDGESSRDVWTLPYSLVLRHTTEEVHAACLEAIEPERVEITSRLRDQVMKELEQALSKQDWFAGFDIADEQPTKYSLQQWIDHVKEAKAVVFVAVHGGIGEDGTIQLMLESAGVPYTGPGPIASRTCMDKVATSLAVDHLAGYGIHTIPKGVRETDELLSSSLVDIWNDLKSKLQTETVCVKPARDGCSTGVARLCCPEDLEVYVTALRRKLQRLPANCLSRAHGVIEMPVPPPESLIFEPFIETDEIIISNKSRDDSARHLVWKGEKEWLEVTVGVVGKCGEMHSLNPSITVKESGDILSLEEKFQGGTGINLTPPPATIMSEDALRKCKSCIEMMANTLGLEGFSRIDAFVNVRNGEVLLIEVNTVPGMTPSTVLIHQALTEDPPIYPHKFFRTLLDLAFARAN

SEQ ID NO: 6674 - protein, 665 aa, Avena sativa
EGIDDKVIIEVFLEGGCEFTAIVIDVGNSEPVVLLPTEVELQSFSNTDIEEDTIFNYRRKYLPTQQVAYHTPPRFPAEVIDCIRKGVSLLFQHFGLRDFARIDGWFLPTPATSLLSSENGGKFGNTEYGTVLFTDINLISGMEQTSFLFQQASKVGFSHSRILRTIVQHACSRFPSLVPRNNAWTALFREMQSAKQAEVIQNGTCKQKAFVIFGGDTSERQVSLMSGTNVWLNLQGFDDLDVTPCLLTPANGYSSSHNNDFSESSRDVWTLPYSLVLRHTTEEVCAACFEAIEPERVEITSRLRGQVMKELEQGLRKKDWFAGFDIADEQPTKYSLEQWINHVKEAKAVVFIAVHGGIGEDGTIQSLLESAGVPYTGPGPIASRTCMDKVATSLAVDHLASYGIHTIPKDVRLSEELVQTSRVDIWNELKAKLQTETVCVKPARDGCSTGVARLCCPEDLEVYTNALRRKLQRLPANCLSRAHGVIEMPVPPPESLIFEPYIETDEIIISNESRDDSSRHLVWKGKKEWLEITVGVVGKRGEMHSLNPSITVKESGDILSLEEKFQGGTGINLTPPPATIMSEAALQKCKSCIETMANTLGLEGFSRIDAFVNVRSGEVLLIEVNTVPGMTPSTVLIHQALTEEPPIYPHKFFRTLLDLAFARAN

SEQ ID NO: 6675 - protein, 723 aa, Triticum aestivum
KDKLAKSQLEEWFGSINLNKENGKVIVKPTRAGSSIGVVVAYGANEAAEKAEGIFSEGIDDKVIIEVFLEGGCEFTAIVLDVGTANNSEPIVLLPTEVELQSSISSDIQEDTIFNYRRKYLPTQQVAYHTPPRFPAEVIDCIRKGVSLLFRHFGLRDFARIDGWFLPSPATSLPSSENGVKFGNTEYGAVLFTDINLISGMEQTSFLFQQASKVGFSHSRILRTIVQRACSRFPSLVSSNNAWTALSRKMQSAKQAEIIQNGTCKQKAFVIFGGDTSERQVSLMSGTNVWLNLQGFDDLDVTPCLLAPSSGCSSHNQDLSKSSRDVWTLPYSLVLRHTTEEVHAACFEAIEPERVEITSRLRDQVMKELQQALSKQDWFAGFDITDEQPIKYSLQQWIDYVKEAKAVVFIAVHGGIGEDGTIQSLLESAGVPYTGPGPIASRTCMDKVATSLAVDHLASYGIHTIPKDVRATEELLKSSLVDIWNDLKAKLQTETVCVKPARDGCSTGVARLRCPEDLEVYANALRGKLPRLPANCLSRAHGVIEMPVPPPESLIFEPFIETDEIIISNKSRNDSTRHLVWKGENEWLEVTVGVVGKRGEMHSLNPSITVKESGDILSLEEKFQGGTGINLTPPPATIMSEDALEKCKKCIEMMANTLGLEGFSRIDAFVNVRSGEVLLIEVNTVPGMTPSTVLIHQALTEEPPIYPHKFFRTLLDLAFARAE

SEQ ID NO: 6676 - protein, 946 aa, Setaria italica
MPLPRPQALLLPRFASPTPRLIRVLAPPRRALVSSPPLGFASAARGLPAPLRAAVSAEQREPGIEAGEQGRPLRVGLVCGGPSAERGVSLNSARSVLDHIQGDDLVVSCYYIDSGMNAFAISPAQLYSNTPSDFDFKLESLAQGFHSLSDFAEHLSTNVDIAFPVIHGKFGEDGGIQELLENANVPFVGTSSKECQRAFDKHSASLELDVQGFLTVPNFLVEKDKLAKRELEAWFQTTNLSKENGKVIVKPTRAGSSIGVVVAYGVNDAAQKAEEIISEGIDDRVIVEVFLEGGTEFTAIVVDVGAANNSEPVVLLPTEVELQHSSSSDSKEDTIFNYRRKYLPTQQVVYHTPPRFPAEVIDCIRQGLSVLFRRLGLHDFARIDGWFLPSPVTSLPSAENSGKFGNTKYGTILFTDINLVSGMEQTSFLFQQASAVGFSHSQILRTVVQHACSRFPSLVPFNNARTALSRKLQPSKQAESIQKGTSRQKVFVIFGGDTSERQVSLMSGTNVWLNLQGFDDLDVTPCFLAPANGYFSSHDQDFSDISREVWMLPYSLVLRHTTEEVHAACVEATEPERVEITSRLREQVMNELGPALSKHDWFAGFDIAYEQPIKYSLQQWINHAKEVGAVVFIAVHGGIGEDGTIQTLLESAGVPYTGPGPLASRTCMNKVATSLAVEHLTSYGVHTIPKDVRATEEVLKSSLVDIWNELKAKLQTETVCVKPARDGCSTGVARLCCPKDLEVYTNALRKKFQRLPANCLSRAHGVIEMPVTPPESLIFEPFIETDEIIISNKLENGSARHLVWKGENDWLEITVGVVGKRGEMHSLNPSITVKESGDILSLEEKFQGGTGINLTPPPATIMSEDALQRCKRSIEMMANSLGLEGFSRIDAFVNVRSGEVLLIEVNTVPGMTPSTVLIHQALAEEPPVYPHKFFRTLLDLAFERAK

SEQ ID NO: 6677 - protein, 737 aa, Pennisetum glaucum
DAQGFLTVPNFLVEKDKLVKRELEAWFQTTNLSRENGKVIVKPTRAGSSIGVVVAYGVNDAAQKAEEIISKGIDDRVIVELFLEGGTEFTAIVVDVGTANNSEPVVLLPTEVELQYSSSSDSKEDAIFNYRRKYLPTRQVVYHTPPRFPAEVIDCIRQGLSLLFRRLALHDFARIDGWFLPSPVTSLPSAENSRKFGNTKHGTILFTDINLVSGMEQTSFLFQQASAVGFSHSRILRTVVQHACSRFPSLVPCNNAWTALSRKLQPSKQAESIHKGISRQKVFVIFGGDTSERQVSLMSGTNVWLNLQGFDDLDVTPCFLAPANGYFSSPDQDFSDISREVWMLPYSLVLRHTTEEVHAACVEATEPERIEITSRLREQVMNELGPALRKHDWFAGFDIAYEQPIKYSLQQWINHAKEAGAVVFIAVHGGIGEDGTIQTLLESAGVPYTGPGPLASRTCMNKVATSLAVDHLSSYGVHTIPKDVRTTEEVLKSSLVDIWNELKAKLQTETVCVKPARDGCSTGVARLCSPKDLEVYTNALRKKLQRLPANCLSRAHGVIEMPVPPPESLIFEPFIETDEIIISNKLENGSARHLVWKGENDWLEITVGVVGKRGEMHSLNPSITVKESGDILSLEEKFQGGTGINLTPPPATIMSEDALQRCKQSIEMMANSLGLEGFSRIDAFVNVRSGEVLLIEVNTVPGMTPSTVLIHQALAEEPPVYPHKFFRTLLDLAFERA

SEQ ID NO: 6678 - protein, 945 aa, Sorghum bicolor
MLLSRPQTLPLPLPRARAPLSSPTLRHLRALVSSPPLGFASAARGLAPLRLRAVVSDHEQRGMEAGEQGRPLRVGLICGGPSGERGVSLNSARSVLDHIQGEDLVVRCYYIDSAMKAFAISPAQLYSNTPSDFDFKLESLAQGFDSLSDFAEHLAINVDIVFPVIHGKFGEDGGIQELLEKANVPFVGTPSKECERAFDKHNASLELNAQGFLTVPNFLVEKDKLAKPELEAWFKTVNLNKENGKVIVKPTRAGSSIGVVVAYGVNDAAQKAEEIISEGIDDKVIIEVFLEGGTEFTAIVVDVGTANNSQPVVLLPTEVELQYSNSSDTDEDTIFNYRKKYLPSRQVAYHSPPRFPAEVIDCIRQGISLLFRRFGLHDYARVDGWFLPSPVASLSSAENSEKFGNTKYGTVLFTDINLISGMEQTSFLFQQASAVGFSHSRILRTVVQHACSRFPSLVPCNNAWTALSRKLQPSKQIGAIHKGTSRQKVFVIFGGDTSERQVSLMSGTNVWLNLQGFDDLDVTPCLLAPANGYFSSHDQVFSDTSREVWTLPYSLVLRHTTEEVHAACVEATEPERVKMTKRLRDQVMNELGPALSKHDWFAGFDIAYEQPIKYSLQQWIDHVKETEAVVFIAVHGGIGEDGTIQTLLESAGVPFTGPGPIASRTCIDKVASSLAVDHLASYGVHTIPKDVRATEEVLKSSLVDIWNELKAKLRTETVCVKPARDGCSTGVARLCCPKDLEVYTNALRRKFQHLPANCLSRAHGVIEMPVPPPESLIFEPFIETDEIIISNKLGNGSARHLVWKGENDWLEITVGVVGKRGEMHSLNPSITVKESGDILSLEEKFQGGTGINLTPPPATIMGEDALQRCKKSIEMMANALGLEGFSRIDAFVNVRSGEVLLIEVNTVPGMTPSTVLIHQALAEEPPVYPHKFFRTLLDLAFTRAK

SEQ ID NO: 6679 - protein, 950 aa, Zea mays
MLLSRPQTLPLPRARLSSPTLRHLRALAAPLRALVSSPPLGFTSAARGPAPLRAAVSESDREQREAGVEAGEQGRPLRVGLVCGGPSGERGVSLNSARSVLDHIQGEDLVVCCYYIDCAMKAFAISPAQLYSNTPSDFDFKLESLAQEFDSLSDFAEHLATNVDIVFPVIHGKFGEDGGIQELLEKANVPFVGTPSKECQRAFDKHNASLELNAQGFLTVPNFLVEKDKLAKPELEAWFQTVNLNKENGKTIVKPTRAGSSIGVVVAYGVNDAAQKAEEIISEGIDDKVIIEVFIEGGTEFTAIVVDVGIANNSEPVVLLPTEVELQYSNNSDTKEDTIFNYRKKYLPSRQVAYHSPPRFPAEVIDCIRQGISLLFCRLGLHDYARIDGWFLPSPVASLPPAENSDKFGNTKYGSVLFTDINLISGMEQTSFLFQQASAVGFSHSRILRTVVQHACSRFPSLLPCNNAWTALSRKLQPSKQVEAIHKGTSRQKVFVIFGGDTSERQVSLMSGTNVWLNLQGFDDLDVTPCLLAPAHGYFSSHDQDFSDSSREVWTLPYSLVLRHTTEEVHAACVEATEPERVEITKRLRDQVMNELGSALSKHDWFAGFDIAYEQPIKYSLQQWIDHVKETEAVVFIAVHGGIGEDGTIQTLLESAGVPYTGPGPIASRTCIDKVASSLAVDHLASYGIRIIPKDVRATEEVLNSSLVDIWNELKAKLETETVCVKPARDGCSTGVARLCCPKDLEVYTNALRRKFQHLPANCLSRAHGVIEMPVPSPESLIFEPFIETDEIIIANKLEDGSARHLVWKGENDWLEITVGVVGKRGEMHSLNPSITVKESGDILSLEEKFQGGTGINLTPPPATIMGEDALQRCKKSIETMANALGLEGFSRIDAFVNVRSGEVLLIEVNTVPGMTPSTVLIHQALAEEPPVYPHRFFRTLLDLVFARAK

SEQ ID NO: 6680 - protein, 339 aa, Sorghum bicolor
MERYEVIKDIGSGNFGVAKLVRDVRTKELFAVKFIERGMKIDENVQREIMNHRSLRHPNIVKFKEVVLTPTHLAIVMEYAAGGELFERICKAGRFSEDEARFFFQQLISGVSYCHSMQICHRDLKLENTLLDGSIAPRLKICDFGYSKSSVLHSQPKSTVGTPAYIAPEVLARKEYDGKVADVWSCGVTLYVMLVGAYPFEDPDEPKNFRKTLTRILSVQYAVPDFVRVSMECRHLLSRIFVAIPEQRITIPEIKNHPWFLKNLPIEMTDEYQMNLQLVDMNGPSQSLEEIMTIIQEARKPGDGLKHSGQLPGLGSMELDDIDVDDIDVEDSGDFVCAL

SEQ ID NO: 6681 - protein, 339 aa, Saccharum officinarum
MERYEVIKDIGSGNFGVAKLVRDVRTKELFAVKFIERGMKIDENVQREIMNHRSLRHPNIVKFKEVVLTPTHLAIVMEYAAGGELFERICKAGRFSEDEARFFFQQLISGVSYCHSMQICHRDLKLENTLLDGSIAPRLKICDFGYSKSSVLHSQPKSTVGTPAYIAPEVLARKEYDGKVADVWSCGVTLYVMLVGAYPFEDPDEPRNFRKTLTRILSVQYAVPDFVRVSMECRHLLSRIFVANPEQRITIPEIKNHPWFLKNLPIEMTDEYQRNLQPVDMNAPSQSLDEIMAIIQEARKPGDGLKHSGQLPGLGSMELDDIDVDDIDVEDSGDFVCAL

SEQ ID NO: 6682 - protein, 339 aa, Panicum virgatum
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDGSIAPRLKICDFGYSKSSVLHSQPKSTVGTPAYIAPEVLAKREYDGKVADVWSCGVTLYVMLVGAYPFEDPDEPKNFRKTLTRILSVQYAIPDFVRVSMECRHLLSRIFVANPEQRITIPEIKNHPWFLKNLPIEMTDEYQMSVLMTDMNVPSQSLEEIMAIIQEARKPGDGMKLTGQIPGLGSMELDDIDVDDIDVEDSGDFVCAL

SEQ ID NO: 6683 - protein, 339 aa, Setaria italica
MERYEVIKDIGSGNFGVAKLVRDVRTKDLFAVKFIERGMKIDENVQREIMNHRSLRHPNIVKFKEVVLTPTHLAIVMEYASGGELFERICNAGRFSEDEARFFFQQLISGVSYCHSMQICHRDLKLENTLLDGSIAPRLKICDFGYSKSSVLHSQPKSTVGTPAYIAPEVLARKEYDGKVADVWSCGVTLYVMLVGAYPFEDPDEPKNFRKTLTRILSVQYAIPDFVRVSMECRHLLSRIFVANPEQRITIPEIKNHPWFLKNLPIEMTDEYQMSVLTADMNFPSQSLEEIMAIIQEARKPGDGMKLTGQLPGLGSMELDDIDVDDIDVDDSGDFVCAL

SEQ ID NO: 6684 - protein, 339 aa, Pennisetum glaucum
MERYEVIKDIGSGNFGVAKLVRDVRTKELFAVKFIERGMKIDENVQREIMNHRSLRHPNIVKFKEVVLTPTHLAIVMEYAAGGELFERICNSGRFSEDEARFFFQQLISGVSYCHSMQICHRDLKLENTLLDGSIAPRLKICDFGYSKSSVLHSQPKSTVGTPAYIAPEVLARKEYDGKVADVWSCGVTLYVMLVGAYPFEDPDEPKNFRKTLTRILSVQYAIPDFVRVSMECRHLLSRIFVASPEQRITIPEIKNHPWFLKNLPIEMTEEYQMTVLTADMNSPSQSLENIMAIIQEARTPGDGMKLTGQLPGLGSMELDDIDVDDIDVDDSGDFVCAL

SEQ ID NO: 6685 - protein, 339 aa, Panicum virgatum
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDGSIAPRLKICDFGYSKSSVLHSQPKSTVGTPAYIAPEVLAKRVYDGKVADVWSCGVTLYVMLVGAYPFEDPDEPKNFRKTLTRILSIQYAIPDFVRVSMECRHLLSRIFVANPEQRISIPEIKNHPWFLKNLPIEMTDEYQISVLMTDMNVPSQSLEEIMAIIQEARKPGDGMKLTGQIPGLGSMELDDIDVDDIDVEDSGDFVCAL

SEQ ID NO: 6686 - protein, 339 aa, Panicum virgatum
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDGSIAPRLKICDFGYSKSSVLHSQPKSTVGTPAYIAPEVLAKRVYDGKVADVWSCGVTLYVMLVGAYPFEDPDEPKNFRKTLTRILSIQYAIPDFVRVSMECRHLLSRIFVANPEQRISIPEIKNHPWFLKNLPIEMTDEYQISVLMTDMNVPSQSLEEIMAIIQEARKPGDGMKLTGQIPGLGSMELDDIDVDDIDMEDSGDFVCAL

SEQ ID NO: 6687 - protein, 341 aa, Brachypodium distachyon
MERYEVIKDLGSGNFGVAKLVRDVRTKELFAVKFIERGHKIDENVQREIMNHRSLRHPNIVRFKEVVLTPTHLAIVMEYAAGGELFERICSTGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPVEPKNFRKTITRILSVQYAVPDYVRISMECRHLLSRIFVANPEQRITIPEIKNHPWFLKNLPIEMTDEYQLRLQMVGINAPSQTLEDSMAIIQEARKPGDGSKFAGQLCVPGLGSMELDDIDADDIDVEDSGDFVCAL

SEQ ID NO: 6688 - protein, 341 aa, Triticum aestivum
MERYEVIKDIGSGNFGVAKLVRDVRTKELFAVKFIERGHKIDENVQREIMNHRSLRHPNIVRFKEVVLTPTHLAIVMEYAAGGELFERICGSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYSVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDVDVEDSGDFVCAL

SEQ ID NO: 6689 - protein, 341 aa, Triticum aestivum
MERYEVIKDIGSGNFGVAKLVRDVRTKELFAVKFIERGHKIDENVQREIMNHRSLRHPNIVRFKEVVLTPTHLAIVMEYAAGGELFERICSSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYAVPDYVRISMECRHLLSRIFVANPEQRITIQEIKNHPWFLKNLPIEMTDEYQMSLHMVGVNAPPQTLEEVMAIIQEARIPGDGSKFAGQLSVPGLGSMELDDIDDVDADVEDSGDFVCAL

SEQ ID NO: 6690 - protein, 122 aa, Avena sativa
MNHRSLRHPNIVRFKEVALTPTHLAIVMEYAAGGELFERICGSGRFSENEARFFFQQLLSGVSYCHSMQICHRDLKLENTLLDGSEAPRLKICDFGYSKSSVLHSQLNQPLGLQLTSLRSPF

SEQ ID NO: 6691 - protein, 342 aa, Saccharum officinarum
MERYEVIRDIGSGNFGVAKLVRDVSTKELFAVKFIERGQKIDEHVQREIMNHRSLKHPNIIRFKEVVLTPTHLAIVMEYAAGGELFERICNAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVSTECRHLLSRIFVGNPEQRITIPEIKNHPWFLKNLPIEMTDEYQQSMQLADMNTPGQSLEEVMAIIQEARKPGDAVTLAGHLPCLGSMDLDDIDSDDIDDIDIENSGDFVCAV

SEQ ID NO: 6692 - protein, 342 aa, Pennisetum glaucum
MERYEVIRDIGSGNFGVAKLVRDVTTKELFAVKFIERGQKIDEHVQREIMNHRSLKHPNIIRFKEVVLTPTHLAIVMEYAAGGELFERICNAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPRNFRKTITRILSVQYSIPDYVRVSTECRHLLSRIFVGNPEQRITIPEIKNHPWFLKNLPIEMTDDYQQSMQLAGVNSSEQSLEDVMAIIQEARKPGEGMKLAGQLSCLGSMDLDDIDLDDIDDIDIENSGDFVCAM

SEQ ID NO: 6693 - protein, 344 aa, Setaria italica
MERYEVIRDIGSGNFGVAKLVRDVTTKELFAVKFIERGQKIDEHVQREIMNHRSLKHPNIIRFKEVVLTPTHLAIVMEYAAGGELFERICTAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPRNFRKTITRILSVQYSIPDYVRVSMECRHLLSRIFVGNPEQRITIPEIKNHPWFLKNLPIEMTDDYQQSMQLADMNSSEQSLEEVMAIIQEARKPGEAMKLAGQVSCLGSMDMDLDDIDLDDIDDIDIENSGDFVCAM

SEQ ID NO: 6694 - protein, 342 aa, Panicum virgatum
MERYEVIRDIGSGNFGVAKLVRDVSTNELFAVKFIERGQMIDEHVQREIMNHRSLKHPNIIRFKEVVLTPTHLAIVMEYAAGGELFERICNAGRFIEDEARFFFQQLISGVSYCHSMQICHRDLKLENTLLDGSAAPRLKICDFGYSKSSVLHSQPKSTVGTPAYIAPEVLTKKEYDGKVADVWSCGVTLYVMLVGAYPFEDPDDPRNFRKTITRILSVQYSIPDYVRVSMECRHLLSRIFVGNPEQRITIPEIKNHPWFLKNLPIEMTDEYQQSMQLPGMNSPEQSLEEVTAIIQEARKPGEAVKVAGQVSCLGSMDLDDIDLDYIDDIDIENSGDFVCAM

SEQ ID NO: 6695 - protein, 342 aa, Panicum virgatum
MERYEVIRGIGSGNFGVAKLVRNVRTEELFAVKFIERGQMIDEHVEREIMNHRSLKHPNIIRFKEVVLTPTHLAIVMEYAAGGELFERICNAGRFSEDEARFFFQQLISGVSYCHSMQICHRDLKLENTLLDGSAAPRLKICDFGYSKSSVLHSQPKSTVGTPAYIAPEVLTKKEYDGKVADVWSCGVTLYVMLVGAYPFEDPDDPRNFRKTITRILSVQYSIPDDVRVSMECRHLLSRIFIGNPEQRITIPEIKNHPWFLKNLPIEMTDEYQQNMQLPGMNTPEQSLEEVTAIIQEARKPGEATKVAGQVPCLGSMDLDDVDLDYIDDIDIENSGDFVCAM

SEQ ID NO: 6696 - protein, 343 aa, Brachypodium distachyon
MDRYEVMRDIGSGNFGVAKLVRDVATKEHFAVKFIERGQKIDEHVQREIMNHRSLKHPNIIRFKEVVLTPTHLAIVMEYASGGELFERICNAGRFSEDEGRFFFQQLISGVSYCHSMQVCHRDLKLENTLLDGSVAPRLKICDFGYSKSSVLHSQPKSTVGTPAYIAPEVLSRREYDGKVADVWSCGVTLYVMLVGAYPFEDPDEPRNFRKTITRILSVQYSIPDYVRVSTECIHLLSRIFVGNPEQRITIPEIKNHPWFLKNLPVEMTDEYQRSMQLADLNTPSQSLEEVMAIIQEARKPGDNALRLAGQVACLGSMDLDDIDFDDIDDIDVENSGDFVCPL

SEQ ID NO: 6697 - protein, 342 aa, Triticum aestivum
MDRYEVVRDIGSGNFGVAKLVRDVRTKEHFAVKFIERGHKIDEHVQREIMNHRSLKHPNIIRFKEVVLTPTHLAIVMEYASGGELFQRICNAGRFSEDEGRFFFQQLISGVSYCHSMQVCHRDLKLENTLLDGSVAPRLKICDFGYSKSSVLHSQPKSTVGTPAYIAPEVLSRREYDGKVADVWSCGVTLYVMLVGAYPFEDPDEPRNFRKTITRILSVQYSVPDYVRVSMDCIHLLSRIFVGNPQQRITIPEIKNHPWFLKRLPVEMTDEYQRSMQLADMNTPSQSLEEAMAIIQEAQKPGDNALGIAGQVACLGSMDLDDIDFDIDDIDVESSGDFVCPL

SEQ ID NO: 6698 - protein, 343 aa, Avena sativa
MDRYEVIRDIGSGNFGVAKLVRDVRTKEHFAVKFIERGQKIDEHVQREIMNHRSLKHPNIIRFKEVVLTPTHLAIVMEYASGGELFERICNAGRFSEDEGRFFFQQLISGVSYCHSMQVCHRDLKLENTLLDGSVAPRLKICDFGYSKSSVLHSQPKSTVGTPAYIAPEVLSRREYDGKVADVWSCGVTLYVMLVGAYPFEDPDEPRNFRKTITRILSVQYSIPDYVRVSADCVHLLSRIFVGNPEQRITIPEIKNHPWFLKNLPVEMTDEYQRSMQLADMNTASQNLEEVMAIIQEARKPGDNALRLAGQVASLGSMDLDDFDFDDIDDIDIENSGDFVCPL

SEQ ID NO: 6699 - protein, 342 aa, Secale cereale
MDRYEVVRDIGSGNFGVAKLVRDVRTKEHFAVKFIERGHKIDEHVQREIMNHRSLKHPNIIRFKEVVLTPTHLAIVMEYASGGELFQRICNAGRFSEDEGRFFFQQLISGVSYCHSMQVCHRDLKLENTLLDGSVAPRLKICDFGYSKSSVLHSQPKSTVGTPAYIAPEVLSRREYDGKVADVWSCGVTLYVMLVGAYPFEDPDEPRNFRKTITRILSVQYSIPDYVRVSMDCIHLLSRIFVGNPQQRITIPEIKNHPWFLKRLPVEMTDEYQRSMQLADMNTPSQSLEEAMAIIQEAQKPGENALGIAGQVACLGSMDLDDIDFDIDDIDVESSGDFVCPL

SEQ ID NO: 6700 - protein, 342 aa, Elaeis guineensis
MERYEVLREIGAGNFGVAKLVRDVWTNELYAVKLIERGHKIDEHVQREIMNHRSLRHPNIVRFKEVVLTPTHLAIVMEYAAGGELFVRICNAGRFSEDEARFFFQQLISGVSYCHSMQICHRDLKLENTLLDGSTAPRLKICDFGYSKSSVLHSQPKSTVGTPAYIAPEVLSRKEYDGKIADVWSCGVTLYVMLVGAYPFEDPDDPRNFRKTLGRILSVRYSIPDYVRVSKECRHLLSRIFVANPEQRITIPEIKSHPWFLKNLPVELTDEYQNSLQSSDMNTPSQSIEEIMAIIQEARKPAESPKLGGGHFVGGDSGDLDDMDADVDLDDIETSGDFVCAL

SEQ ID NO: 6701 - protein, 342 aa, Amorphophallus konjac
MERFEVLKDIGSGNFGVAKLVRDRWTKEQFAVKFIERGQTIDENVQREIMNHRSLKHPNIVRFKEVLLTPTHLAIVMEYAAGGELFERICNAGRFSEDEAKVFLQQLISGVSYCHSMQICHRDLKLENTLLDGSVAPRVKICDFGYSKSSVLHSQPKSTVGTPAYIAPEVLSRKEYDGKIADVWSCGVTLYVMLVGAYPFEDPDDPRNFRKTIARILSVQYSIPDYVRVSTECRHLLSRIFVANPEKRITIPEIKNHPWFLKNLPIELTEDAQGNLQNNDVGGPSQSIEDIMSIIQEARKPPEGPKVGSGPFVGGGSMDLDDVDADADLDDIETSGDFVCAL

SEQ ID NO: 6702 - protein, 335 aa, Vitis vinifera
MERYEIIKDIGSGNFGVARLVSDKRTRELFAVKFIERGQKIDEHVQREIMNHRSLMHPNIVRFKEVLLTPTHLAIVMEYAAGGELFGRICNAGRFSEDEARFFFQQLISGVSYCHSMRICHRDLKLENTLLDGSTAPRVKICDFGYSKSSVLHSQPKSTVGTPAYIAPEVLSRKEYDGKLSDVWSCGVTLYVMLVGAYPFEDPDDPRNFRKTIGRILSVHYSIPDYVRVSIECRHLLSRVFVANPDKRITIPEIKTHPWFLKNLPIEMMDGGSWQKNDVNNPSQSVEEILSIIQEARKTTGVRKAGGPFMEGSMDLDDIDADEDIETSGDFVCPL

SEQ ID NO: 6703 - protein, 337 aa, Populus trichocarpa
MERYEIIKDIGSGNFGVAKLVRDKWTKEFFAVKFIERGQKIDEHVQREIMNHRSLKHPNIVKFKEVLLTPTHLAIVMEYAAGGELFERICNAGRFSEDEARIFFQQLISGVSYCHSMQICHRDLKLENTLLDGSTAPRVKICDFGYSKSAVLHSQPKSTVGTPAYIAPEVLLKKEYDGKISDVWSCGVTLYVMLVGAYPFEDPDDPKNFRKTIGRILSVNYSIPDYIRVSVECNHLLSRIFVANPEKRITIPEIKNHPWFLKNLPIELMEGQSWQSIDVNNLSQSIEEVLSIIQEASKPVSLSKAVGHLLGGSMDLDDLDADADLEDIETSGDFVCP

SEQ ID NO: 6704 - protein, 338 aa, Citrus sinensis
MERYEIVKDIGSGNFGVAKLVRDKWTRELLAVKFIERGQKIDEHVQREIMNHRSLKHPNIVRFKEVLLTPTHLAIVMEYAAGGELFERICNAGRFSEDEARFFFQQLISGVSYCHSMQICHRDLKLENTLLDGSTAPRVKICDFGYSKSSVLHSQPKSTVGTPAYIAPEVLTKKEYDGKIADVWSCGVTLYVMLVGAYPFEDPEDPKNFRKTIGRILSVHYSFPDYVRVSLECKHLLSRIFVANSEKRITIPEIKNHPWFLRNLPIELTEGGSWQSHDVNNPSQSLEEVLSLIHEATKPLEAPRVGGHLLGSSMELDDLDADADLEDTETSGDFVCPL

SEQ ID NO: 6705 - protein, 337 aa, Fragaria vesca
MERYEIVKDIGSGNFGVAKLVKDKWSGELYAIKFIERGQKIDEHVQREIMNHRSLKHPNIIRFKEVLLTQTDLAIVMEYAAGGELFERICNAGRFSEDEARFFFQQLISGVSYCHSMQICHRDLKLENTLLDSSSAPRLKICDFGYSKSSVLHSQPKSTVGTPAYIAPEVLSKKEYDGKIADVWSCGVTLYVMLVGAYPFEDPEDPRNFRKTLQRILSVSYSIPDYVRVSRECTHLLSRIFVANPEKRITIPEIKQHPWFLKNLPSEFMDEDDMQIGEVQKNEISQSVEDIVSIIQEARKLGDGIKVGHFLGSMDLDEIDDADIDDIETSGDFVCAL

SEQ ID NO: 6706 - protein, 285 aa, Setaria italica
MPIEDVSIETTEAAGPQKVPYWDPPPAPLLETSELMKWSLYRALIAEFVATLIFLYVSIATVIGYKDQSKALACNGVGFLGVAWSFGATIFILVYCIGGISGGHINPAVTFGLFVGRKLSLLRTVLYIVAQCLGAICGVAIVKGITGDQYSLLGGGANSVADGFSVVAGLGAEIMGTFVLVYTVFSATDPKRTARDSFIPVLVPLPIGFAVFVVHLATIPITGTGINPARSLGAAVIFGEAWKNHWIFWVGPLIGATAAALYHKLVLRGEAAKALGSFRSTSATV

SEQ ID NO: 6707 - protein, 284 aa, Panicum virgatum
MPKEDVSIEAAAAEKAPYWDPPPAPVLDTSELQKWSLYRALIAEFVATLIFLYVSIATVIGYKAQSNNLQTCTGVGFLGVSWSFGATIFILVYCTGGVSGGHINPAVTFGLFVGRKLSLVRTVLYIVAQCLGAICGAGMVKGIVGGDLYDTLGGGANAVGSGFSVAAALGAEIAGTFVLVYTVFSATDPKRTARDSFIPVLVPLPIGFAVFVVHLATIPITGTGINPARSLGAAVMYNKAWSYHWIFWIGPAIGATAAALYHKLVLRGEAVKALGSFRSTSATV

SEQ ID NO: 6708 - protein, 290 aa, Panicum virgatum
MPKEDVSIEEDVSIEAAAAEKAPYWDPPPAPVLDTSELGKWSLYRALIAEFVATLIFLYVSIATVIGYKAQSNNLQTCTGVGFLGVAWSFGATIFILVYCTGGVSGGHINPAVTFGLFVGRKLSLVRTVLYIVAQCLGAICGAGIVKGIVGGDIYDAYGGGANAVGSGFSVAAALGAEIAGTFVLVYTVFSATDPKRTARDSFIPVLLPLPIGFAVFVVHLATIPITGTGINPARSLGAAVVYDMAWKNHWIFWIGPAIGATAAAMYHKLVLRGEAVKALCSFRSTSATV

SEQ ID NO: 6709 - protein, 168 aa, Panicum virgatum
DRDLSLGNIIVNFSLGKPQIHNKWTSAAIKVYRDTVSTGLVPSSDVLSQVLGCLRPPHYNSLKSSFIENMQISCDIPHNPNINSLFEGFGEYDIRAFSILEEAASLGAVGSISMKDTRIVIDARKVKDPHSRGFSSYNIEILEASTCCRCKVTKRDNLVTHRKETGRH

SEQ ID NO: 6710 - protein, 324 aa, Saccharum officinarum
LKAVDILNEMNRLGVHPNEITYSVLFVACERNGEAQLGLDLFEQLKMDGIGINPTIIGSLTGLCLQMFDNDFSLGNIIVNFSSGKPQIDNKWTSSAVMVYREAVSAGLLPSSDVLSQVLGCLRLPHGSSLKSSFIENMGISSDIPQHPNINSLFEGFGEYDIRAFSILEEAASLGAVGSISMKETRILIDARKLKIYTAEVSLLRTLRSLKHRLAAGSRLPNVTILLPTEQKQVDIDEKEKTLKLAGRIGQAVGSLLRRLGISYQGEESHGRMRINGLTLRRWFSPKLNSKSSAAAPADLLPLPSRLAKGIAGQQRDIRNLSLE

SEQ ID NO: 6711 - protein, 258 aa, Zea mays
MFNIDFSLGNIIVNFSSGKPQIDNKWTSSAVMVYREAVSAGLLPSSDVLSQVLGCLRLPHGSSLKSTFIENMGVSCDIPQYPNINSLFEGFGEYDIRAFSILEEAASLGAVASISIKETRIVIDARKLKIFTAEVSLLRTLRSLKHRLAAGSRLPNVTILLPTEKKQVDIDEKEKTLKLAGRIGQAVGSLLRRLGISYQGEESHGRMRINGLTIRRWFNPKLNSKSSAAGPADLLPLPSRLAKGIAGQQRDIRNLSLE

SEQ ID NO: 6712 - protein, 977 aa, Oryza sativa
MQVSHEHDKRIVNNKALGTSTDLLDDSSYSSRRTHENVFSEPSVSGRMTVDRTDCQTDVFSGVDTVNNTTQVGSVISTYRSLDTFEGVYGPANTSSIEKVQDILPQSRSVSDGQHQSRHFANRRAQLGGLPHQFLSLSKQNEQTKNGQGPPDNKTDSEGANLLGCHQSDQGDYVDFTSLSSFKRINEHPLNFIPEAHASNLFEPRKASEFTNSYAGGSYLRAGRLVPVACLRDGPVSKQKKAMNDHDDAKLIGWSISNLLSKENPENSTSANRAGLRGTKDVPDYLRRYNSLLIDGRLKDSVDLLESMEQKGLLDMNKIHHASFLNACKKQRAVPEAVRFCKLINNPKMSTFNMLLSVCANSQDFDGALQVMVLLKEAGLKPDCKLYTTLISTCAKCGKVDAMFEVFHEMVSAGIEPNVNTYSALIDGCAKAGQVAKAFGAYGIMSSKKVKPDRVVFNALISACGESGAVARAFDVLSEMTAEASESKGSKPILPDHVTVGALMKTCIQAGQADRAREVYKMLQEYNIKGTPEVYTIALRSCSLTGDLGFALKIYEDMNKIGVQPDEMFLSALVDVAGHARRADAAFEIMKDARAKGYQVGTIAYSSLMGACCNAKDWKKALQLFEEIKSIKLMPTVSMMNALITALCDGDQVLKSFEVLSEMKRLGVCPNMITYSVLFVACERNAEAQLGLDLFEQLKIDSIDLNPTIVGCLTGLCLQMFDNDLSLGNIVVTFNLGKPQIENKWTSSAIKVYREAISTGLLPSSDVLSQVLGCLRFPHDNTLTNTFIENMGISCDIPHHPNVNSLLEGFGEYDIRAFSILEEAASLGAVESISMKDTRILVDARKSKIYTAEVSVLTTLRSLKHRLAAGARLPNVTILLPTEKKQVGLDEREKTLKLAGRVGQAVGSLLRRLGIKYHGEESHGKMRINGLTLRRWFNPKLTSTSSTGTPADLLPLPSRLAKGIADQQRNIRNLSLE

SEQ ID NO: 6713 - protein, 262 aa, Panicum virgatum
GLCLQMFDRDLSLGNIIVNFSLGKPQIHNKWTSAAIKVYRDAVSTGLVPSSDVLSQVLGCLRLPHYNSLKSSFIENMQISCDIPHNPNINSLFEGFGEYDIRAFSILEEAASLGAVGSISMKDTRIVIDARKLRIHTAEVSLLTTLRSLKHRLAAGARLPNVTILLPTEKKQVDIDEREKTLKLAGRIGQAVGSLLRRLGISYQGEESHGRMRINGLTLRRWFNPKLNSKSSSAAPADLLPLSSRLAKGIADQQRDIRSLSF

SEQ ID NO: 6714 - protein, 260 aa, Pseudoroegneria spicata
MSTMFSYDLSLGNIIVRFNQGKPQIDNKWTSSAIMVFRQAITAGLLPSSDVLSQVLGCLRFPHDSSLKTTFIDNMGISCDMPHHPNTNSLLEGFGEYDIRAFSVLEEGGLLGAVASTSTKYSQIVIDARKSNIYTAEVSLLSTLKSLKHRLAAGARLPNVTILLPTEKKQVDLDEREKTLKLAGRVGQAVGSLLRRLGIKYQGEESHGRMRINGLTLRRSFNPKFTSAPSTGAPVELLPLPSRLAKGIADQQRDIRSLSL

SEQ ID NO: 6715 - protein, 501 aa, Secale cereale
KPRFADFSLVPQGWGAYVSPWVAALGPAYPRLERICLKRMTVSDDELALIPTSFPLFKDLSLVCCDGFTTRGLAVIAEGCRHLRALDLTEDYFHEEESEVVDWISKFPECNTSLESLVFDCVSVPFNFDALEALVARSPALRRLRVNDHVSIEQLRRLMARAPQLTHLGTGSFRSEPGPGGALSVSELAASFAASRSLVCLSGFLDVNAAYLPAIYQVCANLTSVNFSFAGLTAEEFIPVIHHCVNLRTLWVLDTVGDEGLQAVAETCSNLRELRVFPLDATEDSEGSVSDIGLQAISEGCRKLESILYFCQRMTNAAVIAMSENCPDLLVFRLCIMGRHRPDRITGAPMDEGFGAIVMNCKKLTRLSVSGLLTDKAFAYIGKHGKLIKTLSVAFAGNSDISLQHVFEGCTRLQKLEVRDSPFGDKGLLSGLNYFYNMRFFWMNSCRLTVKGCGDVAQKMPNLVVEVMKENEGEMDTVDKLYLYRSLAGPRDDAPAFVNIL

SEQ ID NO: 6716 - protein, 529 aa, Triticum aestivum
GNCYAVSPRRAVERFGGVRAVVLKGKPRFADFSLVPHGWSSYVSPWVAALGPAYPRLERICLKRMTVSDDELALIPKSFPLFKELSLVCCDGFTTRGLAVIAEGCRHLRVLDLTEDYFHEEESEVVDWISKFPESNTSLESLVFDCVSVPFNFEALEALVARSPALRRLRVNDHVSIEQLRRLMARAPHLTHLGTGSFRSEPGPGGALSVSELATSFAASRSLVCLSGFLDANAAYLPAIYQVCANLTSLNFSFAGLTDEEFIPVIRHCINLRTLWVLDTVGDEGLRAVAETCSNLRELRVFPLDATEDSEGSVSDIGLQAISEGCRKLESILYFCQRMTNAAVIAMSENCPDLLVFRLCIMGRHRPDRITGAPMDEGFGAIVMNCKKLTRLSVSGLLTDKAFAYIGQYGKLIKTLSLAFSGNSDLSLQFLFEGCTRLQKLEVRDSPFSDRGLLCGLDYFYNMRFLWMNSCRLTMRGCREVAQRMPNLVVEVMEEQNEDKVETETVDKLYLYRSLAGPRGDAPPLVKIL

SEQ ID NO: 6717 - protein, 665 aa, Zea mays
MSTPHSSSTSSVPHRASAPQIPQSLTLAPPTACSASPSSSFSSSSASGMRDAGEDDDSDSPPSQMSEDDPGAGAGDRWEPDLRGGGGRRAPPDQVLGNVLETVLQFLTAARDRNAASLVCRSWYQAEAQTRRELFIGNCYAVSPRRAVERFGGLRAVVLKGKPRFADFSLVPYGWGAYVSPWVAALGPAYPCLERICLKRMTVSDDDLALVATSFPCFRDLSLVCCDGFSTLGLAVVAERCRHLRVLDLIEDYVEDDEDELVDWISKFPECNTSLESLVFDCVSVPFNFEALEALVARSPALRQLRVNHHVSVEQLRRLMARAPQLTHFGTGAFRSEGAPGGGLAVTELATSFAASRSLICLSGFREVDPEYLPAIYPVCAKLTSLNFSFASLTAAELKPVIRNCTNLRTFWVLDTVGDEGLRAVADACSDLRELRVFPLDASEDSEGSVSDVGLEAISKGCRKLESILYFCQRMTNAAVIDMSKNCPELVVFRLCIMGRHRPDRVTGEPMDEGFGAIVMNCKKLTRLSVSGLLTDKAFAHIGKHGKLIKTLSVAFAGNSDMSLQYVFEGCTKLQKLEVRDSPFSDRGLLSGLDYFYNMRFLWMNSCRLTMRGCRDVARQMQNLVVEVIKDHSEDEGEGETVDKLYLYRSLAGPRDDAPPFVTLL

SEQ ID NO: 6718 - protein, 666 aa, Zea mays
MSTPHSSSTSSVPPHRASPPQIPQSLTLAPTASSASPSSSSASGMRDAAEDDSDSPPSQMSEDDPGGGGGDRWEPDLRGGNGGGGGGGRWAPPDQVLENVLETVLEFLTAARDRNAASLVCRSWYRAEAQTRRELFIGNCYAVSPRRAVERFGGLRAVVLKGKPRFADFSLVPYGWGAYVSPWVAALGPAYPRLQRICLKRMAVSDDDLALVASSFPFLRDLSLVCCDGFSTLGLAVIAERCRHLRVLDLIEDYVEDDDEELVDWISKFPESNTSLESLVFDCVSCPFNFEALEALVARSPALRRLRVNHHVSVEQLRRLMARAPQLTHFGTGAFRSEGAPGGGLAVTELATSFAASRSLVCLSGFREVDPEYLPAIYPVCANLTSLNFSFASLTAAELKPAIRNCTNLRTFWVLDTVGDEGLRAVADACSDLRELRVFPLDASEDSEGSVSDVGLQAISEGCRKLESILYFCQRMTNAAVIDMSKNCPELVVFRLCIMGRHRPDRDTGEPMDEGFGAIVMNCKKLTRLSVSGLLTDKAFAYIGKHGKLIKTLSVAFAGNSDMALQYVFEGCTKLQKLEVRDSPFSDRGLLSGLDYLYNMRFLWMNSCRLTMRGCRGVAQQMQNLVVEVIKDHSEDEGEAETVDKLYLYRSLAGPRNDAPPFVTLL

SEQ ID NO: 6719 - protein, 574 aa, Secale cereale
PPDQVLENVLESVLEFLTAARDRNAASLVCRSWYRAEAQTRRELFIGNCYAVSPRRAVQRFRGVAAVVLKGKPRFADFSLLPDGWGANVKPWLEALGPAYPCLERICLKRMTVTDDDLGLVARSFPQFKELSLVCCDGFSTLGLAVIAERCRHLRVLDLIEDYVDQEDEAVDWISKFPVSNTSLESLMFDCVSVPFNFEALEALVARSPSLRRLRVNHHVSVEQLRRLMARAPQLTHLGTGAFRPEAPQGGGMSVSELAPSFAASTSIVCLSGFQEVNPEYLPAIYPVCGNLTSLNVSFASLTAEDLTPVIRQCHKLQTFWVLDTVGDEGLRAVAETCSDLRELRVFPLDATEDSDGSVSDVGLQAISEGCRKLESILYFCQRMTNAAVVAMSYNCPDLVVFRLCIMGRHRPDRITGEPMDDGFGAIVMNCKKLTRLSVSGLLTDKAFAYIGKYGKLIKTLSLAFSGNSDLSLQFLFEGCTRLQKLEVRDSPFSDRGLLCGLDYFYNMRFLWMNSCRLTMRGCREVAQRMPNLVVEVMEEPNEDKVETETVDKLYLYRSLAGPRGDAPELVKIL

SEQ ID NO: 6720 - protein, 663 aa, Hordeum vulgare
MSTSSPAPTPTSSSDPPTTTTTTTTSSDPITGPSSSSSPASGMSGAAEEADSPPTHMSEDSSGSSSGGRRTPDLRGGNNGGGPRASSSAPPDQVLENVLESVLEFLTAARDRNAASLVCRSWYRAEAQTRRELFIGNCYAVDPRRAVWRFRGVHAVVLKGKPRFADFSLLPDGWGANVKPWLEALGPAYPCLERICLKRMTVTDDDLGLVARSFPQFKELSLVCCEGFSTLGLAVIAERCRHLRVLDLIEDYVDQEDEAVDWISKFPVSNTSLESLMFDCVGVPFNFEALEALVARSPSLRRLRVNHHVSVEQLRRLMARAPQLTHLGTGAFRPEAPQGGAMSVSELTPSFAASTSIVCLSGFQEVNPEYLPAIYPVCGNLTSLNVSFASLTAEDLTPVIRQCHKLQTFWVLDTVGDEGLRAVAETCSDLRELRVFPLDATEDSDGSVSDVGLQAISEGCRKLESILYFCQQMTNSAVVAMSNNCPDLVVFRLCIMGRHRPDRITGEPMDDGFGAIVMNCKKLTRLSVSGLLTDKAFSYIGKYGKLIKTLSLAFSGNSDLSLQFLFEGCTRLQKLEVRDSPFSDRGLLCGLDYFYNMRFLWMNSCRLTMRGCREVAQRMPNLVVEVMEEPNEDKVETETVDKLYLYRSLAGPRDDAPPLVKIL

SEQ ID NO: 6721 - protein, 447 aa, Panicum virgatum
MSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDQTLSPEQAEEYNKILAILDDLSAEKLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFFMFPREDQMAGKSATRLKLGNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQRMVLEALEAMGETEALEMKAALESKGEVEFKGVHPWEGCYDKEKHGFN

SEQ ID NO: 6722 - protein, 276 aa, Zea mays
MLVLRRVSFLLSSPSPRAPLAKPLLLLRPPQTLAPTARQLVAMAASVPSAGGAGTMSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDHTLSPEMAEEYNRVLAILDDLTAEQLGAKIREYKIVAPDTKNSLSDPYPFNLMFQTSIGPSGLSPGYMRPETAQGIFVNFKDLYYYNGNKLPFAAAQIGQAFRNEA

SEQ ID NO: 6723 - protein, 690 aa, Elaeis guineensis
MAASEDSLRQALVEKQTAVDAQAEAVRAIKARPGASKEEIDAAVEALKALKVEHGAAARRLQAAVSSNGDGSSKEAFRQAVVNTLERRLFYIPSFKIYRGVAGLYDYGPPGCAVKSNVLAFWRHHFVLEENMLEVDCPCVTPEIVLKASGHVDKFTDLMVKDEKTGTCYRADHLLKDYCKGKLEKDLTLSSEKAAEFKHVIAVLDDLSAEELGAKLKEYDIRAPDTGNPLSDPYPFNLMFQTSIGPSGLLPGYMRPETAQGIFVNFKDLYYYNGNKLPFAAAQIGQAFRNEISPRQGLLRVREFTLAEIEHFVDPEDKSHPKFVDVANLEFLMFPREDQLSGQPAKTMILGEAVSKGTINNETLGYFMGRVYLFLTHLGIDKDRLRFRQHLPNEMAHYAADCWDAEIECSYGWIECVGIADRSAYDLRAHSEKSGVLLVAHEKFSEPREVEKLVITPSKKELGLAFKGSQKMVVEALEAMGEKEALEMKKALEDKGEVEFQVCPLGKLVVLKKNMVSISVEKKKEHQRVFTPSVIEPSFGIGRIIYCLFEHSFYTRPSKSEEEQLNVFRFPPLVAPIKCTVFPLIKTQLFDEVAKLIAKSLTAAGISHIIDITGTSIGKRYARTDEIGVPFAITVDSTTSVTIRERDSKEQIRVSIDEVASVVKEVTDGQSTWADVLWRYPTHAAPHADE

SEQ ID NO: 6724 - protein, 691 aa, Elaeis guineensis
MAASEDSLRRALAEKQAAVDAQAEAVRALKARSGVAKDEIDAAIEVLKALKVEHGAAAKRLQSAVSSNGDGSSKEAFRQAVVNTLERRLFYIPSFKIYRGVAGLYDYGPPGCAVKSNVLAFWRQHFVLEENMLEVDCPCVTPEIVLKASGHVDKFTDLMVKDEKTGTCYRADHLLKDYCKGKLEKDLTLSPDKAAEFKHVVAVLDDLSAEELGAKLKEYDIRSPDTGNQLSDPYPFNLMFQTSIGPSGLLPGYMRPETAQGIFVNFKDLYYYNGNKLPFAAAQIGQAFRNEISPRQGLLRVREFTLAEIEHFVDPEDKSHPKFVDVAELEFLMFPREEQLAGKSAKTMILGEAVSKGTINNETLGYFIGRVYLFLTRLGIDKDKLRFRQHLPNEMAHYAADCWDAEIECSYGWIECVGIADRSAYDLRAHSEKSGVPLVAHEKFSEPREVEKLVITPSKKELGLAFKGNQRMVVEALEGMSEKEALDMKQALEDKGEVDFQVCTLGKSVVIKKNMVSISMERKKEHQRVFTPSVIEPSFGIGRIIYCLFEHSFYTRPSKSEDEQLNMFRFPPLVAPIKCTVFPLIKSQQFDEVAKLIAKSLTAAGISHIIDVTGTSIGKRYARTDELGVPFAITVDSTTSVTIRERDSKGQIRVSMDEVASVVKEITDGQSTWADVLWRYPTHVTTHADEE

SEQ ID NO: 6725 - protein, 694 aa, Musa acuminata
MADSEESLRRALSEKQAAVDAQAEAVRALKARPASAPSEIDAAVEALKALKVEAAAAARLLQAAVSRNGDGSTAGSREAFRQAVVNTLERRLFYIPSFKIYRGVAGLYDYGPPGCAVKSNVLAFWRQHFVLEENMLEVDCPCVTPEIVLKASGHVDKFTDLMVKDEKTGTCYRADHLLKDYCKEKLEKDLTLSAEKAAELKHILAVLDDLSADEVGAKIKEYGIAAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKTHPKFVDVSNLEFLMFPRKEQMAGESAKPMILGEAISKGTVNNETLGYFIGRVYLFLACLGIDKDRLRFRQHLPNEMAHYAADCWDAEIECSYGWIECVGIADRSAYDLRAHSEKSGVALVAHEKFSESREVEKLVIVPSKKELGLAFKGNQKMVVEALETMSEKEALKMRASLESKGEVDFHVCTLGKAVVITKNMVSISIEKKKEHQRVFTPSVIEPSFGIGRIIYCLFEHSFYTRPSKSEDEQLNVFRFPPLVAPIKCTVFPLIKTQKFDDVAKIIARSLTAAGISHIIDITGTSIGKRYARTDEIGVPFAITVDSTNSVTIRERDSKEQIRVSIDEVAKVVKEVTDGQSTWADIMWRYPAHAASLVDEE

SEQ ID NO: 6726 - protein, 416 aa, Phalaenopsis aphrodite
NRLPFAAAQIGQAFRNEISPRQGLLRVREFTLAEIEHFVDPEDKSHPKFVDVADIEFLMFPRELQMAGESAKPMVIGEAVRKGTVNNETLGYFIGRVYLFLTRLGIDKERLRFRQHLPNEMAHYAADCWDAEIECSYGWIECVGIADRSAYDLRAHTDKSGVPLVAHEKYPEPREVEKLVIAPSKKELGLAFKGNQKMVVEALEALNHEEALKIKAALESKGEVEFEVCTLGKSVIIKKNMVSISIEKKKEHQRVFTPSVIEPSFGIGRIIYCLFEHSFYTRPSKSEDEQLNVFRFPPLVAPIKCTVFPLIKSQQFDEVAKVIARSLRSAGISHIIDITGTSIGKRYARTDEIGVPFAITVDSTSSVTIRERDSKEQIRVRIDEVASVVKEVTDGQSTWADIMWRFPTHSASHVDE

SEQ ID NO: 6727 - protein, 770 aa, Secale cereale
KVVEAAKRLHVKEHEVLDGSGNPVKLAATVECKGIVGSDDRHYILDLMRVTPRDSNYIGLQHRFCVLRPELVASFVEAESIKKSPTQKVPDVPTESNGQESDDLASASDATAASVEEHDKSDESPASTPAESNDSTAEILFNPNVFTEYKLAGSPEEIEADEALVKKVGSYLLDTVIPKFVQDLCSLDVSPMDGQTLTDVLHSNGINVRYLGKVAGMIKHLPHLWDLFSAEIIVRSAKHVVKDILRQSPDHNIAPAVAHFLNCFFGKVLAASTKGSTGSPQSKTQKGQKSSQSASSRKGQSAYSQLTSDGVWSDIKEFAKHKYQFEAPDDARVGAKRVAVLRNLCQKVGITIAARKYDLHSTTPFQPSDILNLQPVVKHSVPTCTDARKLMEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSEDSRTKDSENWLNTFKGREQQVIAQKQKGQGTAAPSTNAVEFLKAHPGLFQAMKAAAIQSGGDGPATVSRGRGSDERAAKAAAEARKTAVARGVNLRNGPAASVSDINQILNLINTAASASAASSGNAQATESEAPQSNGPALNGAKEAKDTSRPSAKADGQAPVGLGASLELKKQKSK

SEQ ID NO: 6728 - protein, 397 aa, Avena sativa
MEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGLYKLSVQHETSTHDILVKQLGSDDSRTKDSGNWLKTFKEREQQANAQKQKGQTTNPSATALNLLKAHPGLYQAMKAAAIQSGDGSANVNKSLNAAVVGEGVPRGRGVDERAAKATAEVRKKAAARGVTLRNGPPGNSVAELNQILNLINSAASVSAASPAANTQTTESEGSQSNGPALNGANEAKDTNPLSAKVDSQTPVGLGASLELKKQKSKQKAQ

SEQ ID NO: 6729 - protein, 259 aa, Pseudoroegneria spicata
HREALELYSAALAAARGPAQRIALHSNRAACYLKLHDFHKAAEECTSVLELDTEHAGALMLRAQTLVTLKDYQSALFDVNRLIEINPSSEVYRNLHARLKTQLSLAPIPESEEESLYTEEDKEDLPPKDNTKNETVVVKSDQPSAKLILENKPVTKALKVEVPPNLPSKPEGGGTIQKPKGHSELDYKKPLTEAPKVQVSPSLPSKPGAIQKPKGHSGLDYSKWDKVEDDSSEDDEDDDEDDLPRYKFKVRTIGVRTVK

SEQ ID NO: 6730 - protein, 651 aa, Zea mays
MMAFFVVQRGSSQLTPLLALALLGLLRCAAVSCSAAAAATTLLHRESYAGKSEFRTVNRKPLGSCVDPSPYLAIDVGAAGPIPDEAFLQVTVSGVQRPDPSDWVAMITPSNSSVAGCPLSEVNYVETGDLANLPLLCHYPVKAQYLTSDPGYLGCKNAGCGKRDASGACTARTCAATLTFHVVNFRTDVEFVLFSGGFKAPCLLKRSGARRFANPASPLYGHLSSTDSKATSMRLTWVSGDGNPQRVQYGDGKSSTSEVATFTQDDMCSISVLPSPAKDFGWHDPGYIHSAVMTGLQPSQSYTYRYGSDSVGWSDTVKFRTAPAAGSDELSFVIYGDMGKAPLDPSVEHYIQPGSVSVAKAVAKEIQTGNVDSIFHIGDISYATGFLVEWDFFLHLITPLASQVPYMTAIGNHERDYASSASVYVTPDSGGECGVAYESYFPMPAVSKDKPWYSIEQGTVHFIVMSTEHEWSEKSEQYNWMDEDLSSVDRSRTPWVIFIGHRPMYSSHGGILPNVDSNFVASVEPLLLNYQVDLVFFGHVHNYERTCAVYQGNCKGMPTTDKSGIDVYDNSNYTAPVHVIVGAGGFSLDSFPNKGEAWSLSRVSEFGYGKVHATRTDMLVQFVNSSSMEVRDQFRIVKGAPANKSLSLIIQ

SEQ ID NO: 6731 - protein, 642 aa, Panicum virgatum
MGFFSSSVVPPLLVLLGLLCGGAVSSSPPPEMLHGSYAGKSEFRTVNRKELQSCLNPSPYLAINVSTGGAPLPDEAFVKVTVAGVLRPDASDWVAMITPSNSSVSGCPLSGVNYVETGDLANLPLLCHYPVKAQYLTSDPGYMGCKNAGCGKRSVAGACKARTCAATLTFHVVNFRTDVEFVLFSGGFKTPCLLKRSGALRFANPASPLYGHLSSTDSKATSMRLTWVSGDGNPQQVQYGDGKSSTSEVATFTQDDMCSISVLPSPAKDFGWHDPGYIHSVIMTGLQPSQSYTYRYGSDSVGWSDTIKFRTPPAAGSDELSFVIYGDMGKAPLDPSVEHYIQPGSISVAKAVAKEIQTGKVDSIFHIGDISYATGFLVEWDFFLHLITPLASQVSYMTAIGNHERDYANSASVYVTPDSGGECGVAYESYFPMPAVSKDKPWYSIKQGSVHFIVMSTEHEWSEKSEQYNWMDEDLSSIDRSRTPWVIFIGHRPMYSSHGGILPNVDSNFVASVEPLLLNYQVDLVFFGHVHNYERTCAVYQGNCNGIPTKDANGIDVYDNSNYTAPVHAIVGAGGFSLDNFPNNGETWSLSRVSEFGYARVHATRADMLVQFVNSSTMEVRDQFRIVKGSSAKKTPSLIIQQ

SEQ ID NO: 6732 - protein, 647 aa, Setaria italica
MGRFFSSGVVPLRLALLLALHCAAVSCSAPPPEMLHGSYAGKSEFRTVNRKELESCLNPSPYLAINVSTAGGGAANLPDEAFLQVTVAGVLKPSASDWVAMITPSNSSVSGCPLSVVNYVETGDLANLPLLCHYPVKAQYLTSDPGYMGCKNAGCGERGASGACTARTCAATLTFHVVNFRTDVEFVLFSGGFETPCLLKRSGALRFANPASPLYGHLSSTDSKATSMRLTWVSGDGNPQQVQYGDGKSSTSEVATFTQDDMCSISLLPSPAKDFGWHDPGYIHSAVMTGLQPSQSYTYRYGSDSVGWSDTIKFRTPPAAGSDELSFVIYGDMGKAPFDPSVEHYIQPGSISVAKAVAKEIQNGKVDSIFHIGDISYATGFLVEWDFFLHLITPLASQVSYMTAIGNHERDYANSASVYVTPDSGGECGVAYESYFPMPAVGKDKPWYSIEQGSVHFIVMSTEHEWSEKSEQYNWMDEDLSSIDRSRTPWVIFIGHRPMYSSHGGILPNVDSNFVASVEPLLLNYQVDLVFFGHVHNYERTCAVYQENCNGMPMKDANGVDVYDNSNYTAPVHAIVGAGGFSLDNFPNNGETWSLSRVSEFGYARVHATRTDMLVQFVNSSTMEVRDQFKIVKGSTSKKSSNLTIQQ

SEQ ID NO: 6733 - protein, 666 aa, Triticum aestivum
MLLRLLSSASRAIAAKPHPPQTLAAAAAGATSTTRKLAAMAGNREAFRVAVGNTLERRLFYVPSFKIYGGVAGLYDYGPPGCAVKANVLAFWRQHFVLEEGMLEVDCPCVTPEVVLKASGHVEKFTDLMVKDEKTGSCYRADHLLKDFCKEKLENDNTLSPEKVEELNHILAVLDDLSAEQLGAKIKEYGIAAPDTKNPLSDPYPFNLMFQTSIGPSGLSAGYMRPETAQGIFVNFKDLYYYNGNKLPFAAAQIGQAFRNEISPRQGLLRVREFTLAEIEHFVDPEDKSHPKFSDVSDLEFLMFPREDQLTGRSATRLRLGEAVSEGTVNNETLGFFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGLAFKGDQKMVLEALEAMGETEALGMKAALESKGDVEFKVCTLGKDVTIKRNMVSINMEKKKEHQRKFTPSVIEPSFGIGRIIYCLFEHCFYQRTGKTDDEQLNVFRFPPLVAPIKCTVFPLVKVEKFDVVAKKISKALTTAGISHIIDITGTSIGKRYARTDEIGVPLAITVDSTTSVTVRDRDSKDQIRVEVDEVALVVKEVTDGQSTWADIMWRYPAHTALATDEEEASET

SEQ ID NO: 6734 - protein, 655 aa, Triticum aestivum
AIAAKPHPPQTLAAAAAGATSTTRKLAAMAGNREAFRVAVGNTLERRLFYVPSFKIYGGVAGLYDYGPPGCAVKANVLAFWRQHFVLEEGMLEVDCPCVTPEVVLKASGHVEKFTDLMVKDEKTGSCYRADHLLKDFCKEKLENDNTLSPQKVEELNHILAVLDDLSAEQLGAKIKEYGIAAPDTKNPLSDPYPFNLMFQTSIGPSGLSAGYMRPETAQGIFVNFKDLYYYNGNKLPFAAAQIGQAFRNEISPRQGLLRVREFTLAEIEHFVDPEDKSHPKFSDVSDLEFLMFPREDQLTGRSATRLRLGEAVSEGTVNNETLGFFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGLAFKGSQKMVLEALEAMGETEALGMKAALESKGDVEFKVCTLGKDVTIKRNMVSINMEKKKEHQRKFTPSVIEPSFGIGRIIYCLFEHCFYQRTGKTDDEQLNVFRFPPLVAPIKCTVFPLVKVEKFDVVAKKISKALTTAGISHIIDITGTSIGKRYARTDEIGVPLAITVDSTTSVTVRDRDSKDQIRVEVEEVASVVKEVTDGQSTWADIMWRYPAHTALATDEEEASET

SEQ ID NO: 6735 - protein, 683 aa, Secale cereale
ASRCPRRISNARTTHLSMLPRLLSSASRAIAAKPHPPQTLAAAAAGATSTTRKLAAMAGNREAFRVAVGNTLERRLFYVPSFKIYGGVAGLYDYGPPGCAVKANVLAFWRQHFVLEEGMLEVDCPCVTPEVVLKASGHVEKFTDLMVKDEKTGSCYRADHLLKDFCKEKLENDNTLSPEKVEELNHILAVLDDLSAEQLGAKIKEYGIVAPDTKNPLSDPYPFNLMFQTSIGPSGLSAGYMRPETAQGIFVNFKDLYYYNGNKLPFAAAQIGQAFRNEISPRQGLLRVREFTLAEIEHFVDPEDKSHPKFGDVSDLEFLMFPREDQLTGGSATRLRLGEAVSEGTVNNETLGFFIGRVYLFLTQLGIDKDRLRFRQHLPNEMAHYAADCWDAEIECSYGWIECVGIADRSAYDLRAHSDKSGVPLEAHEKFAEPRQVEKLVITPSKKELGLAFKGNQKMVLEALEAMGETEALGMKAALESKGDVEFKVCTLGKDVTIKRNMVSINMEKKKEHQRKFTPSVIEPSFGIGRIIYCLFEHCFYQRIGKTDDEQLNVFRFPPLVAPIKCTVFPLVKVEKFDVVAKKISKALTTAGISHIIDITGTSIGKRYARTDEIGVPLAITVDSTTSVTVRDRDSKDQIRVEVDEVASVVKEVTDGQSTWADIMWRYPAHTALATDEEEASET

SEQ ID NO: 6736 - protein, 654 aa, Avena sativa
RATIAAKPHPPQTLAAAATSTTRLLADMAGNREAFRVAVGNTLERRLFYVPSFKIYGGVAGLYDYGPPGCAVKANVLAFWRQHFVLEEGMLEVDCPCVTPEVVLKASGHVEKFTDLMVKDEKTGSCYRADHLLKDFCKDKLERDTTLSPEKIEELNHILAVLDDLSAEQLGAKIKEYGIVAPDTKNLLSDPYPFNLMFQTSIGPSGLSAGYMRPETAQGIFVNFKDLYYYNGNKLPFAAAQIGQAFRNEISPRQGLLRVREFTLAEIEHFVDPEDKSHPKFSDVSDLEFLMFPREQQLTGRSATKLKLGGAVSEGTVNNETLGYFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGLAFKGNQKMVLEALEAMGETEALDMKSTLESKGEVEFKVCTLGKDVTVKKNMVSINIEKKKEHQRKFTPSVIEPSFGIGRIIYCLFEHCFYQRTGKTEDEQLNVFGFPPLVAPIKCTVFPLVKIEKFDVVAKKISKALTTVGISHIIDITGNSIGKRYARTDEIGVPLAITVDSTTSVTVRDRDSKDQIRVEVDEVASVVKEVTDGQSTWADIMWRYPAHTASAADEEEASET

SEQ ID NO: 6737 - protein, 673 aa, Oryza sativa
MLLSSASRALAAAKPRSPEPFAAAAAVLLRRQLAAGMAAAPASSASAAGNREAFRVAVTNTLERRLFYVPSFKIYGGVAGLYDYGPPGCAVKANVLAFWRQHFVLEEGMLEVDCPCVTPEVVLKASGHVDKFTDLMVKDEKTGTCYRADHLLKDFCKDKLEKDNTLSPEKTAEFNHVLAVLDDLSAEQLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFRDVSDLEFFMFPREQQLTGKSAMKLNIGQAVSEGTVNNETLGYFIGRVYLFLTQLGIDKDRLRFRQHLPNEMAHYAADCWDAEIECSFGWIECVGIADRSAYDLRAHSDKSGVALEAHEKFAEPREVEKLVITPSKKELGLAFKGNQRMVLEALEAMSETEALNMKSALESKGEVEFKVCTLGKDVTIKKSMVSINMEKKKEHQRKFTPSVIEPSFGIGRIIYCLFEHCFYQRPGKAEDEQLNVFGFPPLVAPIKCTVFPLVKIEKFEVVAKKISKALTAAGISHIIDMTGNTIGKRYARTDEIGVPLAITVDNTTSVTVRDRDSKDQIRVEVDEVASVVKEVTDGQSTWADIMWRYPAHTASAAEEEEASET

SEQ ID NO: 6738 - protein, 684 aa, Sorghum bicolor
MLLLRRGVFVLLSSPSPRAPLAKPLLPQRPPRTLAPTARQLVAMSAPAPTPAPSAGGAGTMSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDHTLSPEMVQEYNRVLAILDDLSAEQLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFLMFPREDQMAGRSATRLKLGNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQKMVLESLEAMTETEALDMKAVLESKGEVEFKVCTLGKDVTIKKNMVSINIEKKKEHQRKFTPSVIEPSFGIGRIIYCLFEHCFYQRAGKTEDEQLNVFRFPPLVAPIKCTVFPLVKLEKFEVVAKKISKALTAAGISHIIDMTGNTIGKRYARTDEIGVPLAITVDNTISVTVRDRDSKDQIRVEVDEVASVVKEVTDGQSTWADIMWRYPAHTTSAADEEDAEP

SEQ ID NO: 6739 - protein, 677 aa, Panicum virgatum
MLLLRRVCFLLPSPSPRAPLAKPLPLPLRPPRTLAPAARPLASMAAPAGGTAATSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDQTLSPEQAEEYNKILAILDDLSAEQLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFLMFPREDQMAGRSATRLKLGNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQRMILEALEAMGETEALEMKAALESKGEVEFKVCTLGKDVTIKKSMVSINIEKKKEHQRKFTPSVIEPSFGIGRIIYCLFEHCFYQRPGKAEDEQLNVFGFPPLVAPIKCTVFPLVKLEKFEVVAKKISKALTAAGISHIIDMTGNTIGKRYARTDELGVPLAITVDNTTSVTVRDRDSKDQIRVEVDEVASVVKEVTDGQSTWADIMWRYPAHTASVAEDEEAEP

SEQ ID NO: 6740 - protein, 636 aa, Pennisetum glaucum
MAAPAGGAAAAAMSRDAFRAAVTNTLERRLFFVPSFKIYGGVAGLYDYGPPGCAVKANVLAFWRQHFVLEEGMLEVDCPCVTPEVVLKASGHVEKFTDLMVKDEKTGNCYRADHLLKDFCKDKLEKDNTLSPEQTEEYNKILAILDDLSAEQLGAKIREYGIVAPDTKNSLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFLMFPREDQMAGSSATKLNIGNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQRMVLEALEAMGETEALDMKAALESKGEVEFKVCTLGKDVTIKKSMVSINIEKKKEHQRKFTPSVIEPSFGIGRIIYCLFEHCFYQRPGKTEDEQLNVFGFPPLVAPIKCTVFPLVKLEKFEVVAKKISKALTAAGISHIIDMTGNTIGKRYARTDEIGVPLAITVDNTTSVTVRDRDSKDQIRVEVDEVASVVKEVTDGQSTWADIMWRYPAHTSSAADDEDAEP

SEQ ID NO: 6741 - protein, 684 aa, Setaria italica
MLLLRRVSFLLPSPSFPRAPLAKPLPLLLLLLHPPRTPAPTARPLASMAAPAAPAGGTAAMSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDHTLSPEQTEEYNKILAILDDLSAEQLGSKIREYGIVAPDTKNPLSDPYPFNLMFQTSIGPSGLSSGYMRPETAQGIFVNFKDLYYYNGNKLPFAAAQIGQAFRNEISPRQGLLRVREFTLAEIEHFVDPEDKSHPKFGDVSDLEFLMFPREDQMAGRSAKRLKIGNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQRMVLEALEAMGETEALDMKAALESNGEVEFKVCTLGKDVTIKKSMVSINIEKKKEHQRKFTPSVIEPSFGIGRIIYCLFEHCFYQRPGKTEDEQLNVFGFPPLVAPIKCTVFPLVKLEKFEVVAKKISKALTAAGISHIIDMTGNTIGKRYARTDEIGVPLAITVDNTTSVTVRDRDSKDQIRVEVDEVASVVKEVTDGQSTWADIMWRYPAHTASAVDDEEAEP

SEQ ID NO: 6742 - protein, 624 aa, Saccharum officinarum
MSRDAFRAAVTNTLERRLFFVPSFKIYGGVAGLYDYGPPGCAVKANVLAFWRQHFVLEEGMLEVDCPCVTPEVVLKASGHVDKFTDLMVKDEKTGNCYRADHLLKDFCKDKLEKDHTLSPEMVEEYNRVLAILDDLSAEQLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFLMFPREDQMAGRSATKLKLRNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQKMVLESLEAMTETEALDMKAVLESKGEVEFKVCTLGKDVTIKKNMVSINIEKKKEHQRKFTPSVIEPSFGIGRIIYCLFEHCFYQRPGKTEDEQLNVFRFPPLVAPIKCTVFPLVKFEKFEVVAKKISKALTAAGISHIIDMTGNTIGKRYARTDEIGVPLAITVDNTTSVTVRDRDSKDQIRVEVDEVASVVKEVTDGQSTWADIMWRYPAHTASAADEEESQP

SEQ ID NO: 6743 - protein, 677 aa, Panicum virgatum
MLLLRRRVRFLLPSSLSSPRAPLAKPLPLPLRHPPRILASAARPLASMAAPAAMSRDAFRAAVTNTLERRLFFVSSFKIYSGVAGLYDYGPPGCAVKANVLAFWRQHFVLEEGMLEVDCPCVTPEVVLKASGHVDKFTDLMVKDEKTGNCYRADHLLKDFCKDKLEKDQTLSPEQAEEYNKILAILDDLSAEQLGAKIKEYGIVAPDTKNPLSDPYPFNLMFQTSIGPSGLSPGYMRPETAQGIFVNFKDLYYYNGNKLPFAAAQIGQAFRNEISPRQGLLRVREFTLAEIEHFVDPEDKSHPKFGDVSDLEFFMFPREDQMAGKSATRLKLGNAVSEGTVNNETLGYFIGRVYLFLTQLGIDKDRLRFRQHLPNEMAHYAADCWDAEIECSYGWIECVGIADRSAYDLRAHSDKSGEKLEAHEKFAEPREVEKLVITPSKKELGLAFKGNQRMVLEALEAMGETEALEMKAALESKGEVEFKVCTLGKDVTIKKNMVSINIEKKKEHQRKFTPSVIEPSFGIGRIIYCLFEHCFYQRPGKAEDEQLNVFGFTPLVAPIKCTVFPLVKLEKFEVVAKKISKALTAAGISHIIDMTGNTIGKRYARTDELGVPLAITVDNTTSVTVRDRDSKDQIRVEVDEVASVVKEVTAGQSTWGDIMWRYPAHTASAAEDEEAEP

SEQ ID NO: 6744 - protein, 696 aa, Triticum aestivum
QMSEYIKRLRACIRWLVELEDGYLAEQEKLRGQIDSDNARHAEFEAQLSGALEELKAANLEMTTRCDSLEESLNKEKADRLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQARKSSKDSELLRIKAAAFEETCSSQQEQIETLQKQLAVATEKLKHADVTAIEAMTGYESQKETIKDLEERLAYAEFQIIEADKLRKKLHNTILELKGNIRVFCRVRPFLSDTDSNGQEEAIISYPSSVENAGRGIDLMNQGQKCSFSYDKVFDHSASQDDVFVEMSQLVQSALDGYKVCIFAYGQTGSGKTYTMMGKPGRDQKGIIPRSLEQIFKTSQSLESQGWKYCMQASMLEIYNETIRDLLAPGRSSSEMPGGKQYTIKHDSQGNTTVSDLTTTNVFSTADVTSLLEKASHSRSVGKTQMNEQSSRSHFVFTLKIFGSNESTGQQVQGVLNLIDLAGSERLTKSGATGERLKETQAINKSLSALSDVIFAIAKNDDHVPFRNSKLTYLLQPCLGGDSKTLMFVNVSPEASSAGETLCSLRFASRVNACEIGVARRQTQSKSSSDNSNRLSYG

SEQ ID NO: 6745 - protein, 788 aa, Brachypodium distachyon
MASSLTPRSPYPKENLGNVRRGMGFKVAPRRNVLSAINNDGVNGEPAMAPSEGGSVGEVPTAPAVEFSGREDVERLLNEKMKGKSKNDYKGRTEQMSEYIKRLRACIRWYVELEDGYLAEQEKLRGSIDAENTRHAEFEMQLSSAIEELNATNSDMIRRCASLEESLDKEMADKLIAVESYEKERHERESAEASRDVLTVDLERVTHEAKRFSEQLKMVQDTNKRLLEYNTSLQQYNSNLQADTTKNGEIISKLQKEKSAMMEAMTNLKETNNSMKNQLDSSMTSQKEAIRVKEDLRKEVECLRTELQQVRDDRDQSVAQLNSLSAELAIYSEQAGKSSKECEVLRVKVLAFEETCNSQQEQIQTLQKQLAVATEKLKHADVTAIEAMTGYEAQKEKIKDLEERLAYAEFKIIEADKLRKKLHNTILELKGNIRVFCRVRPLLSDGDSNSQDEAMISYPTSVENAGRGIDLMNQGQKVSFSYDKVFNHGASQEDVFVEMSQLVQSALDGYKVCIFAYGQTGSGKTYTMMGKPGRDQKGIIPRSLEQIFKTSQSLESQGWKYCMQASMLEIYNETIRDLLAPGRSNNVEMSASKQYTIKHDAHGNTTVSELTIADVFSTADVTSLLEKASHSRSVGKTQMNEQSSRSHFVFTLKIFGSNESTGQQVQGVLNLIDLAGSERLAKSGSTGDRLKETQAINKSLSALSDVIFAIAKNDDHVPFRNSKLTYLLQPCLGGDSKTLMFVNISPEASSVGETICSLRFASRVNACEIGVPRRHTQARSFDSRLSYG

SEQ ID NO: 6746 - protein, 665 aa, Triticum aestivum
GQIDSDNARHAEFEAQLSGALEELKAANLEMTTRCDSLEESLNKEKAARLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQARKSSKDSELLRIKAAAFEETCSSQQEQIETLQKQLAVATEKLKHADVTAIEAMTGYETQKETIKDLEERLAYAEFQIIEADKLRKKLHNTILELKGNIRVFCRVRPFLSDSDSNGQEEAIISYPSSVENAGRGIDLLNQGQKCSFSYDKVFDHSASQDDVFVEMSQLVQSALDGYKVCIFAYGQTGSGKTYTMMGKPGRDQKGIIPRSLEQIFKTSQSLESQGWKYCMQASMLEIYNETIRDLLAPGRSSSEMAGGKQYTIKHDSQGNTTVSDLTTTNVFSTADVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEASSAGETLCSLRFASRVNACEIGVARRQTQSKSSSDNSNRLSYG

SEQ ID NO: 6747 - protein, 788 aa, Oryza sativa
MASSLTPRSPYPKKENLGNARRGMGVKPGPRRNVLSAINNGGGTNSDTASVDGGEGGAGPAAPVIEFTGREDVERLLAEKMKGKSKTDYKGRTEQMSEYIKKLRACIRWYIELEDGYLVEQEKLRSTMDAENAQHAKLEAQLSSDLEELKAAHLNLTRQCDSLEESFNKEKADRMLAVESYEKERQQRESAEASLDLLSVDLERVSHEAKRFSEQLKMVQDTNKRLQEYNTSLQQYNSNLQADASKSGDIISKLQKEKSAMMETMASLKDLNNSMKNHLDSSRTSQQEAIRMKEQLMKEVDCLRIELHQIREDRDQSVSQVNTLSAELANYKELAGKSTKDCESLSVKVSAFEETCSMQQEQIQTLQKQLAVATNKLKLADVTAIEAMTGYEEQKVIIKDLEERLASAEFQIVEADKLRKKLHNTILELKGNIRVFCRVRPLLQDNDSSGAEEALISYPTSVESAGRGIDLMNQGQRFSFSYDKVFDHGASQEDVFVEMSQLVQSALDGYKVCIFAYGQTGSGKTYTMMGPPGRDQKGIIPRSLEQIFKTSQSLESQGWKYSMQASMLEIYNETIRDLLAPGRSNNFDLSTSKQYTIKHDPQGNTTVTDLTVADVFSSADVTSLLAKASQSRSVGRTQMNEQSSRSHFVFTLKISGSNENTGQQVQGVLNLIDLAGSERLAKSGSTGDRLKETQAINKSLSALSDVIFAIAKGDDHVPFRNSKLTYLLQPCLGGDSKTLMFVNISPEASSVGETICSLRFASRVNACEIGIPRRHTQARSFDSRLSYG

SEQ ID NO: 6748 - protein, 183 aa, Triticum aestivum
MALQVWMVGENGEDLKNHRELLPLSKLQEIGVLYWHLDPKKSESEEELAKIRKDRGYNYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLTDDNAGLALAAH

SEQ ID NO: 6749 - protein, 183 aa, Pseudoroegneria spicata
  misc_feature (105)..(105): Xaa can be any naturally occurring amino acid
MALQVWMVGENGEDLNNHRELLPLCKLQEIGVLYWHLDPKKSESEEELAKIRKDRGYSYMDYLDICPGKLANFEEKLKNFFTEHMHADEEIRYCLEGGGYFDVRXKDDKWVRIWIKEGDMIVLPAGIYHRFTLDAANHVKLMRLFLGEPVWTAHNRPQEDHPVRQEYVKRLTDDSAGLALAAH

SEQ ID NO: 6750 - protein, 183 aa, Secale cereale
MALQVWMVGEDGEDLNNHRELLPLSKLQEIGVLYWHLDPKKPESEEELAKIRKDRGYNYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLTDDNAGLALAAH

SEQ ID NO: 6751 - protein, 183 aa, Secale cereale
MALQVWMVGEDGEDLNNHRELLPLSKLQEIGVLYWHLDPKKPESEEELAKIRKDRGYNYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLIDDNAGLALAAH

SEQ ID NO: 6752 - protein, 183 aa, Secale cereale
MALQVWMVGEDGEDLNNHRELLPLSKLQEIGVLYWHLDPKKAESEEELAKIRKDRGYNYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLIDDNAGLALAAH

SEQ ID NO: 6753 - protein, 183 aa, Triticum aestivum
MALQVWMVGEDGEDLDNHKELLPLSKLQEIGVLYWHLDPKKSESEEELAKIRKDRGYNYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLTDDNAGLALAAH

SEQ ID NO: 6754 - protein, 183 aa, Secale cereale
MALQVWMVGEDGEDLNNHRELLPLSKLQEIGVLYWHLDPKKPESEEELAKIRKDRGYNYMDYLDICPGKLANFEEKLKNFFTEHMHADEEIRYCLEGGGYFDVRDKDDKWVRIWIKEGDMVVLPAGIYHRFTLDAANHVKLMRLFLGEPVWTAHNRPQEDHPVRQEYVKRLIDDNAGLALAAH

SEQ ID NO: 6755 - protein, 171 aa, Secale cereale
MALQVWMVGEDGEDLNNHRELLPLSKLQEIGVLYWHLDPKKPESEEELAKIRKDRGYNYMDYLDICPGKLANFEEKLKNFFTEHMHADEEIRYCLEGGGYFDVRDKDDKWVRIWIKRDMIVLPAGIYHRFTLRCRQPCEAHEALPRRTSLDCAQPASGGPSGAARVCQEAH

SEQ ID NO: 6756 - protein, 124 aa, Secale cereale
MDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLIDDNAGLALAAH

SEQ ID NO: 6757 - protein, 183 aa, Triticum aestivum
MALQVWMVGEDGEDLDNHKELLPLSKLQEIGVLYWHLDPKKSESEEELAKIRKDRGYNYMDYLDICPGKLANFEEKLKNFFTEHMHADEEIRYCLEGGGYFDVRDKDDKWVRIWIKEGGMIVLPAGIYHRFTLDAANHVKLMRLFLGEPVWTAHNRPQEDHPVRQEYVKRLMDDNAGLALAAH

SEQ ID NO: 6758 - protein, 183 aa, Triticum aestivum
MAPQVWMVGEDGEDLKNHGELLPLSKLQEIGVLYWHLDPKKPESEEELAKIRKDRGYNYMDYLDIRPGKLANFEEKLKNFFTEHMHADEEIRYCLEGGGYFDVRDKDDKWVRIWIKEGGMIVLPAGIYHRFTLDAANHVKLMRLFLGEPVWTAHNRPQEDHPVRQEYVKRLMDDNAGLALAAH

SEQ ID NO: 6759 - protein, 179 aa, Leymus cinereus x Leymus triticoides
MALQMWMVGENGEDLKNRKEFLPLSKLQEIGVLYWHLDPKKSESEEELTKIRKDRGYSYMDFLEICPGKLANFEEKLKNFFTEHMHADEEIRYCLEGGGYFDVRDKDDKWVRIWIKEGDMIVLPAGIYHRFTLDAANRVKLMRLFLGEPVWTAHNRPQEDHPVRQEYVKRLTDDNAGLA

SEQ ID NO: 6760 - protein, 182 aa, Festuca arundinacea
MALQVWMVGENGEDLKNPKEFLPVSKLEEIGVLYWHLDPKKSESEEELSKIRKDRGYSYMDLLEICPGKLENYEEKLKNFFREHMHADEEIRYCLEGGGYFDVRNKDDKWIRIWIKEGDMIVLPAGIYHRFTLDTANHVKLMRLFIGEPVWTAHNRPQEDHPVRQEYVKNLTDNAGLPLAAH

SEQ ID NO: 6761 - protein, 182 aa, Brachypodium distachyon
MVLQVWMVGENGEDLENAKEFLPLSKLEEIGVLYWHLDPKKSEAEEELMKIRKDRGYSYMDLLEICPDKLENYEEKLKNFFREHMHADEEIRYCLEGGGYFDVRDKDDKWIRIWIKEGDMIILPAGIYHRFTLDGANRVKLMRLFIGEPVWTAHNRPQEDHPVRQEYVKNLTDNTGLALAAH

SEQ ID NO: 6762 - protein, 586 aa, Triticum aestivum
MERILKSARESGSLNLSNRSLSEVPGEVYNNLDTGSLDDKWWEGVDLQKLILAHNNLEVLREDLRNLSSLVVLNISHNQISSLPAAIGDLPLLKSLDASFNQIKLIPEEVGLATALVKVDFSNNCLTELPASLGRCLNLSELKASNNNISRLPDELAGCCKLSKFDLEGNKLVLLPENMFTSWTLLTELNAAKNQLTAIPASIGALSKLVRMDLHQNKITSIPSSIKGCSSLAEFYMGNNLLSTIPDDIGMLSKLGTLDLHSNQLKEYPVGACKLKLSFLDLSNNALSGLPPELGTMTTLRKLLLSGNPMRALRSSLVSGPTSTLMKYLRSRLSSEEEASGSRTTPTKDDQISAARRLSVSSKELNLSGLGVPNVPPAAWETSDVVKLDLSKNLIEDLPNELSLCSSLQALILSNNKIKKWPGMVVSSLPSLTTLKLDNNPLAEISSTDLVSLSKLEVLDLSGNASSFSESSVVSSLPQLHELYLRRMKLQEFPIGLVQLKHLRILNLSQNNLSTIPEGIKDFSALIELDLSDNNITRLPAELGLLEPSLQVLKLDGNPLRSIRRTVLERGTKAVLSYLKEKLPSN

SEQ ID NO: 6763 - protein, 586 aa, Secale cereale
MERILKSARESGSLNLSNRSLSEVPGEVYNNLDTGSLDDKWWEGVDLQKLILAHNNLEVLREDLRNLSSLVVLNISHNQISSLPAAIGDLPLLKSLDVSFNQIKLVPEEVGLATALVKVDFSNNCLTELPASLGRCLNLSELKASNNNISRLPDELSGCCKLSKFDLEGNKLVLLPENMFTSWTLLTELNAAKNQLTTIPASIGALSKLVRMDLHQNKITSIPSSIKGCSSLAEFYMGNNLLSTIPDDIGMLSKLGTLDLHSNQLKEYPVGACKLKLSFLDLSNNALSGLPPELGTMTTLRKLLLSGNPMRALRSSLVSGPTSTLMKYLRSRLSSDEEASGSRTIPRKDDQISAARRLSVSSKELNLSGLGVPNVPPAAWETSDVVKLDLSKNLIEDLPNELSLCSSLQALILSNNKIKKWPGMVVSSLPSLTSLKLDNNPLAEISSTDLESLSKLEVLDLSGNASSLSEPSVVSSLPQLQEIYLRRMKLQEFPIGLVQLKHLRILSLSQNNISTIPEGIKDFNALIELDLSDNNITRLPAELGLLEPSLQVLKLDGNPLRSIRRTVLERGTKAVLSYLKEKLPSN

SEQ ID NO: 6764 - protein, 586 aa, Triticum aestivum
MERILKSARESGSLNLSNRSLSEVPGEVYNNLDTGSLDDKWWEGVDLQKLILAHNNLEVLREDLRNLSSLVVLNISHNQLSSVPAAIGDLPLLKSLDASFNQIKLIPEEVGLATALVKVDFSNNCLTELPASLGRCLNLSELKASNNNISRLPDELAGCCKLSKFDLEGNKLVLLPENMFTSWTLLTELNAAKNQLTAIPASIGALSKLVRMDLHQNKITSIPSSIKGCSSLAEFYMGNNLLSTIPDDIGMLSKLGTLDLHSNQLKEYPVGACKLKLSFLDLSNNALSGLPPELGTMTTLRKLLLSGNPMRALRSSLVSGPTSTLMKYLRSRLSSEEEASGSRATPTKVDQISAARRLSVSSKELNLSGLGVPNVPPAAWETSDVVKLDLSKNLIEDLPNELSLCSSLQALILSNNKIKKWPGMVVSSLPSLTSLKLDNNPLAEISPTDLESLSKLEILDLSGNASSLSEPSVVSSLPQLQELYLRRMKLQEFPIGLVQLKHLRILNLSQNNLTTIPEGIKDFSALIELDLSDNNITRLPAELGLLEPSLQVLKLDGNPLRSIRRTVLERGTKAVLSYLKEKLPSN

SEQ ID NO: 6765 - protein, 162 aa, Secale cereale
MVVSSLPSLISLKLDNNPLAEISSTDLESLPKLEVLDLSGNASSLSEPSVVSSLPQLQEYILGNETSGISYWSCTIKHLRILSLSQNNISTIPEGIKDFNALIELDLSDNNITRLPAELGLLEPSLQVLKLDGNPLRSIRRTVLERGTKAVLSYLKEKLPSN

SEQ ID NO: 6766 - protein, 586 aa, Brachypodium distachyon
MERILKSARESGSLNLSNRSLREVPGEVYNNLDTGSQDDKWWEGVDLQKLILAHNNLEVLREDLRNLSSLVVLNISHNQIYSLPAAIGDLPLLKSLDISFNQINTVPEEIGLAAALVKVDFSNNCLTELPASLAGCLNLSELKASNNKISRIPDELAGCSKLSKLDLEGNKLEMLSENMFSSWTILTELNAAKNILTTIPASIGALSKLIRLDLHQNKITLIPSSIKGCSSLAEFYMGNNLLLSIPADIGMLSKLGTLDLHSNQLKEYPVGACKLKLSFLDLSNNTLSGLPPELGTMTTLRKLLLSGNPMRTLRSSLVSGPTSTLLKYLRSRLSSDEEASGSGRTPTKDDQVAAARRLSLSSKELNLSGLGVTSVPPAAWETSDVVKLDLSKNSIEDLPNELTLCSSLQALVLSNNKIKKWPGMVVSSLPSLSSLKLDNNPLAEISSTDLEVLSKLEVLDLSGNASSLTKPSALSSLPQLQELYLRRVKLHEFPIGLLGLKLLRILDLSQNYLTTIPEGIKEFTALIELNLSDNNITALPAELGLLEPNLQVLKLDGNPLRSIRRTVLDRGTKAVLQYLKDKLPSH

SEQ ID NO: 6767 - protein, 586 aa, Sorghum bicolor
MERILKSARESGSLNLSNRSLREIPKEVYNNLDTGSQDEKWWEGVDLQKLILAHNNLEVLREDLRNLSSLVVLNISHNNISSLPAAIGDLPLLKSLDISFNQINTLPEEIGLATALVKVDFSNNFLTELPPSLAKCPDLSELKASNNNISRIPDVLAGCSKLSKLDLEGNKLVMLSENMFVSWTMLTELNLAKNLLTAIPSSIGALPKLIRLDMHQNKITSIPPSIKGCSSLAEFYMGNNLLSSIPADIGMLSKLGILDLHSNQLKEYPVGACNLKLSFLDLSNNSLSGLPAELGKMTTLRKLLLTGNPMRTLRSSLVSGPTTTLLKYLRSRLSSDEEASGSGSTPTKDDQIAAARRLSLSSKELDLSGLGVTSVPAAAWETSDVVKLDLSKNSIEDLPNELSLCSSLQSLVLSNNKIKKWPRTVVSSLPSLSSLKLDNNPLVEISSTDLVPLSKLEVLDLSGNASALPEPSAVSALPQLHELYLRRMKLHEFPNGLLGLKQLRILDLSQNSLTTVPEGIKNFTALIELDLSDNNITALPAELGLLEANLQVLKLDGNPLRSIRRTLLERGTKAILKYLKEKLPAE

SEQ ID NO: 6768 - protein, 585 aa, Setaria italica
MDRILKSARESGSLNLSNRSLREIPKEVYNNLDTGSQDEKWWEGVDLQKLILAHNNLEVLREDLRNLSSLVVLNISHNKISSLPAAIGDLPLLKSLDVSFNQINTLPEEIGLATALVKVDFSNNCLTELPSSLAKCPDLLELKASNNNISRIPDILGCSKLSKLDLEGNKLVTVSENMFASWTMLTELNLAKNLLTTTPDSIGALSKLIRLDMHQNKITSIPPSIKGCSSLAELYMGNNLLSSIPADIGTLSKLGILDLHSNQLKEYPVGACNLKLSFLDLSNNSLSGLPAELGKMTTLRRLLLTGNPMRTLRSSLVSGPTTTLLKFLRSRLSSDEEGSGSTSTPTKDDQIAAARRLSLSSKELNLSSLGVTSVPAVAWETSDVVKLDLSKNSIEDLPNELSLCSSLQSLVLSNNKIKRWPHTVISSLTSLSSLKLDNNSLAEISSTDLLSLSKLEVLDLSGNASALPEPSAVSASPQLQELYLRRMKLHEFPNGLLGLKQLRILDLSQNNLTTVPEGIKNFTALIELDLSDNNITALPAELGLLEPNLQVLKLDGNPLRSIRRTLLERGTKAILKYLKEKLPAE

SEQ ID NO: 6769 - protein, 586 aa, Panicum virgatum
MDRIFKSARESGSLNLSNRSLRDIPKEVYNNLDTGSQDEKWWEGVDLQKLILAHNNLEVLREDLRNLSSLVVLNISHNKISSLPAAIGDLPLLKSLDASFNQISTLPEEIGLATALVKVDLSNNCLSELPASLAKCSDLSELKASNNTISRIPDALAGCSKLSKLDLEGNKLVTISENMFPSWTMLTELNLARNLLTTTPDSIGALHKLIRLDMHQNKITSIPPSIKGCSSLAELYMGNNLLSSIPADIGTLSKLGILDLHSNQLKEYPVGACNLKLSFLDLSNNSLSGLPAELGKMTTLRKLLLSGNPMRTLRSSLVSGPTTALLKYLRSRLSSDEEGSGSTSTPTKDDQIAAARQLSLSSKELDLSGLGVTSVPAVAWETNDVVKLDLSKNSIEDLPNELSICSSLQSLVLSNNKIKRWPHTVISSLTSLSSLKLDNNPLAEISFTDLVSLAKLEVLDLSGNASALPEPSAVSALPQLQELYLRRMKLHEFPNGLLDLKQLRILDLSQNNLTTVPEGIKNFTVLIELDLSDNNITALPAELGLLEPNLQVLKLDGNPLRSIRRTLLERGTKAILKYLKEKLPAQ

SEQ ID NO: 6770 - protein, 489 aa, Zea mays
MSFNQINTLPEEIGLATALVKVDFSNNCLTELPPNLATCPDLSELKASNNNISRVPDVLAGCSKLSKLDLEGNKLVALSENMFVSWTMLTELNLAKNLLTAIPGSIGALPKLIRLDMHQNKITSIPPSIKGCSSLAELYMGNNLLSSIPADIGTLSKLGILDLHSNQLKEYPVGACNLKLSFLDLSNNSLSGLPAELGKMTTLRKLLLTGNPMRTLRSSLVSGPTTTLLKYLRSRLSSDEEASGSRSTPTKDDQIAAARRLSLSSKELDLSGLGVTSVPAAAWETSDVVKLDLSKNSIEDLPNELSLCSSLQSLVLSNNKIKRWPHTVVSSLPCLSSLKLDNNPLVEISSTDLVPLSKLEVLDLSGNASALPEPSAVSALPQLQELYLRRMKLHEFPNGLLGLKLLRILDLSQNHLTTVPEGIKNFTALIELDLSDNNITALPAELGLLEANLQVLKLDGNPLRSIRRTLLERGTKAVLKYLKEKLPSE

SEQ ID NO: 6771 - protein, 134 aa, Secale cereale
MGSLRSSGSGAAVPVESVDPEAACALLASGQYGYVDVRMWEDFDKGHVAGARNVPYYLSVTPNGKEHNPHFVDQVAALHSKEDRFLVGCRSGVRSRLATADLVAAGFTNVKNLEGGYLSLLKSASYPQPTSSNH

SEQ ID NO: 6772 - protein, 134 aa, Secale cereale
MGSLRSSGSGAAVPVESVDPEAACALLASGQYGYVDVRMWEDFDKGHVAGARNVPYYLSVTPNGKEHNPHFVDQVAALHSKEDRFLVGCRSGVRSRLATADLVAAGFTNVKNLEGGYLSLLKSASYPQSTSSNH

SEQ ID NO: 6773 - protein, 134 aa, Secale cereale
MGSLRSSGSGAAVPVESVDPEAACALLASGQYGYVDVRMWEDFDKGHVAGARNVPYYLSVTPHGKEHNPHFVDQVAALHSKEDRFLVGCRSGVRSRLATADLVAAGFTNVKNLEGGYLSLLKSASYPQSTSSNH

SEQ ID NO: 6774 - protein, 134 aa, Secale cereale
MGSLRSSGSGAAVPVESVDPEAACALLASGQYGYVDVRMWEDFDKGHVAGARNVPYYLSVTPHGKEHNPHFVDQVAALHSKEDRFLVGCRSGVRSRLATADLVAAGFTNVKNLEGGYLSLLKSASYPQTTAIHY

SEQ ID NO: 6775 - protein, 134 aa, Secale cereale
MGSLRSSGSGAAVPVESVDPEAACALLASGQYGYVDVRMWEDFDKGHVAGARNVPYYLSVTPHGKEHNTHFVEQVAALHSKEDRFLVGCRSGVRSRLATADLVAAGFTNVKNLEGGYLSLLKSASYPQPTSSNH

SEQ ID NO: 6776 - protein, 134 aa, Triticum aestivum
MGSLRSSGSGAAVPVESVDPEAACALLASGQYGYVDVRMWEDFDRGHVAGARNVPYYLSVTPHGKEHNPHFVDQVAALHAKEDRFLVGCRSGIRSRLATADLVAAGFTNVKNLEGGYLSLLKSASYPQPAASHH

SEQ ID NO: 6777 - protein, 134 aa, Triticum aestivum
MGSLRSSGSGAAVPVESVDPEAACVLLATQQYGYVDVRMWEDFDKGHVAGARNVPYYLSVTPHGKERNPHFVDQVAALHAKEDRFLVGCRSGVRSRLATADLLAAGFTNVKNLQGGYLSLLKSASYSQPTASHQ

SEQ ID NO: 6778 - protein, 134 aa, Secale cereale
HGSLRSSGSGAAVPVESVDPEAACALLASGQYGYVDVRMWEDFDKGHVAGARNVPYYLSVTPHGREHNPHFVDQVAALHAKEDRFLVGCRSGIRSRLATADLVAAGFTNVKNLEGGYLSLLKSASYPQPAAGHH

SEQ ID NO: 6779 - protein, 132 aa, Triticum aestivum
MGSLRSSTSAAVESVDAEAACGLLASEQYGYVDVRMWEDFEKGHVAGARNVPYYLSVTPHGKERNPDFVDQVAALHSKEDRFLVGCRSGVRSRLATADLVAAGFANVKNLQGGYLSLLKSTSYPQPQAASHQ

SEQ ID NO: 6780 - protein, 132 aa, Triticum aestivum
MGSLRSSTSTAVESVDAEAACGLLALEQYGYVDVRMWEDFEKGHVAGARNVPYYHSVTPHGKERNPDFVDQVAALHSKEDRFLVGCRSGVRSRLATADLVAAGFMNVKNLEGGYLSLLKSTSYPQPQAASHQ

SEQ ID NO: 6781 - protein, 129 aa, Hordeum vulgare
MGSLRSSTSTAVDSVDAEAACALLALEQYGYVDVRMWEDFEKGHVAGARNVPYYLSVTPHGKERNPDFVDQVAALHSKEDRFLVGCRSGVRSRLATADLVAAGFANVKNLEGGYLSLLKSASYQAASHQ

SEQ ID NO: 6782 - protein, 136 aa, Hordeum vulgare
MGSLGSRDGEKRHAVESVGTEAACALLVSEQYGYVDVRMWEDFDRGHVAGARNVPYYLSVNPHGKERNLDFVDQVAALHSKHDRLLVGCRSGVRSRLATTDLVAAGFTKVKNLEGGYLSLLKSVSYPQQAAAAIHH

SEQ ID NO: 6783 - protein, 132 aa, Secale cereale
MGSLRSSTSAAVESVDAEAACGLLALEQYGYVDVRMWEDFEKGHVAGARNVPYYLSVTPHGKEPNPDFVQQVAALHSKEDRFLVGCRSGIRSRLATADLVAAGFANVKNLDGGYLSLLKSTSYPQPQAASHQ

SEQ ID NO: 6784 - protein, 132 aa, Secale cereale
MGSLRSSTSAAVESVDAEAACGLLALEQYGYLDVRMWEDFEKGHVAGARNVPYYLSVTPHGKERNPDFVEQVAALHSKEDRFLVGCRSGIRSRLATADLVAAGFANVKNLDGGYLSLLKSTSYPQPQAASHQ

SEQ ID NO: 6785 - protein, 132 aa, Secale cereale
MGSLRGSTSTAVESVDAEAACGLLALEQYGYVDVRMWEDFEKGHVAGARNVPYYLSVTPHGKERNPDFVEQVAALHSKEDRFLVGCRSGIRSRLATADLVAAGFANVKNLDGGYLSLLKSTSYPQPQAASHQ

SEQ ID NO: 6786 - protein, 712 aa, Brachypodium distachyon
MEESFVPLRGIKNDLRGRLTCYKQDWTGGFRAGIRILAPTTYIFFASAIPVISFGEQLERSTDGVLTAVQTLASTALCGIIHSIVGGQPLLILGVAEPTVIMYTFMFSFAKDRPDLGPNLFLAWAGWVCVWTAILLFLLAVLGACSIINRFTRIAGELFGLLIAMLFMQQAIKGLVDEFGIPERENIKARQFVPSWRFANGMFAIVLSFGLLLTALKSRKARSWRYGAGWLRGFIADYGVPLMVLVWTGISYIPYDSVPKGIPRRLFSPNPWSPGAYDNWTVIKDMPHVPLMYIIGAFIPATMIAVLYYFDHSVASQLAQQAEFNLRKPPSFHYDLLLLGFLTLLCGLIGIPPSNGVIPQSPMHTKSLATLKHQILRNRLVATARQSMRQNASLSQLYGSMQDAYQQIQTPLIYQQQSVKGLNELKDSTVQLASSMGNIDAPVDETIFDIEKEIDDLLPMEVKEQRLSNLLQAAMVGGCVAAMPLLKKIPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLATQDIDVALGRTQSAEILDDMVTRSRGEIKRLNSPKITSSGGTPVAELKGIRSPCISEKAYSPRVTELRHERSPLGERDSPRTGETRASKLGEGSAPK

SEQ ID NO: 6787 - protein, 722 aa, Elaeis guineensis
MSIEETFVPFRGIKNDLQGRLMCYKQDWTSGFRAGIRILAPTTYIFFASAIPVISFGEQLERNTDGVITAVQTLASTALCGIIHSIIGGQPLLILGVAEPTVLMYTFMFNFAKDRADLGRKLFLAWTGWVCVWTAFLLFLLAILGACSIINRFTRVAGELFGLLIAMLFMQQAIKGLVDEFRIPKRENPKSLEFVPSWRFANGMFAIVLSFGLLLTALRSRKARSWRYATGWLRGLIADYGVPLMVLVWTGISYIPSGSIPKGIPRRLFSPNPWSPGAYENWTVIKDMLNIPFLYILGAFIPATMIAVLYYFDHSVASQLAQQKEFNLRKPPSFHYDLLLLGFLTLLCGLIGIPPSNGVIPQSPMHTKSLATLKHQLLRNRLVAAAHQSMRQNSSLSQLYENMQDAYRQMQTPLIYQEQSDRGLKELKDSTIQLASSMGNIDAPVDESVFDIEKEIDDLLPVEVKEQRLSNLLQSMTVAGCVAAMPFLKKIPTSVLWGYFAFMAIESLPGNQFWERILLLFTAPSRRYKVLEEYHATFVETVPFKTIAAFTLFQTAYLLLCFGITWIPIAGVLFPLMIMLLVPVRQYVLPKLFKGAHLTDLDAAEYEELPAIKFDLETEIESGIRHSFAEDREILDELVTRSRGEIKHICSPKVTSSSGTPATEIKSFQSPRLSSEKAYSPRVSELRQEHSPRLSGRGPSSPRTGEIRPSKLGEGARLSTSK

SEQ ID NO: 6788 - protein, 716 aa, Musa acuminata
MEETFEPFHGIKNDLRGRLMCYKQDWSSGFNAGIRILAPTTYIFFASAIPVISFGEQLERNTDGVLTAVQTLASTALCGIIHSIIGGQPLLILGVAEPTVLMYTFMFNFVKDRADLGRNMFLAWTGWVCVWTAFLLFLLAILGACSIINRFTRLAGELFGLLIAMLFMQQAIKGLVDEFRIPKREDPRDVALMSSWRFANGMFALVLSFGLLLTALRSRKARSWRYGTGWLRGFIADYGVPLMVLVWTGVSYMPAGGVPRGIPRRLLSPNPWSPGAYQNWTDMLNVPFLYILGAFIPATMIAVLYYFDHSVASQLAQQQEFNLRKPPSFHYDLLLLGFLTLLCGLIGIPPSNGVIPQSPMHTKSLATLKHQLLRNRLVATARQSMSQNSSLSQLYGSMQDAYRQMQTPLIYQGQSARGLKELKDSTVQLASSMGSMDAPVDDSVFDIDKEIDDLLPVEVKEQRLSNLLQAMMVAGCVAAMPLLKKIPTSVLWGYFAFMAIESLPGNQFWERILLLFTAPSRRYKVLEDYHATFVESVPFKAITAFTIFQTAYLLVCFGITWIPIAGVLFPLMIMLLVPVRQYILPKLFKGAHLTDLDAAEYEESPAITFNLPTEVDMGRGYSFSETREVLDEIVTRSRGEIKHMNSPKVTSSGGTPATDVRGLSSPRLSEKAYSPRVGELRPERSPRVGGRRAFSPRMGEIKPSKLGEGGLNSPMK

SEQ ID NO: 6789 - protein, 713 aa, Theobroma cacao
MEESFVPFRGIKNDLRGRLKCYKQDWTGGFGAGFRILAPTTYIFFASAIPVISFGEQLERDTDGVLTAVQTLASTALCGIIHSIIGGQPLLILGVAEPTVIMYTFMFNFAKNRLDLGSELFLAWTGWVCVWTAILLFLLAILGACSIINRFTRLAGELFGLLIAMLFMQQAIKGLVDEFRIPERENPKLVEFQPSWRFANGMFALVLSFGLLLTALRSRKARSWRFGSGSLRGFIADYGVPLMVLVWTAISYVPAGTIPKGIPRRLFSPNPWSPGAYENWTVIKDMLKVPVLYIIGAFIPATMIAVLYYFDHSVAAQLAQQKEFNLRKPPSFHYDLLLLGFLTILCGLIGIPPANGVIPQSPMHTKSLATLKHQLLRNRLVATARKCMRKNGSLGQVYESMQEAYQQMQTPLIYQEPSARGLKELKESTIQMASNMGNINAPVDETVFDVEKEIDDLLPVEVKEQRLSNLLQATMVGGCVAAMPFIKKIPTSVLWGYFAFMAIESLPGNQFWERILLLFTAPSRRYKVLEEYHATFVETVPFKTIAVFTIFQTAYLFVCFGITWIPIAGVLFPLMIMLLVPVRQYILPKFFKGPHLQDLDAAEYEESPAVPFNLVTEGELVRTASFADDEEILDGMITRSRGEIRRMCSPKVTSSTATPSKEFKSLQSPRFSEKVYSPRVSELREEQSPGKVGRGSFSPRTHEGKPSNLGKSG

SEQ ID NO: 6790 - protein, 709 aa, Manihot esculenta
MEESFVPFRGIKNDLKGRLMCYKQDWTGGFKAGFRILAPTTYIFFASAIPVISFGEQLERDTDGVLTAVQTLASTALCGIIHSIIGGQPLLILGVAEPTVIMYTFMFNFAKSRPDLGSKLFLAWTGWVCVWTAILLFLLAILGACSIINRFTRLAGELFGLLIAMLFMQEAIKGLVDEFCIPDRENPKSIQFEFSWRFANGMFALVLSFGLLLTALKSRKARSWRYGSGSLRGCIADYGVPLMVLVWTAVSYIPSGSIPKGIPRRLLSPNPWSTGAYENWTDMLNVPVLYVIGAFVPATMIAVLYYFDHSVASQLAQQKEFNLRKPPSFHYDLLLLGFMVILCGLIGIPPSNGVIPQSPMHTKSLATLKHQLLRNRLVATARKCMSENSSLGQVYESMQEAYQQMQTPLIYQEPSALGLKELKDLTIQIASVGNIDAPVDETVFDVEKEIDDLLPVEVKEQRVSNLLQAIMVGGCVAAMPFIKKIPTSVLWGYFAFMAIESLPGNQFWERILLLFTAPSRRYKVLEEYHATFVETVPFKTIAIFTVFQTAYLLVCFGITWIPIAGVLFPLMIMLLVPVRQYILPKCFKGAHLQDLDAAEYEEAPALSFNLATEIEMSRSASFADDGEILDGMITRSRGEIKSIRSPRVASSTSTPSKEFKTIHSPRFSDKVYSPRVSELKGELSPRQGGRGPFSPRTGEARPSNLGKTG

SEQ ID NO: 6791 - protein, 715 aa, Prunus mume
MEETFVPFQGIKNDLRGRLLCYKQDWTGGFKAGFRILAPTTYIFFASAIPVISFGEQLERNTDGVLTAVQTLVSTAVCGIIHSIIGGQPLLILGVAEPTVIMYTFMFNFAKERADLGPKLFLAWSGWVCVWTAALLFLLAILGACSIINRFTRVAGELFGLLIAMLFMQQAIKGLVDEFRLPQREDTSLPQFVPSWRFANGMFALVLSFGLLLTALKSRKARSWRYGSGWLRGFVADYGVPLMVLVWTGVSYIPTSTVPHGIPRRLFSPNPWSPGAYDNWTVIKDMLNVPILYIIGAFIPATMIAVLYYFDHSVASQLSQQKEFNLRKPSSYHYDLLLLGFLTLMCGLLGIPPSNGVIPQSPMHTKSLATLKHQLLRNRLVATARKSMRKNASLGQLYGNMQEAYRQMQTPLIYQEASARGLNELKESTIQAASSMGNYIDAPVDETVFDVEKEIDDLLPVEVKEQRLSNLLQAILVGGCVAAMPILKKIPTSVLWGYFAFMAIESLPGNQFWERILLLFTAPSRRYKVLEEYHATFVETVPFKSIALFTVFQTLYLLVCFGLTWVPIAGVMFPLMIMLLVPVRQYVLPKFFKGAHLQDLDAAEYEEAPALPFNLATEAELGAGASYAGDAEILDEVMTRSRGEFRHVSSPRITSSTSTPGNAPKILESPHSFSPRVNELRGERSPRSGGRGPNSPRTPGSSSILGKSPSNNTTS

SEQ ID NO: 6792 - protein, 347 aa, Sorghum bicolor
MEVGDLHKVWEVRALKTKPDAAAARATLDRVARQVQPIMRRHKWRVKVLSEFSPRNPRLLGLNVGGGVEVKLRLRRAGRDHDFIPYEEVLDTMLHELCHNQRGPHDAQFYKLWDELRKECEELVSKGITGTGQGFDGTGRRVGGFTVHPPPPSLRQATLAAAQKRARNGALLPSGPRKLGGNSEIMSALSPVQAAAMAAERRMYDDLWCGSHDQSGIDDSDDVIILQEPPNLVTRDGKHTKASCSNTFAEPSTSSGIHIAARDDRTSDALDSSKWECGACTLLNQPLAPICEVCGTAKPKIAKAKYMTWSCKFCTLENSTKLDKCSACDQWRYSYGPPVATHGPSYD

SEQ ID NO: 6793 - protein, 350 aa, Zea mays
MEVGDLHKVWEVRALKIKPDATAARATLDRVARQVQPIMRRHKWRVKVLSEFSPRNPRLLGLNVGAGVEVKLRLRRAGRDHDFIPYEEVLDTMLHELCHNERGPHDAQFYKLWDELRKECEELVSKGITGTGQGFDGTGRRVGGFTVHPPPPSLRQATLAAAQKRARNGALLPSGPRKLGGNSEIMSALSPVQAAAMAAERRMYDDLWCGSHDQSAIDDSDDVIILQESPNLTRDEKDKGSCSNTSAQPSTSSRIHIAARDDRTTSDALDSSKWECGACTLLNQASFIPLAPICEVCGTTKPKIAKAKYTTWSCKFCTLENSTKLDKCSACDQWRYSYGPPVATYGPSYD

SEQ ID NO: 6794 - protein, 352 aa, Oryza sativa
MEVGDLHKVWEIRALKRKPDEPAARALLDRVAKQVQPIMRRRKWRVKVLSEFSPKNPRLLGLNVGGGVEVKLRLRHAGRDYDFIPYEEVLDTMLHELCHIARGPHDAQFYKLWDELRKECEELVSKGITGSGQGFDGTGRRLGGFTVHPPPPSLRQATLAAAQKRARNGALLPSGPRKLGGNNDIMSALSPIQAAAMAAERRMYDDLWCGSHDQSGIDDSEDVVILEDTPNLPTQLGKSTKDGFSSSSENPSTSSGFPTAAQNGSSSCRITTDAGDSSLWECVACTLLNQPLAPICEVCSAAKPKTTKAKYATWSCKFCTLENSTKIDKCSACDQWRYSHGPPAATYCPSYD

SEQ ID NO: 6795 - protein, 159 aa, Secale cereale
MEVGDLHKVWEIRALKRKPEEPAARALLDRIAKQVQPIMRRRKWRVKVLSEFSPKNPRLLGLNVNRGVEVKLRLRRDGRDLDFIPYEEVLDTMLHELAHNARGPHDAQFYKLWDELRKECEELVAKGITGPGQGFDGTGRRLGGFSKYIHHHHLSDKLH

SEQ ID NO: 6796 - protein, 357 aa, Brachypodium distachyon
MEVGDLHKVWEIRALKRKPDEPSARALLDRIAKQVQPIMRRRKWRVKVLSEFSPKNPRLLGLNVNGGVEVKLRLRRAGRDYDFIPYEEVLDTMLHELAHIARGPHDAQFYKLWDELRKECEELVSKGITGPGQGFDGTGRRLGGFSIHPPPPSLRQATLTAAQKRARNGALLPSGPRKLGGNNDIMSALSPIQAAAMAAERRMQDDLWCGSHDQSGIDDSEDVVILEKPPNWPTRDRKDTEDGKNAKGVSSSGSGESSTSSGFQVGAQGDSSSCRTTDASMSSLWECSSCTLLNQPLAPICEVCGTAKLKLAKAKYTTWSCKFCTLENNTKLEKCSACDQWRYSYGPPVATYGSSYD

SEQ ID NO: 6797 - protein, 356 aa, Triticum aestivum
GDRRDKVWDGVRRVKRKPDGAGGRALLNRVAKQVQPIMRRRKWRVKVLSEFSPKNPRLLGLNVNRGVEVKLRLRRDGRDLDFIPYEEVLDTMLHELAHNARGPHDAQFYKLWDELRKECEELVAKGITGPGQGFDGTGRRLGGFSIHPPPPSLRQATLTAAQKRARNGALLPSGPRKLGGNNAIMSALSPVQAAAMAAERRMQDDLWCGSHNDSGIDDSEDVVILEQPPNLTTRDGKNTKRAKNTRCDSSSSSAEPSTSSVSQVPARADSSSGRTTDADFSSLWECSACTLLNQPLAPICEVCGTAKPKIAKAKYASWSCKFCTLENCTKLDKCSACDQWRYSYGPPVATYGPSYD

SEQ ID NO: 6798 - protein, 283 aa, Cenchrus ciliaris
MDEVTQAVENLKKEWNQAVSQLEENIAAIESCGKTGKGTEEANSLPRLNGSAQDALQLLKSLQFRLDLLAQQLPTFEEVQSGQATLESWDEQYKKLRASLRSANLQAKENIRKAAQEERELLLGGGEESTIRRRNLQTKAGMTSAAESITESLRRSRQMMVQEVERSASTLATFDESTSVLRKAEGEYQGHRSLLSRTRGLLSTMQRQDVLDRVILTAGFIIFSLAVLYVVSRRIGLLTLQRKLADAIRSGSLSAEDIVAKAQQHGPAAAGVAAPAPPIYDEL

SEQ ID NO: 6799 - protein, 70 aa, Setaria italica
MDELTQAVDNLKKEWNQAVSQLEESIAVIRSCGKTGKGTEEANSLPRLNGSAQDALQLLKSLQFRLDLLA

SEQ ID NO: 6800 - protein, 282 aa, Panicum virgatum
MDEVTQAVENLKKEWSQAVSQLEESIATIKSCGKAGKGTEEANSLPRLNGSAQDALQLLKSLQFRLDLLAQQLPTFEEVQSGQATLQSWDEQYKKLRASLRNANLQAKENIRKAAQEERELLLGGGEESTIRRRNLQTKAGMTSAAESITESLRRSRQMMVQEVERSASTLATFDESTSVLQKAEGEYQGHRSLLMRTRGLLSTMQRQDVLDRVILTVGFIIFSLAVLYVVSRRIGLLTLQRKLADAIRSGSLSAEDIVAKAQPGPAAANVPAPAPPIYDEL

SEQ ID NO: 6801 - protein, 282 aa, Panicum virgatum
MDEVTQAVENLKKEWSQAVSQLEESIATIKSCGKAGKGIEEANSLPRLNGSAQDALQLLKSLQFRLDLLAQQLPTFEEVQSGQATLQSWDEQYKKLRASLRNANLQAKENIRKAAQEERELLLGGGEESTIRRRNLQTKAGMTSAAESITESLRRSRQMMVQEVERSASTLATFDESTSVLRKAEGEYQGHRSLLMRTRGLLSTMQRQDVLDRVILTVGFIIFSLAVLYVVSRRIGLLTLQRKLADAIRSGSLSAEDIVAKAQPGPAAANVPAPAPPIYDEL

SEQ ID NO: 6802 - protein, 283 aa, Pennisetum glaucum
MDEVTQAVENLKKEWSQAVSQIEESISAIESCGKTGKGTEEASSLPRLNASAQDALQLLKSLQFRLDLLAQQLPTFEEVQAGQATLELWDEQYKKLRVSLRNANLQAKENIRKAAQEERELLLGGGEESTIRRRNLQTNAGMTSAAENITESLRRSRQMMVQEVERSASTLATFDESTSVLKKAEGEYQGHRPLLSRTRGLLSTMQRQDVLDRVILTAGFIIFSLAVLYVVSRRIGLLTLQRKLADAIRSGSLSAEDLVAKAQQHGPAAAGVADPAPPIYDEL

SEQ ID NO: 6803 - protein, 279 aa, Zea mays
MDEVTQAVENLKKEWSQAVSQLEESIAAIESCGKTGKGTEEATSLPRLNGSAQDALQLLKSLQFRLDLLAQQLPTFDEVQSGQATLGSWDEQYKKLRASLRNANLQAKENIRKAAQEERELLLGGGEESTIRRRNLQTKVGMTSAAESITESLRRSRQMMVQEVERSASTLATFDESTSVLRKAEGEYQGHRSLLMRTRGLLSTMQQQDVLDRIILTIGFIIFSLAVLYVVSRRIGLLTLQRKLADAIRSGSLSADDIVANAQRGPAPANVPAPIYDEL

SEQ ID NO: 6804 - protein, 279 aa, Sorghum bicolor
MDEVTQAVEDLKKEWSQAVSQLEESIAAIETCGKTGKGTEEATSLPRLNGSAQDALQLLKSLQFRLDLLAQQLPTFDEVQSGQATLESWDEQYKKLRASLRNANLQAKENIRKAAQEERELLLGGGEESTIRRRNLQTKAGMTSAAESITESLRRSRQMMVQEVERSASTLATFDESTSVLRKAEGEYQGHRSLLMRTRGLLSTMQRQDVLDRIILTIGFIIFSLAVLYVVSRRIGLLTLQRKLANAIRSGSLSAADIVAKAQHVPAPANVPAPIYDEL

SEQ ID NO: 6805 - protein, 282 aa, Sorghum bicolor
MDEVTQAVENLKKEWSQAVSQLEENITAIESCGKTGKGTEEANSLPRLNGSAQDALQLLKSLQFRLDLLAQQLPTFDEVQSGQATLKSWDEQYKKLRVSLRNANLQAKDNIRQAAQEERALLLGGGEESTIRRRNLQTKAGMTSAAESITESLRRSRQMMVQEVERNASTLATFDESTSVLRKAEGEYQGHRSLLMRTRGLLSTMQRQDVLDRIILTIGFIIFSSAVLYVVSRRIGLLTLQRKLANAIRSGSLSAEDIVAKAQHGPVALANAPAPPPIYDEL

SEQ ID NO: 6806 - protein, 282 aa, Zea mays
MDGVTQAVENLKKEWGQAVSQLDENITAIKSCGKTGKGTEEANSLPRLNGSAQDALQLLKSLQFQLDLLAQQLPTFDEVQSGQATLKSWDEQYKKLRISLRNANLEAKDNIRQAAEEERALLLGGGEESTIRRRNLQTKAGMTSAAESITESLRRSRQMMVQEVERSASTLATFDESTSVLQKAEGEYQGHRSLLMRTRGLLSTMQRQDVFDRIILTIGFTIFSLAVLYVVSRRIGLLALQRKLADAIRSGSLSAEDIVAKAQHGPAPANVPAPAPRVYNEL

SEQ ID NO: 6807 - protein, 283 aa, Oryza sativa
MDKVTQAVENLKEEWNQAVAQLEGCIAAIESCGKMGKGTEEASSLPRLNGSAQDALQLLNSLQCRLDPLAEQLPTFEEVQSGQATLQSWKEQYQKLRMRLRNANLQANANIKKAAQEERELLLGGGEESTIRRRNLQTKAGMTSAAESITESLRRSRQLMVQEVERSANTLATFDESTSVLRKAEGEYQGHRSLLMRTRGLLSTMQRQDVLDRIILTIGFLIFSLAVLYVVSRRIGLLTLQRKLADAIRSGSISAEDVVAKVKNVPVPAPAAPAPAPPIYDEL

SEQ ID NO: 6808 - protein, 281 aa, Brachypodium distachyon
MDEVTQAVENLKKEWSQVVTQLELCVAAIESCGKMGKGTEEASSLPRLNGSAQDSLQLLNALQCRLDLLVEQLPSFEEVQSGQATLGSWKEQYQKLRASLRSANLQAKSNIKKAAQEERELLLGGGEESTIRRRNLQTKTGLTSAAESITESLRRSRQLMVQEVERSASTLSTFDESTSVLRKAEGEYQGHRSLLMRTRGLLSTMQRQDVLDRIILTIGFLIFFLAVLYVVSRRIGLLTLQRKLADAIRSGSISAEDIIPKVQHGPAPANPNIAPPIYDEL

SEQ ID NO: 6809 - protein, 278 aa, Secale cereale
MDEVTQAVENLKKEWGQAVAQLEVCIAAIESCGKMGKGTEEAMSLPRLNGSAQDALQLLNALQCRLDLLAEQLPTFEEVQSGQATLGSWKEQYQRLRVNLRSANLQAKANIGKAAQEERELLLGGGEESTVRRRNLQTKAGMTSAAESITESLRRSRQLMVQEVERSANTLSTFDESTSVLRKAEGEYQGHRSLLMRTRGLLSTMQRQDVLDRIILAIGFLVFSLAVMYVVSRRIGLLTLQRKLADAIRSGSVSAGDILAKVQEGPAPTDAPPIYDEL

SEQ ID NO: 6810 - protein, 194 aa, Hordeum vulgare
MDEVTQAVENLKKEWSQAVAQLEVCIAAIESCGKMGKGTEEAMSLPRLNGSAQDALQLLNALHCRLDLLAEQLPTFEEVQSGQATLGSWNEQYQRLRVSLRTANLQAKANIGKAAQEERELLLGGGEESTIRRRNLQTKAGMTSAAESITESLRRSRQLMVQEVERSANTLSTFDESKVFSERLKVNIKDTALC

SEQ ID NO: 6811 - protein, 244 aa, Secale cereale
MGKGTEEAMSLPRLNGSAQDALQLLNALQCRLDLLAEQLPTFEEVQSGRATLGSWKEQYQRLRVSLRSANLQAKANIGKAAQEERELLLGGGEESTIRRRNLQTKAGMTSAAESITESLRRSQQLMVQEVERSANTLSTFDESTSVLRKAEGEYQGHRSLLMRTRGLLSTMQRQDVLDRIILAIGFLVFSLAVMYVVSRRIGLLTLQRKLADAIRSGSVSAGDILAKVQEGPAPTDAPPIYDEL

SEQ ID NO: 6812 - protein, 276 aa, Triticum aestivum
MDEVTQAVENLKSEWSQAVAQLEVCIAAIESCGKMGKGTEEAMSLPRLNGSAQDALQLLNALQCRLDLLAEQLPTFEEVQSGQATLGSWKEQYQRLRATLRSANLQAKVNIGKAAQEERELLLGGGEESTIRRRNLQTKAGMTSAAESITESLRRSRQLMVQEVERSANTLSTFDESTSVLRKAEGEYQGHRSLLMRTRGMLSTMQRQDVLDRIILTIGFLVFSLAVLYVVSRRIGLLTLQRKLADAIRSGSVSAGDILAKVQEGPAPTNAPYDEL

SEQ ID NO: 6813 - protein, 115 aa, Pseudoroegneria spicata
  misc_feature (11)..(11): Xaa can be any naturally occurring amino acid
  misc_feature (13)..(13): Xaa can be any naturally occurring amino acid
  misc_feature (98)..(99): Xaa can be any naturally occurring amino acid
MDEVTQAVENXKXEWSQAVAQLEVCIAAIESCGKMGKGTEEAMSLPRLNGSAQDALQLLNALQCRLDLLAEQLPTFEEVQSGQATLGSWKEQYQRLRXXLRSANLQAKANIGKAA

SEQ ID NO: 6814 - protein, 252 aa, Pennisetum glaucum
MAAPTPNDNPTVSSLAATVPVQAVLFDIDGTLCDSDPLHHVAFQEMLLEIGYNNGVPIDEEFFIKNIAGRSDVEAAQNLFPDWELEKGLKFLEDKEAKYRSLAKERLEPVKGLGKVVQWVKDHGYKRAAVTNAPRINAELMISLLGLSDFFQAIIVGGECEQPKPAPYPYLKALKELQVSAEHTFIFEDSPSGIRAGVTAGMPVVAVATRNPEKSLLEARASLLIKDYEDPKLWAALEEIDEEEAKLKKAGA

SEQ ID NO: 6815 - protein, 252 aa, Panicum virgatum
MAAPTANGNSTVSSLATTVPVQAVLFDIDGTLCDSDPLHHAAFQELLLEIGYNNGVPIDDEFFIKNIAGRSDVEAAQNLFPDWDLEKGLKFLDEKEAKYRSLAKERLEPVKGLGKVVQWVKDHGYKRAAVTNAPRINAELMISLLGLSDFFQAIIIGGECEQPKPAPYPYLKAIKELQVSAEHTFIFEDSASGIRAGVAAGMPVVAVATRNPEKSLLEAGASLLIKDYEDPKLWAALEEIDREEAKLKKASE

SEQ ID NO: 6816 - protein, 252 aa, Panicum virgatum
MAAPTANGNPTVSSLVTTVPVQAVLFDIDGTLCDSDPLHHVAFQELLLEIGYNNGVPIDDEFFIKNIAGRSDVEAAQNLFPDWDLDKGLKFLEEKEAKYRSLAKERLEPVKGLGKVVQWVKDHGYKRAAVTNAPRINAELMISLLGLSDFFQAIIIGGECEQPKPAPYPYLKAIKELQVSAEHTFIFEDSASGIRAGVAAGMPVVAVATRNPEKSLLEAGASLLIKDYEDPKLWAALEEIDREEAKLKKASA

SEQ ID NO: 6817 - protein, 248 aa, Setaria italica
MADGNPTLGSLATTVPVQAVLFDIDGTLCDSDPLHHVAFQELLLEIGYNNGVPIDDEFFIKNIAGRSDVEAAQNLFPDWDLEKGLKFLEDKEAKYRSLAKERLEPVKGLGKVVQWVKDHGYKRAAVTNAPRINAELMISLLGLSDFFQAVIVGDECEQPKPAPYPYLKAIKELQVSAEHTFIFEDSPSGIRAGVAAGMPVVAVATRNPEKSLLEAGASLLIKDYEDPKLWAALEEIDREEAKLKKAGA

SEQ ID NO: 6818 - protein, 251 aa, Sorghum bicolor
MAASVPNGSPTVSSLATTVPVQAVLFDIDGTLCDSDPLHHLAFQELLLEIGYNNGVPIDDEFFIKNIAGRSDVEAAQNLFPDWPLEKGLKFLDDKEAKYRSLAKERLVPVKGLEKVVQWVKDHGYKRAAVTNAPRINAELMISLLGLSDFFQAVIIGGECEQPKPAPYPYLKALKELEVSAQHTFIFEDSPSGIRAGVAAGMPVVGLVTRNPENSLLEAGAALLIKDYEDPKLWAALDEIDREEAKLKASA

SEQ ID NO: 6819 - protein, 246 aa, Panicum virgatum
MPSNLCSSLATTVPVQAVLFDIDGTLCDSDPLHHAAFQELLLEIGYNNGVPIDDEFFIKNIAGRSDVEAAQNLFPDWDLEKGLKFLDEKEAKYRSLAKERLEPVKGLGKVVQWVKDHGYKRAAVTNAPRINAELMISLLGLSDFFQAIIIGGECEQPKPAPYPYLKAIKELQVSAEHTFIFEDSASGIRAGVAAGMPVVAVATRNPEKSLLEAGASLLIKDYEDPKLWAALEEIDREEAKLKKASE

SEQ ID NO: 6820 - protein, 252 aa, Oryza sativa
MAAATPNGIPASRPLASSVPIEAVLFDIDGTLCDSDPLHHVAFQEMLLEIGYNNGVPIDEEFFINNIAGRSDVEAAQNLFPDWPLEKGLKFLEDKEAKYRSLAKERLEPVKGLAKVVQWVKDHGYKRAAVTNAPRINSELMISLLGLTDFFQAVIVGGECEKPKPAPFPYLKALKELQVSADHTFIFEDSASGTRAGVAAGIPVVAVATRNPEKSLLDAGATLIIKDYEDPKLWSALEEIDREEAKLKKADA

SEQ ID NO: 6821 - protein, 281 aa, Panicum virgatum
  misc_feature (174)..(174): Xaa can be any naturally occurring amino acid
MAASTPNGNQTVRFRAHPNKAELPSSMICSSLAATAPVQAVLFDIDGTLCDSDPLHHVAFQELLLEIGYNNGVPIDEEFFIKNIAGRSDVEAAPEPVPGLGAREGAQVPGGQGSQVQELGERAPGTCKRLGRVVQWVKDHGYKRAAVTNAPRINAELMISLHGFSDFFQPSSSXGSASSRSPRRTRTSRPSRSFRFLQTTPSSLRTLLLASGLASLQECLSLVWPQGTRRIPCWKQERHCSSRIMKIPSSGQCLKRSTERKRSTRRPANKMMMMIMMMIKH

SEQ ID NO: 6822 - protein, 250 aa, Brachypodium distachyon
MAAAPNGGAVSSLPATVPVEAVLFDIDGTLCDSDPLHHVAFQELLLAIGYNNGVPIDDEFFIKNIAGRSDVEAAQNLFPDWPLEKGLKFLEDKEVKYRSLAMERLEPVKGLGKVVQWVKDHGYKRAAVTNAPRINAELMIKLLGLSDFFQAVIVGGECEKPKPAPFPYLKALKELDVSAAHTFIFEDSASGTSAGVAAGMPVVAVLTRNPEKSLLDAGASLIIKDYEDPKLWTVLEEIDREEAKLKNSGA

SEQ ID NO: 6823 - protein, 250 aa, Festuca arundinacea
MAAPNGASAVSPLAAMVPVEAVLFDIDGTLCDSDPLHHVAFQEMLLAIGYNNGVPIDEEFFIKNIAGRSDVEAAQNLFPDWPLEKGLKFLEDKETKYRSLAMERLEPVNGLGKVVQWVKDHGYKRAAVTNAPRINAELMLKLLGLSDFFQAVIVGGECEKPKPAPFPYLKALKELGVSAEHTFIFEDSASGTRAGVAAGMPVVAVLTRNPENSLQEAGAALIVKDYADPKLWSALEEIDAAEAKLKSGGA

SEQ ID NO: 6824 - protein, 599 aa, Hordeum vulgare
MPSSPAPRRRPPAAATSTALLPRLRLAVGHTSPRRLLLQSLALVLTSNLSSTHAAVSSRLLNSLLPHLPASHPHLLRFLPFDHLTLLLLSSGSPNRHTIYPLPAASSLHALAVRSGHLPADLRLANSLLARYLAHGSHASARRLFADVPRPDAVTWNTLLRACLRSGLLPSARHLFDQMPVRDLVSYNSMLSGHAAAGDMDGARQLFDGMPERDVVSWNSMLAGHTRCGDMEEARRMFDAMPERDVVSWNSMLDGYAQAGDVLAARAVFDGMPRRSTVSWNVVLALYARVKNWRECLRLFDAMMAVGAAVPNEKTFVSVLTACGSLGDLERGKRVHDLVRQRWETLVPDVLLLTALLTMYAKCGVMEAARVIFDSMGERSVPSWNSMIIGYGLHGQSEKALELFLEMERTGPRPNETTFVCVLSSCAHGGLVLEGWWCFDRMVRLYGVEPKAEHFGCMMDLLGRAGLLTDSDTLVQNLQEKASPALWGAMVSASRAQNGSRLGEFVGKKLIEMRPKEVGPYVLLSNIYAAEGRWNDVEKVREMMKGNGAEKDVGLSLVGSSEPEHRIGTEDGVVLSMLGEIGAHLKLPSVEPKRMEGRL

SEQ ID NO: 6825 - protein, 249 aa, Triticum aestivum
MASTNGGAVSPLAATVPVEAVLFDIDGTLCDSDPLHHIAFQELLLAIGYNNGVPIDDEFFINNIAGRSDAEAAQNLFPDWPLEKGLKFLEDKDVKYRSLAMERLEPVKGLHKVVQWVKDHGYKRAAVTNAPRINAELMIKLLGLSDFFQAVIVGGECEKPKPAPFPYLKALKELEVSAAHTFIFEDSASGTRAGVAAGMPVVAVSTRNPEKSLQEAGAALIVSDYEDQKLWNALEEIDREEAKLKTGGA

SEQ ID NO: 6826 - protein, 249 aa, Triticum aestivum
MASTNGGFVSPLAATVPVEAVLFDIDGTLCDSDPLHHVAFQELLLAIGYNNGVPIDDEFFINNIAGRSDAEAAQNLFPDWPLEKGLKFLEDKDVKYRSLAMERLEPVKGLHKVVQWVKDHGYKRAAVTNAPRINAELMIKLLGLSDFFQAVIVGGECEKPKPAPFPYLKALKELEVSAAHTFIFEDSASGTRAGVAAGMPVVAVSTRNPVKSLQEAGAALIVSDYEDQKLWNALEEINREEAKLKNGGA

SEQ ID NO: 6827 - protein, 246 aa, Brachypodium distachyon
MVTTNGVLSSLAATVPVEAVLFDIDGTLCDSDPLHHVAFQEMLLAIGYNNGVPIDEEFFINNIAGRSDVEAAQNLFPDWPLEKGLKFLEDKETKYRSLAIERLEPVNGLGKVVQWVKDHGYKCAAVTNAPRINAELMIKLLGLSDFFQAVIVGGECEKPKPAPFPYLKALKELGASAAHTCIFEDSASGTRAGVAAGVPVIAVLTRNPEKSLQEAGAALIVKDYADPKLWSVLEEIDREEAKLKNV

SEQ ID NO: 6828 - protein, 249 aa, Secale cereale
MASTNGGGVSPLAATVPVEAVLFDIDGTLCDSDPLHHVAFQELLLAIGYNNGVPIDDEFFINNIAGRSEVEAAQNLFPDWPLEKALKFLDEKEAKYRSLAMERLEPVKGLSKVVQWVKDHGYKRAAVTNAPRINAELMIKLLGLSDFFQAVIIGGECEKPKPAPFPYLKALKELEVSAAHTFIFEDSASGTRAGVAAGMPVVAVLTRNPEKSLQEAGAALIINDYEDQKLWNALEEIDREEAKLKNGGA

SEQ ID NO: 6829 - protein, 249 aa, Triticum aestivum
MASTNGGFVSPLAATVPVEAVLFDIDGTLCDSDPLHHIAFQELLLAIGYNNGVPIDDEFFINNIAGRSDAEAAQNLFPDWPLEKGLKFLEDKDVKYRSLAMERLEPVKGLHKVVQWVKDHGYKRAAVTNAPRINAELMIKLLGLSDFFQAVIVGGECEKPKPAPFPYLKALKELGVSAAHTFIFEDSASGTRAGVAAGMPVVAVSTRNPEKSLQEAGAALIISDYEDQKLWNTLEEIDREEAKLKTGGA

SEQ ID NO: 6830 - protein, 240 aa, Avena sativa
SPLAATVPVQAVLFDVDGTLCDSDPLHHVAFQEMLLAIGYNNGVPIDDEFFIKNIAGRSDVEAAQNLFPDWPLEKGLKFLEDKETKYRSLAMERLEPVNGLAKVVQWVKDHGYKRAAVTNAPRINAELMLKLLGLTDFFQAVIVGGECEQPKPAPFPYLKALKELDVSAAHTFIFEDSASGTRAGVAAGMPVVAVLTRNPENSLQEAGASLIVKDYADPKLWSALEEIDAAEAKLKSGAA

SEQ ID NO: 6831 - protein, 306 aa, Setaria italica
MAGNFELQGRHGKSRVRVSRVWRRPAAAGGDIIVEWNVAVSVVSDCLPSYTSSDNSAIVATDSIKNTVYVKAKECTEVVSMEEFAVILGRHFTSLYPQVSEATVTIVERPWERVVVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKKVLSDTFFGPPDVGVYSPSVQNTLYLMAKEVLTRFPDISSIQLRMPNLHFLPVNLGSKENPLVKFADDVYLPTDEPHGTIEATLSRPMSKL

SEQ ID NO: 6832 - protein, 306 aa, Pennisetum glaucum
MAGNFELQGRHGKSRVRVSRVWRRPAAAGGDIIVEWNVAVSLVSDCLPSYTSSDNSAIVATDSIKNTVYVKAKECTEVVSMEEFAVILGRHFTSLYPQVSEATVTIVERPWERVVVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYKDVKKVLSDTFFGPPDVGVYSPSVQNTLYLMAKEVLTRFPDISSVQLRMPNLHFLPVNLGSKENPLVKFADDVYLPTDEPHGTIEATLSRPMSKL

SEQ ID NO: 6833 - protein, 306 aa, Sorghum bicolor
MAENFQLQSRHGKSRVRVSRVWRRPAAAGGHIIVEWNVAVSIVSDCLPSYISSDNSAIVATDSIKNTVYVKAKECTEVVSMEEFAVILGRHFTSLYPQVSEATVTIVERPWDRVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKRVLTETFFGPADVGVYSPSVQNTLYLMAKEVLTRFPDISSVQLRMPNLHFLPVNLGSKETPLVKFADDVYLPTDEPHGTIEATLSRPMSKL

SEQ ID NO: 6834 - protein, 306 aa, Panicum virgatum
MAGNFELQGRHGKSRVRVSRVWRRPAAAGGHVIVEWSVAVSVVSDCLPSYTSSDNSAIVATDSIKNTVYVKAKECTEVVSMEEFAVILGRHFTSLYPQVSEATVTIVERPWERVVVDGKPHSHGFKVGVEKHSTEVIVKKSGSLLINSGIQGYSLLKTTQSGFEGFVTDRYRLLPDTRERIVATEVTAWWRYPFEHVSQLLSKPFCFTQRYQDVKKVLSETFFGPPDVGVYSPSVQNTLYLMAKEVLTRFPDISSIQLRMPNLHFLPVNLGSKENPLVKFADDVYLPTDEPHGTIEATLSRPMSKL

SEQ ID NO: 6835 - protein, 306 aa, Panicum virgatum
MAGNFELQGRHGKSRVRVSRVWRRPAAAGGHVIVEWSVAVSVVSDCLPSYTSSDNSAIVATDSIKNTVYVKAKECTEVVSMEEFAVILGRHFTSLYPQVSEATVTIVERPWERVVVDGKPHSHGFKVGVEKHSTEVIVKKSGSLLINSGIQGYSLLKTTQSGFEGFVMDRYRLLPDTRERIVATDVTAWWRYPFEHISQLPSKPFCFTQRYQDVKKVLSETFFGPPDVGVYSPSVQNTLYLMAKEVLTRFPDISSIQLRMPNLHFLPVNLGSKENPLMKFADDVYLPTDEPHGTIEATLSRPMSKL

SEQ ID NO: 6836 - protein, 306 aa, Saccharum officinarum
MAENFQLQSRHGKSRVRVSRVWRRPAAAGGHVIVEWNVAVSIVSDCLPSYISSDNSAIVATDSIKNTVYVKAKECTEVVSMEEFAVILGRHFTSLYPQVSEATVTIVERPWERVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKKVLAETFFGPADVGVYSPSVQNTLYLMGKEVLTRVAEISSIQLKMPNLHFLAVNLGSKETPLVKIADDVYPATDEPHRTIGAPLTRPMSKL

SEQ ID NO: 6837 - protein, 307 aa, Brachypodium distachyon
MAERFDLQSRHGKSRVRVSRVWRRPAAAGGHLFVEWSVAVSVVSDCLPSYTSDDNSAIVATDSIKNTVYVKAKECTEVVSMEEFAVILGRHFTSLYPQVSEASVSIVERPWERVVVDGKPHSHGFKLGAEKHSTEVTVKKSGSLLINSGILGYSLLKTTQSGFEGFVRDRYTLLPETRERIVATEVTAWWRYPFEHISQLPSKPFCFTQRYQDVKKVLADTFFGPPDVGVYSPSVQNTLYLMAKEVLTRFPDISSVQLRMPNLHFLPVNLSGKENPGLVKFADDVYMPTDEPHGTIEATLSRANSKL

SEQ ID NO: 6838 - protein, 307 aa, Pseudoroegneria spicata
MAGRFDLQGRHGKSRVRVARVWRRPAEAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGSLLINSGIQGYSLLKTTQSGFEGFVRDRYTLLPETRERIVATEVTAWWRYPFEHISQLPSKPFCFTQRYQDVKKVLADTFFGPPDVGVYSPSVQNTLYLMAREVLTRFPDIASVQLRMPNLHFLPVNLGGKENPGLVKFADDVYMPTDEPHGTIEATLSRANSKL

SEQ ID NO: 6839 - protein, 307 aa, Triticum aestivum
MAGRFDLQGRHGKSRVRVSRVWRRPADAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGSLLINSGIQGYSLLKTTQSGFEGFVRDRYTLLPETRERIVATEVTAWWRYPFEHISQLPSKPFCFTQRYQDVKKVLADTFFGPPDVGVYSPSVQNTLYLMAREVLTRFPDIASVQLRMPNLHFIPVNLGGKENPGLVKFADDVYMPTDEPHGTIEATLSRANSKL

SEQ ID NO: 6840 - protein, 307 aa, Secale cereale
MAGRFDLQGRHGKSRVRVSRVWRRPAEAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGILLINSGLQGYSLLKTTQSGFEGFVRDRYTLLPETRERIVATEVTAWWRYPFEHISQLPSKPFCFTQRYQDVKKVLADTFFGPPDVGVYSPSVQNTLYLMAREVLTRFPDIASVQLRMPNLHFLPVNLGGKENPGLVKFADDVYMPTDEPHGTIEATLSRANSKL

SEQ ID NO: 6841 - protein, 307 aa, Secale cereale
MAGRFDLQGRHGKSRVRVSRVWRRPAEAGGHLFVEWSVAVSVVSDCLPSYTSDDNSAIVATDSIKNTVYVKAKECTEVVSMEEFAVILGKHFTSLYPQVSEATVTIVERPWERVAVDGKPHSHGFKLGSEKHTTEVTVKKSGILLINSGLQGYSLLKTTQSGFEGFVRDRYTLLPETRERIVATEVTAWWRYPFEHISQLPSKPFCFTQRYQDVKKVLADTFFGPPDVGVYSPSVQNTLYLMAREVLTRFPDIASVQLRMPNLHFLPVNLGGKENPGLVKFADDVYMPTDEPHGTIEATLSRANSKL

SEQ ID NO: 6842 - protein, 307 aa, Secale cereale
MAGRFDLQGRHGKSRVRVSRVWRRPAEAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGILLINSGLQGYSLLKTTQSGFEGFVRDRYTLLPETRERIVATEVTAWWRYPFEHISQLPPKPFCFTQRYQDVKKVLADTFFGPPDVGVYSPSVQNTLYLMAREVLTRFPDIASVQLRMPNLHFLPVNLGGKENPGLVKFADDVYMPTDEPHGTIEATLSRANSKL

SEQ ID NO: 6843 - protein, 307 aa, Triticum aestivum
MAGHFDLQGRHGKSRVRVSRVWRRPADAGGHLFVEWSVAVSVVSDCLPSYTSDDNSAIVATDSIKNTVYVKAKECTEVVSMEEFAVILGRHFTSLYPQVSEAAVTIVERPWERVAVDGKPHSHGFKLGSEKHTTEVTVKKSGSLLINSGIQGYSLLKTTQSGFEGFMRDRYTLLPETRERIVATEVTAWWRYPFEHISQLPSKPFCFTQRYQDVKKVLADTFFGPSDVGVYSPSVQNTLYLMAREVLTRFPDIASVQLRMPNLHFLPVNLGGKENPGLVKFADDVYMPTDEPHGTIEATLSRANSKL

SEQ ID NO: 6844 - protein, 247 aa, Cenchrus ciliaris
  misc_feature (176)..(176): Xaa can be any naturally occurring amino acid
AVPSDRLTPHPAQHRRSDPRSDLAGNFELQGRHGKSRVRVSRVWRRPAAAGGDIIVEWNVAVSLVSDCLPSYTSSDNSAIVATDSIKNTVYVKAKECTEVVSMEEFAVILGRHFTSLYPQVSEATVTIVERPWERVVVDGKPHSHGFKVGVEKHSTEVIVKKSGILLINSGIQGYXLLKTTQSGFEGFVTDRYRLLPDTRERIVATEVTAWWRYPFDHVSQIPSKSFCFTQRYQDVKKVCQRRSLAP

SEQ ID NO: 6845 - protein, 182 aa, Secale cereale
SRAGTAVPRPVSRVWRRPPRPAATSSSSGASPSASSPTCLPSYTSDDNSAIVATDSIKNTVYVKAKECTEVVSMEEFAVILGRHFTSLYSQVSEATVTIVERPWERVAVDGKPHSHGFKLGSEKHTTEVNVKKSGSLLINSGIQGYSLLKTTQSGFEGFVRDRYTLLPETRERIVATEVTAW

SEQ ID NO: 6846 - protein, 918 aa, Setaria italica
MRTLAVAGPHPGAAFTARHRRLHPSAADRDSISQRCWRCERTQDRSFGNSLRISRLPGTPHRDVGKNLLTPTAAVSVEQAEATADLPKGDMWSVHKFGGTCMGTSQRIQNVADIVLRDPSERKLVVVSAMSKVTDMMYNLVNKAQSRDDSYITVLDEVFEKHMGTAKDLLAGEDLARFLSQLHADISNLKAMLRAIYIAGHATESFSDFVVGHGELWSAQMLSYAIKKSGTPCSWMDTREILVVNPSGSNQVDPDYLESEKRLEKWFARGPAETIIATGFIASTPDNIPTTLKRDGSDFSAAIIGSLVKARQVTIWTDVDGVFSADPRKVSEAVILSTLSYQEAWEMSYFGANVLHPRTIIPVMKYNIPIVIRNIFNTSAPGTMICQQPANENGDLDACVKAFATIDKLALVNVEGTGMAGVPGTASAIFGAVKDVGANVVMISQASSEHSVCFAVPEKEVASVSAALHVRFREALAAGRLSKVEVIHNCSILAAVGLRMASTPGVSATLFDALAKANINVRAIAQGCSEYNITVVLKQEDCVRALRAAHSRFFLSKTTLAVGIVGPGLIGRTLLNQLKDQAAVLKENMNIDLRVMGITGSRTMLLSDIGIDLTQWKEKLQTEAEPADLDKFVHHLSENHFFPNRVLVDCTADTSVASHYYDWLKRGIHVITPNKKANSGPLERYLKLRTLQRASYTHYFYEATVGAGLPIISTLRGLLETGDKILRIEGIFSGTLSYIFNNFEGARTFSDVVTEAKEAGYTEPDPRDDLSGTDVARKVIILARESGLRLELSDIPVRSLVPESLRSCTSADEYMQKLPSFDQDWASERNDAEAAGEVLRYVGVVDVVNKKGQVELRRYKRDHPFAQLSGSDNIIAFTTSRYKEQPLIVRGPGAGAEVTAGGVFSDILRLASYLGAPS

SEQ ID NO: 6847 - protein, 919 aa, Brachypodium distachyon
MTSLAAASPHPGAAFAARRRHRVHPTRSGREAISQCWRRERSQGRSFRSSLRISNLPGQLRGDVPKNLLTPTAGTVSVEQVEASTYLPKGDMWSVHKFGGTCMGTPQRIQNVADIVLRDPSERKLVVVSAMSKVTDMMYNLVNKAQARDDSYIVALDEVFEKHMVAAKDLLEGEDLARFLSQMHADISNLKAMLRAIYIAGHVTESFSDFVVGHGELWSAQMLSFAIKQSGTPCSWMDTREVLVVNPTGSNQVDPDYLESEKRLDKWFARKPAETIIATGFIASTHENIPTTLKRDGSDFSAAIIGSLVKARQVTIWTDVDGVFSADPRKVSEAVILSTLSYQEAWEMSYFGANVLHPRTIIPVMKYNIPIVIRNIFNISAPGTMICQQPTNEDGDLEACVKAFATIDKLALVNVEGTGMAGVPGTANAIFGAVKDVGANVIMISQASSEHSVCFAVPEKEVSAVSAALHVRFREALSAGRLSKVEVIHNCSILAAVGLRMASTPGVSATLFDALAKANINVRAIAQGCSEYNITVVLKQEDCVRALRAAHSRFFLSKTTLAVGIIGPGLIGRTLLNQLKDQAAVLKENMNIDLRVMGITGSRTMFLSDTGVDLTQWKELLETEAEPANLDKFAYHLSENHFFPNRVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGTRTFSDVVAEAKEAGYTEPDPRDDLSGTDVARKVIILARESGLRLELSDIPVRSLVPEELRMCSSGNEYMQKLPSFDHNWASERKEAEVAGEVLRYVGVVDVANKKGQVELRRYKRDHPFAQLSGSDNIIAFTTSRYKEQPLIVRGPGAGAEVTAAGVFSDILRLASYLGAPS

SEQ ID NO: 6848 - protein, 921 aa, Oryza sativa
MWSLAVASPHPAAAFAAARPRRGPRPAAAPSHRGVNPQRWRCEKTQAWSFWSSLWASDLPGGLYGDVSKNMLKPAAAVSVEQAEASAHLPKGDMWSVHKFGGTCMGTSQRIQNVADIILRDPSERKLVVVSAMSKVTDMMYNLVNKAQSRDDSYITALDEVFEKHMAAAKDLLGGEDLARFLSQLHADVSNLKAMLRAICIAGHATESFSDFVVGHGEIWSAQLLSFAIKKSGTPCSWMDTREVLVVNPTGSNQVDPDYLESEKRLEKWFARQPAETIIATGFIASTPENIPTTLKRDGSDFSAAIIGSLVKAGQVTIWTDVDGVFSADPRKVSEAVILSTLSYQEAWEMSYFGANVLHPRTIIPVMKYNIPIVIRNMFNISAPGTMICQQPANESGDLEACVKAFATIDKLSLVNVEGTGMAGVPGTASAIFGAVKDVGANVIMISQASSEHSVCFAVPEKEVAAVSAALHVRFREALSAGRLSKVEVIHNCSILAAVGLKMASTPGVSATLFDALAKANINVRAIAQGCSEYNITVVLKQEDCVRALRAAHSRFFLSKTTLAVGIIGPGLIGRTLLNQLKDQAAVLKENMNIDLRVMGITGSRTMVLSDTGIDLAHWKEQLQTEAEPANLDKFVDHLSENQLFPNRVLVDCTADTSVASHYYDWLKKGIHVITPNKKANSGPLDKYLKLRTLQRASYTHYFYEATVGAGLPIISTLRGLLETGDKILRIEGIFSGTLSYIFNNFEGTRAFSDVVSEAKEAGYTEPDPRDDLSGTDVARKVIILARESGLKLELSDIPVRSLVPEALRSCSTADEYMQKLPSFDQDWARESKDAEAAGEVLRYVGVVDLVNKEGQVELRRYKKDHPFAQLSGSDNIIAFTTSRYKEQPLIVRGPGAGAEVTAGGVFSDILRLASYLGAPS

SEQ ID NO: 6849 - protein, 918 aa, Setaria italica
MRGLAVASPLPPAAAAALRRTRAPSSSGREVSSQCWKYDLSQDRSLGGSLRIGQSQGSLHRHRPTNLLRPAAAAISVEQDEVNTYLPKGDMWSVHKFGGTCMGTPQRIQSVADIVLGDSSERKLIIVSAMSKVTDMMYNLVHKAQSRDDSYTIALEEVFEKHMAAAKDLLDGEDLARFLSQLHSDVSNLRAMLRAIYIAGHATESFSDFVVGHGELWSAQMLSYAIKKSGAPCSWMDTREVLVVKPSGSNQVDPDYLESEKRFQKWFSRQPAETIVATGFIASTAENVPTTLKRDGSDFSAAIIGSLVRARQVTIWTDVDGVFSADPRKVSEAVILSTLSYQEAWEMSYFGANVLHPRTIIPVMKDNIPIVIRNMFNISAPGTMICRQPANDNGDLDACVKSFATIDNLALVNVEGTGMAGVPGTSSAIFSAVKDVGANVIMISQASSEHSVCFAVPEKEVAAVSAALHVRFREALAAGRLSKVEVINGCSILAAVGLRMASTPGVSAILFDALAKANINVRAIAQGCSEYNITVVLKQEDCVRALRAAHSRFFLSKTTLAVGIIGPGLIGGTLLNQLKDQAAVLKENMNIDLRVIGITGSSTMLLSDTGIDLTQWKELLRKEGEPADVANFVRHLSDNHVFPNKVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGTRTFSNVVAEAKEAGYTEPDPRDDLSGTDVARKVIILARESGLRLELSDIPVKSLVPEALASCSSADEFMQKLPSFDEDWARQRSDAEAAGEVLRYVGVVDVVNKEGQVELRRYKRDHPFAQLSGSDNIIAFTTSRYKEQPLIVRGPGAGAEVTAGGVFCDILRLASYLGAPS

SEQ ID NO: 6850 - protein, 915 aa, Oryza sativa
MRSLAVASPLPPAAAVRRRPRASASGREVISQCWKCEINQDQPLGNSLRIGHSQGSLQRHGSRNLLAAAAAISIEQAEVSTYLPKGDMWSVHKFGGTCMGTPQRIQNVADIVLGDSSERKLIIVSAMSKVTDMMFNLVHKAQSRDNSYVTALDEVFNKHMAAAKELLDGEDLARFLAQLHSDISNLRAMLRAIFIAGHATESFSDFVVGHGELWSAQMLSYAIKKSGVPCSWMDTREVLVVKPSGSNQVDPDYLESEKRLQKWFSRQPAEIIIATGFIASTAENIPTTLKRDGSDFSASIIGSLVRACQVTIWTDVDGVFSADPRKVSEAVILSTLSYQEAWEMSYFGANVLHPRTIIPVMKDNIPIVIRNMFNLSAPGTTICKQPANENADLDACVKSFATIDKLALVNVEGTGMAGVPGTASAIFSAAKDVGANVIMISQASSEHSVCFAVPEKEVAAVSTALHVRFREALAAGRLSKVEVIRGCSILAAVGLRMASTPGVSAILFDALAKANINVRAIAQGCSEYNITVVLKQEDCVRALRAVHSRFFLSKTTLAVGIIGPGLIGGTLLDQLKDQAAVLKENMNIDLRVIGISGSRTMHLSDIGVDLNQWKELLRKEAEPADLDSFVRHLSENHVFPNKVLVDCTADTYVACHYYDWLKKGIHVITPNKKANSGPLDRYLKLRTLQRASYTHYFYEATVGAGLPIISTLRGLLETGDKILRIEGIFSGTLSYIFNNFEGTRTFSNVVAEAKEAGYTEPDPRDDLSGTDVARKVIILARESGLRLELSDIPVKSLVPEALRSCSSADEFMQKLPSFDQDWDRQRDEAEAAGEVLRYVGVVDVANRKGRVELQRYKRDHPFAQLSGSDNIIAFTTSRYKEQPLIVRGPGAGAEVTAGGVFCDILRLASYLGAPS

SEQ ID NO: 6851 - protein, 917 aa, Sorghum bicolor
MQGLAVASPLPPAAAAARRRPRASSSTREAVSQCWKYELSRDQYLGGFLRISQSQGSLHRHRSTNLLRPAAAAISVEQDELNTYLPKGDMWSVHKFGGTCMGTPQRIQSVADIVLGDSSERKLIIVSAMSKVTDMMYNLVQKAQSRDDSYTIALEEVFEKHMAAAKDLLDGEDLASFLSQLHSDVSNLRAMLRAIYIAGHATESFSDFVVGHGELWSSQMLSYAIKKSGAPCSWMDTREVLVVKPSGSNQVDPDCLESEKRLQKWFSRQPADIIVATGFIASTAENIPTTLKRDGSDFSAAIIGSLVRARQVTIWTDVDGVFSADPRKVSEAVILRTLSYQEAWEMSYFGANVLHPRTIIPVMKDNIPIVIKNMFNLCAPGTMICKQPANENGDLDACVKSFATIDNLALVNVEGTGMAGVPGTASAIFSAVKDVGANVIMISQASSEHSVCFAVPEKEVAAVSAALHVRFREALAAGRLSKVEVIKGCSILAAVGLRMASTPGVSAILFDALAKANINVRAIAQGCSEYNITVVLKQEDCVRALRAAHSRFFLSKTTLAVGIIGPGLIGGTLLNQLKDQAAVLKENMNIDLRVIGITGSSTMLLSDTGIDLTQWKQLLQKEAEPANIDSFVHHLSDNHIFPNKVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGTRPFSDVVAEAKEAGYTEPDPRDDLSGTDVARKVIILARESGLRLELPDIPVKSLVPETLASCSSADEFMQKLPTFDEDWARQRSDAEAADEVLRYVGVVDTVNKKGQVELRRYKRDHPFAQLSGSDNIIAFTTSRYKEQPLIVRGPGAGAEVTAGGVFCDLLRLASYLGAPS

SEQ ID NO: 6852 - protein, 915 aa, Secale cereale
MRSLAVASPVPPAAAHRRRLRPSASGREVVSQCLKCEINQDRPTGALRIGHSQGNLPRHGSKNLLTPAAAAISVEQVEVSTYLPKGDMWSVHKFGGTCMGTPQRIQNVADVVLGDSSERKLIIVSAMSKVTDMMYSLVHKAQSRDDSYIEELNKVFEKHMAAAKDLLDGENLARFLSQLHSDISNLRAMLRAIYIAGHATESFSEFVVGHGELWSSQMLSYAVQKSGASCSWMDTREVLVVKPSGPDMVDPDYVESEKRLQKWFSRQPAEIIVATGFIASTAENIPTTLKRDGSDFSAAIIGSLVRARQVTIWTDVDGVFSADPRKVSEAVILSTLSYQEAWEMSYFGANVLHPRTIIPVMKDDIPIVIRNMFNLSAPGTVICKQPANEDADLDACVKSFATIDKLALVNVEGTGMAGVPGTSSAIFSAVKEVGANVIMISQASSEHSICFAVPEKEVAAVSAALHVRFREALAAGRLSKVEVIHGCSILAAVGLRMASTPGVSAILFDALAKANINVRAIAQGCSEYNITVVLKQEDCVRALRAAHSRFFLSKTTLAIGVIGPGLIGATLLNQLRDQVAVLKENMNIDVRVIGITGASTMLLSDAGVDLTRWKEEMQKEAKPADLANFVRHLSEDHVFPNKVLVDCTADTNVASHYYDWLKKGIHVITPNKKANSGPLDRYLKLRTLQRASYTHYFYEATVGAGLPIISTLRGLLETGDKILRIEGIFSGTLSYIFNNFEGTRSFSDVVAEAKEAGYTEPDPRDDLSGTDVARKVIILARESGLRLELSDIPVESLVPEALKSCSSPNEFMQKLPSFDQDWARQRHEAEAAGEVLRYVGVVDVLNGKGRVELQRYKRDHPFAQLSGSDNIIAFTTSRYKEQPLIVRGPGAGAEVTAGGVFCDILRLASYLGAPS

SEQ ID NO: 6853 - protein, 917 aa, Zea mays
MQGLAVSCQLPPAAAAARWRPRASSSNREAVLQCWKYELSQDHYLGGPLRIGQSQGSLHRHRSTNFLRPAAAAISVEQDEVNTYLPKGDMWSVHKFGGTCMGTPKRIQCVANIVLGDSSERKLIIVSAMSKVTDMMYNLVQKAQSRDDSYAIALAEVFEKHMTAAKDLLDGEDLARFLSQLHSDVSNLRAMLRAIYIAGHATESFSDFVVGHGELWSAQMLSYAIKKSGAPCSWMDTREVLVVTPSGCNQVDPDYLECEKRLQKWFSRQPAEIIVATGFIASTAGNIPTTLKRDGSDFSAAIVGSLVRARQVTIWTDVDGVFSADPRKVSEAVILSTLSYQEAWEMSYFGANVLHPRTIIPVMKDNIPIVIRNMFNLSAPGTMICKQPANENGDLDACVKSFATVDNLALVNVEGTGMAGVPGTASAIFSAVKDVGANVIMISQASSEHSVCFAVPEKEVAVVSAELHDRFREALAAGRLSKVEVINGCSILAAVGLRMASTPGVSAILFDALAKANINVRAIAQGCSEYNITVVLKQQDCVRALRAAHSRFFLSKTTLAVGIIGPGLIGGALLNQLKNQTAVLKENMNIDLRVIGITGSSTMLLSDTGIDLTQWKQLLQKEAEPADIGSFVHHLSDNHVFPNKVLVDCTADTSVASHYYDWLKKGIHVITPNKKANSGPLDQYLKLRTMQRASYTHYFYEATVGAGLPIISTLRGLLETGDKILRIEGIFSGTLSYIFNNFEGTRAFSDVVAEAREAGYTEPDPRDDLSGTDVARKVVVLARESGLRLELSDIPVKSLVPETLASCSSADEFMQKLPSFDEDWARQRSDAEAAGEVLRYVGALDAVNRSGQVELRRYRRDHPFAQLSGSDNIIAFTTSRYKEQPLIVRGPGAGAEVTAGGVFCDILRLASYLGAPS

SEQ ID NO: 6854 - protein, 918 aa, Brachypodium distachyon
MRSLAITSPVPPTSAAAARRQPRSSASGREVVSQCLKCEINKDRPLGGYLRIGQSQGSLLRHGSKNFIAQAAAAISVEQDEVSTYLPKGDMWSVHKFGGTCMGTPQRIQNVADIVLGDSSERKLIIVSAMSKVTDMMYSLVHKAQSRDDSYTMALDQIFEKHMASAKELLDGEDLARFLSQLHSDISNLRAMLRAIYIAGHATESFSEFVVGHGELWSAQILSYAIQKSGTACSWMDTREVLVVKPSGYNLVDPDYLESKKRLQKWFSRQPAEIIVATGFIASTAENIPTTLKRDGSDFSAAIIGSLVRARQVTIWTDVDGVFSADPRKVSEAVILSTLSYQEAWEMSYFGANVLHPRTIIPVMKDNIPIVIRNMFNLSAPGTVICKQPANEDGDLDACVKSFATIDNLALVNVEGTGMAGVPGTSSTIFSAVKDVGANVIMISQASSEHSICFAVPEKEVAAVSAALHVRFREALAAGRLSKVEIIHGCSILAAVGLRMASTPGVSAILFDALAKANINVRAIAQGCSEYNITVVLKQEDCVRALRAAHSRFFLSKTTLAVGIIGPGLIGATLIKQLGEQVAVLKENMNIDVRVVGITGSSTMLLSDSGVDLSRWKEDLQTESKPADLAIFVRHLSENHVFPNKVLVDCTADTNVASHYYDWLKKGIHVITPNKKANSGPLDRYLKLRTLQRASYTHYFYEATVGAGLPIISTLRGLLETGDNILRIEGIFSGTLSYIFNNFEGTRSFSDVVAEAKEAGYTEPDPRDDLSGTDVARKVIILARECGLRLELSDIPVKSLVPEPLTSCSSADEFMQKLPSFDQDWARQRHEAEAAGEVLRYVGVVDVLNKKGRVELQRYKKDHPFAQLSGSDNIIAFTTSRYKEQPLMVRGPGAGAEVTAGGVFCDILRLASYLGAPS

SEQ ID NO: 6855 - protein, 818 aa, Panicum virgatum
SAQCWKYDLSQDRSLGGSVRIGQSQGSFLTHRSTNLLRPAAAAISVEQDDINTYLPKGDMWSVHKFGGTCMGTPQRIQSVADIVLGDSSERKLVIVSAMSKVTDMMYNLVHKAQSRDDSYMIALEEVFEKHMAAAKDLLDGEDLASFLSQLHSDVSSLRAMLSAIYIAGHATESFSDFVVGHGELWSAQMLSYAIKKSGAPCSWMDTREVLVVKPSGPNQVDPDYLESENRLQKWFSRQPAEIIVATGFIASTAENIPTTLKRDGSDFSAAIIGSLVRARQVTIWTDVDGVFSADPRKVSEAVILSTLSYQEAWEMSYFGANVLHPRTIIPVMKDNIPIVIRNMFNISAPGTMICRQPANDNGDLDACVKSFATIDNLALVNVEGTGMAGVPGTSSAIFSVVKDVGANVIMISQASSEHSICFAVPEKEVAAVSAALHVRFREALAAGRLSKVEVINGCSILAVVGLRMASTPGVSAMLFDALAKANINVRAIAQGCSEYNITVVLKQEDCVRALRAAHSRFFLSKTTLAVGIIGPGLIGGTLLNQLKDQAAVLKENMNIDLRVIGITGSSTMLLSDTGIDLTQWKELLRKEAEPADLANFVRHMSDNHVFPNKVLVDCTADTSVASHYYDWLKKGIHVITPNKKANSGPLDQYLKLRTLQRASYTHYFYEATVGAGLPIISTLRGLLETGDKILRIEGIFSGTLSYIFNNFEGTRTFSDVVAEAKEAGYTEPDPRDDLSGTDVARKVIILARESGLTLELSDIPVKSLVPEALAESHAHRQMNSCKSYHPLMRTGPNNVARQRLQAKSYGTSELWMR

SEQ ID NO: 6856 - protein, 900 aa, Triticum aestivum
AHRRRLRPSASGREVVSQCLKCEINQDRPMGALRIGHSQGNLPRHGSKNLLTPAAAIPVEQVEVSTYLPKGDMWSVHKFGGTCMGTPQRIQNVADVVLGDSSERKLIIVSAMSKVTDMMYSLVHKAQSRDDSYTEELDKVFEKHMAAAKDLLDGENLARFLSQLHSDISNLRAMLRAIYIAGHATESFSEFVVGHGELWSSQMLSYAVQKSGASCSWMDTREVLVVKPSGPDMVDPDYEESEKRLEKWFSRQPAEIIVATGFIASTAENIPTTLKRDGSDFSAAIIGSLVRARQVTIWTDVDGVFSADPRKVSEAVILSTLSYQEAWEMSYFGANVLHPRTIIPVMKDNIPIVIRNMFNLSAPGTVICKQPANEDADLDACVKSFATIDKLALVNVEGTGMAGVPGTSSAIFSAVKEVGANVIMISQASSEHSICFAVPEKEVAAVSAALHVRFREALAAGRLSKVEVIHDCSILAAVGLRMASTPGVSAILFDALAKANINVRAIAQGCSEYNITVVLKQEDCVRALRAAHSRFFLSKTTLAIGVIGPGLIGATLLNQLRDQVAILKENMNIDVRVIGITGASTMLLSETGVDLTRWKEEMQKEAKPADLANFVRHLSEDHVFPNKVLVDCTADTNVASHYYDWLKKGIHVITPNKKANSGPLDRYLKLRTLQRASYTHYFYEATVGAGLPIISTLRGLLETGDKILRIEGIFSGTLSYIFNNFEGTRSFSDVVAEAKEAGYTEPDPRDDLSGTDVARKVIILARESGLRLELSDIPVESLVPEALKSCSSPNEFMQKLPSFDQDWARQRHEAEAAGEVLRYVGAVDVLNGKGRVELQRYKRDHPFAQLSGSDNIIAFTTSRYKEQPLIVRGPGAGAEVTAGGVFCDILRLASYLGAPS

SEQ ID NO: 6857 - protein, 698 aa, Triticum aestivum
MLSYAVQKSGASCSWMDTREVLVVKPSGPDMVDPDYEESEKRLEKWFSRQPAEIIVATGFIASTAENIPTTLKRDGSDFSAAIIGSLVRARQVTIWTDVDGVFSADPRKVSEAVILSTLSYQEAWEMSYFGANVLHPRTIIPVMKDNIPIVIRNMFNLSAPGTVICKQPANEDADLDACVKSFATIDKLALVNVEGTGMAGVPGTSSAIFSAVKEVGANVIMISQASSEHSICFAVPEKEVAAVSAALHVRFREALAAGRLSKVEVIHDCSILAAVGLRMASTPGVSAILFDALAKANINVRAIAQGCSEYNITVVLKQEDCVRALRAAHSRFFLSKTTLAIGVIGPGLIGATLLNQLRDQVAVLKENMNIDVRVIGITGASTMLLSDTGVDLTRWKEEMQKEAKPADLANFVRHLSEDHVFPNKVLVDCTADTNVASHYYDWLKKGIHVITPNKKANSGPLDRYLKLRTLQRASYTHYFYEATVGAGLPIISTLRGLLETGDKILRIEGIFSGTLSYIFNNFEGTRSFSDVVAEAKEAGYTEPDPRDDLSGTDVARKVIILARESGLRLELSDIPVGSLVPEALKSCSSPNEFMQKLPSFDQDWARQRHEAEAAGEVLRYVGVVDVLNGKGRVELQRYKRDHPFAQLSGSDNIIAFTTSRYKEQPLIVRGPGAGAEVTAGGVFCDILRLASYLGAPS

SEQ ID NO: 6858 - protein, 163 aa, Saccharum officinarum
MAAVSSSTSTAYFSSQPQLPTSTADPTAAAASSSLVRQPRRSSSFVMVEASSASSSDGGVARTKSLTEDDLEELKGCLDLGFGFAYSEIPELCGTLPALELCYSMTRRFLDEQKAPGQEQEEEPASPPLPNWRISGPGDDPEEVKARLKYWAQAVACTVKLCS

SEQ ID NO: 6859 - protein, 162 aa, Sorghum bicolor
MAAVSSTSTAYFSSQPQLPTSTADPTSDAASSRLVRQPRRSSSFVMVEASSASGSDGGVARTKSLTEDDLEDLKGCLDLGFGFAYSEIPELCVTLPALELCYSMTRRFLDEQRASGQEQEEEPASPPLPNWRISGPGDHPEEVKARLKYWAQAVACTVKLCR

SEQ ID NO: 6860 - protein, 159 aa, Setaria italica
MEAVSSTAYFSSQPQLPASTAGDPATPIASASRLVRQPRRNSSFVTVEASSGTGGDGVVRTRSLTEDDLEELKGCLDLGFGFAYSEIPELCGTLPALELCYSMTRRFLDEQREPGQEQETSATPLPNWRISGPGDDPEEVKARLKYWAQAVACTVKLCS

SEQ ID NO: 6861 - protein, 157 aa, Panicum virgatum
MAAISSTAYFSSQPQLPGSTADRDAATTASSGLARQPRRSCSFVMVEASSGTGGGVVRTRSLTEDDLEELKGCLDLGFGFAYSEIPELCGTLPALELCYSMTRRFLDEQRAPGKEQENAATPLPNWRISGPGDDPEEVKVRLKYWAQAVACTVKLCS

SEQ ID NO: 6862 - protein, 220 aa, Panicum virgatum
MAAAVESVVVVHNVAKRHNVGTLARSATAFGVAEVVVVGRRDVSAFGSHGATSHLRFRHFASLALARAYLKDERGCDICGVEITDDAQPVTAHPFRRSTAFLFGNEGTGLSQKECEICDFFVYIPQYGGGTASLNVTVAASIVLHHFAVWAGFPERGREGNKFIVADRPQGYSRGLYCTDSIEAVIEERKMRKENACDILEENGSSHPQESNGLDLMFTD

SEQ ID NO: 6863 - protein, 220 aa, Panicum virgatum
MAAAVESVVVVHNVAKRHNVGTLARSATAFGVAEVVVVGRRDVSAFGSHGATSHLRFRHFSSLALARAYLKDERGCDICGVEITDNAQPVTAHPFRRSTAFLFGNEGTGLSQKECEICDFFVYIPQYGGGTASLNVTVAASIVLHHFAVWAGFPERGREGNKFIVADRPQGHSRGLYCTDSIEAVIEERKLRKENACDILEENGSSHPQESNGLDLMFTD

SEQ ID NO: 6864 - protein, 421 aa, Setaria italica
MSASMGEALTAAPPLPLSAHRIRPPRVKMSSSSSILPGRRTFGSMRIPSRLTEGENLGGSSRRRGGGYIGESPSPIGSDSPILPAVSRVLTESVSVQWHGLYDSAKIYGAKLGVMMDGAKPPLRRHPRQQLRMDLGARVAGGRDVYSARGVFMRIFRKKAPHISEAVHGSYPYGVGDINTAAAATLTPTNRAGAAKTAAMAAAAAVESVVVVHNVAKRHNVGTLARSATAFGVAEVVVVGRRDVSAFGSHGATSHLRFRHFASLALARAYLKDERGCDICGVEITDDAQPVTAHPFRRSTAFLFGNEGTGLSQKECEICDFFVYIPQYGGGTASLNVTVAASIVFHHFAVWAGFPERGREGNKFIVADRPQGHSRGLYCTDSIEALIEERKMRKENACDILEENGSSHPQESNGLDLMFTE

SEQ ID NO: 6865 - protein, 220 aa, Sorghum bicolor
MAAAVESVVVVHNVAKRHNVGTLARSATAFGVAEVVVVGRRDVSAFGSHGATSHLRFRHFASLALARAYLKEERGCDICGVEITEDAKPVTAHPFHRSTAFLFGNEGTGLSQKECDICDFFVYIPQYGGGTASLNVTVAASIVLHHFGVWAGFPERGREGNKFIVADRPQGHSRGLYCTDSIEAVIEERKMRKENACDILEENGGSHPQESNGLDLMFTD

SEQ ID NO: 6866 - protein, 223 aa, Brachypodium distachyon
MAAATAAVESVVVVHNVAKRHNVGTLARSATAFGVAEVVVVGRRDVSAFGSHGSTSHLRFRHFVSLATARAYLKDERGCDICGVEITDDALPVTARPFRRSTAFLFGNEGTGLSQKECEICDYFVYIAQYGGGTASLNVTVAASIVLHHFGVWAGFPERGREGNKFVVAEKPQGQSRGLYCSDSIEDVIEERKARKENACDIFEENGSSHPQESNGLDTMFTD

SEQ ID NO: 6867 - protein, 219 aa, Triticum aestivum
TAAVESVVVVHNVAKRHNVGTLARSATAFGVAEVVVVGRRDVSAFGSHGSTSHLRFRHFTSLATACAYLKDERGCDICGVEITDDALPVTAHPFRRSTAFLFGNEGTGLSQKECEVCDFFVYIPQYGGGTASLNVTVAASIVLHHFGVWAGFPERGREGSKFVVAEKPKGQSRGLYCSDSIEDVIEERKARRENACDIFEENGSSHPQESNGLGMMFTD

SEQ ID NO: 6868 - protein, 868 aa, Oryza sativa
MSTLAAHPPLGPAAAAQEKAASRNKRKYRAEPPSAELGSFGLEYPLTADCVGFEFMSPEKAAIAAAAAAAAVAAEGVNLDLIPGSCDCKDIHPTAEELLECQRYVNWNDPNEALLEEILLKGLDATFDNAVGVIIAMGYSEPTARAAVLRAATQYNWRESLAGFGEAAVEVLKTEGDMLSEGASEEDMRKIEQAVLGGMIALVNQAQPFYTTGDVMFCLLMSDMNVANACAMDYNPASLPAVDTQVIAQPVVGNYEPNNPSSDLSVSITNPQTGVTFRGKLTPVPPNSYNTAKADSSATPANLNVPSSKPSVSGKAQSEIPNLKPKENSNPVPDHSEEQPFVAAATQPVKDDKPIPSKRGSSKRDSLHRQKLMSFDKSSRALGSKGSLRSSKHSSLGSAVLDRKCRSFSDSTTSSLKASSKVGKGFSASMKGPEVPPDLSFTGAALPSNPSFDAKLSSNLNPLPAASTDLSLSLPLPSSNDSPAPSSNHDANTEGMDSSSKINLSYDEDQKVWIPQDKKDEMVLILVQRQKELQAHMRDWTDWAQQKVMQVTRRLAKEKEELHSLRKEKEEADRLQEERHNLEESTRKKLLEMESAISRANTQLEKAESSARRREAENEQLRIQMEAAKRHALVSATNILELSKKDENSHKRSQHWESERALLQEDLAAQRNKLSQVHQQLHHAKEQKDQIQARWRQEEAGKIEAIARVSLEKKERDQIETSLRSEENFLHLKAENDTQRYKSQIRALEQQISQLKVSLDSLRVGAPPKWGADNRTNALRLSEGRKNGSAQILANIAAVPQDFDFDDIQRDRECVMCLSEEMSVVFLPCAHQVVCAKCNDLHDKQGMKECPSCRTPIQRRVCARLAGC

SEQ ID NO: 6869 - protein, 224 aa, Oryza sativa
MAAAAAAAVESVVVVHNVAKRHNVGTLARSATAFGVAEVVVVGRRDVSAFGSHGATSHLRFRHFASLPLARAYLKDERGCDICGVEITHNALPVTAHPFRRSTAFLFGNEGTGLSQKECEICDFFVYIPQYGGGTASLNVTVAASIVLHHFGVWAGFPERGREGNKFVVADKPKGQSRGLYCTDSIEEVIEERKMRRENACDIFEENGSSEHQESNVLGTMLSD

SEQ ID NO: 6870 - protein, 208 aa, Cenchrus ciliaris
GTGPPHNVGTLARSATAFGVAEVVVVGRRDVSAFGSHGATSHLRFRHFTSLALARAYLKDERGCDICGVEITDDAQPVTAHPFRRSTAFLFGNEGTGLSQKECDFCDFFVYIPQYGGGTASLNVTVAASIVLHHFAVWAGFPERGREGNKFVVADRPQGHSRGLYCTDSIEAVVEERKMRKENACDIFEENGSSHPQESNGLDLMFTE

SEQ ID NO: 6871 - protein, 229 aa, Secale cereale
MAAAAAASGATAAVESVVVVHNVAKRHNVGTLARSATAFGVAEVVVVGRRDVSAFGSHGSTSHLRFRHFTSLATACAYLKDERGCDICGVEITDDALPVTAHPFRRSTAFLFGNEGTGLSQKECEVCDFFVYIPQYGGGTASLNVTVAASIVLHHFGVWAGFTERGREGSKFVVAEKPKGQSRGLYCSDSIEDVIEERKARRENACDIFEENGSSHPQESNGLGMMFTD

SEQ ID NO: 6872 - protein, 229 aa, Secale cereale
MATAAAASGATAAVESVVVVHNVAKRHNVGTLARSATAFGVAEVVVVGRRDVSAFGSHGSTSHLRFRHFTSLATACAYLKDERGCDICGVEITDDALPVTAHPFRRSTAFLFGNEGTGLSQKECEVCDFFVYIPQYGGGTASLNVTVAASIVLHHFGVWAGFPERGREGNKFVVAEKPKGQSRGLYCSESVEDVIEERKARRENACDIFEENGSSHPQESNGLGMMFTD

SEQ ID NO: 6873 - protein, 141 aa, Panicum virgatum
ARSATAFGVAEVVVVGRRDVSAFGSHGATSHLRFRHFSSLALARAYLKDERGCDICGVEITDNAQPVTAHPFRRSTAFLFGNEGTGLSQKECEICDFLSTSLNMVVEQHLSMLQLQLQLFSTTLQSGLAFPNEAERATNSL

SEQ ID NO: 6874 - protein, 543 aa, Sorghum bicolor
MDSTQDFQPRTFSIKLWPPSESTRLMLVEKMTKNLSTESIFSRKYGLLGKQEAHENAKRIEELCFASADEHFKREPDGDGSSAVQLYAKETSKLMLEVLKKGPSTTAELETPVADTPLVPADTVLDISGGKRAFIEADEAKELLSPLTKPGNSYKRICFSNRSFGIGAANVAGPILEAVKNQLTEVDISDFVAGRPEDEALDVMRIFSKALEGSVLRYLNISDNALGEKGVRAFSELLKSQESLEELYVMNDGISEEAAKALSELIPATEKLKVLHFHNNMTGDEGAMYIAEMVKRSPNVESFRCSATRIGSDGGVALSEALGTCTRLKKLDLRDNLFGVDAGLALSKTLSKLHDLVELYLSDLNLENEGTISIVKALKQSAPQLEVLEMAGNEINAKAALDLAECLTAMQSLKKLTLAENELKDDGAVIIAKSLEDGHTDLKELDVSTNMLQRVGARCFARAVADKPAFVQLNINGNFISDEGIDEVKEILKAGKKSLDVLGSLDENEPDGEPDDEEEDEDAEDNEDELDLKLQSVKVEQDD

SEQ ID NO: 6875 - protein, 548 aa, Setaria italica
MDSAAQDFQPRTFSIKLWPPSESTRLMLVERMTKNLSSESIFSRKYGLLGKEEAHENAKRIEQLCFTSADEHFKMEPDGDGSSAVQLYAKETSKMMLEVLKRGPRTAAESEAPVADAPLEPGDTVLDISGGKRAFIEADEAKELLSPLTKPGNSYKRICFSNRSFGVDAANVAGPILESVKNQLTEVDISDFVAGRPEDEALDVMRIFSKALEGSILRYLNISDNALGEKGVRAFSELLKSQENLEELYVMNDGISEDAAKALSELIPSTEKLKVLHFHNNMTGDEGAVYVAEMVKRSPNLESFRCSATRIGSDGGVALSEALGTCTRLKKLDLRDNLFGVDAGIALSKTLPKLPDLVELYLSDLNLESCTVAIVNALKQSAPQLEVLELAGNEINAKAAPAVAECLTAMQSLKKLTLAENELKDEGAVIIAKSLEDGHTDLKELDVSTNMLQRVGARCFARAVANKPGFVQLNINGNFISDEGIDEVKDILKAGKNSLDVLGSLDENDPEGEPDDGDEEEDDEDAEDGDDEDGLDSKLQNVQVDRDD

SEQ ID NO: 6876 - protein, 548 aa, Setaria italica
MDSTAQDFHPRTFSIKLWPPSESTRLMLVERMTTNLSTESIFSRKYGLLGKEEAHENAKRIEQLCFASADEHFKKEPDGDGSSAVQLYAKETSKMIMEVLKKGPMTTAEPEAPVADTPIEPGDTVLDISGGKRAFIEADEAKELLSPLTEPGNSYKRICFSNRSFGVDAANVAGPILESVKNQLTEVDISDFVAGRPEDEALDVMRIFSKALEGSVLRYLNISDNALGEKGVRAFSELLKSQEKLEELYVMNDGISEDAAKALSELIPSTENLKVLQFHNNMTGDEGAVYVAEMVKRSPNLESFRCSATRIGADGGVALSEALGTCTHLKKLDLRDNLFGVDAGIALSKTLPKLPDLVELYLSDLNLENKGTIAIVNALKQSAPQLEVLELAGNEINAKAAPALAECITAMQSLKKLTLAENELKDDGAVIIAQSLEDGHADLKELDVSTNMLQRVGARCFARAVANKPGFVQLNMNGNFISDEGIDEVKDILKAGKNSLDVLGSLDENDPEGEPDDDEEDDDEDAKDDDDEDGLDSKLQNVKVEQDG

SEQ ID NO: 6877 - protein, 547 aa, Setaria italica
MDAAAQDFQPRTFSIKLWPPSESTRLMLVERMTKNLSTESIFSRKYGLLGKEEAHENAKRIEQLCFASADEHFKKEPDGDGSSAVQLYAKETSKMMLEVLKKGPRTTAEPEAPVADTLEPGDTVLDISGSKRAFIEADEAKELLSPLTKPGNSYNRICFSNRSFGLDAANVAGPILESVKNQLTEVDISDFVAGRPEDEALDVMRIFSKALEGSVLRYLNISDNALGEKGVRAFSELLKSQENLEEFYVMNDGISEDAAKALSELIPSTENLKVLHFHNNMTGDEGAVYVAEMVKRSPNLESFRCSATRIGSDGSVALSEALGTCTHLKKLDLRDNLFGVDAGIALSKTLSKLPDLVELYLSDLNLENKGTVAIANALKQSAPQLEVLELAGNEINAKAAPALAECLTAMQSLKKLILAENELKDDGAVIIAKSLEVGHADLKELDVSTNMFQRVGARCFARAVANKPGFMQLNINGNFISDEGIDEVKDILKAGKNSLDVLGSLDENDPEGEPDDGDEEDDEDAKDDDDEDGLNSKLQNVQVEQED

SEQ ID NO: 6878 - protein, 548 aa, Panicum virgatum
MDSAGQDFQPRTFSIKLWPPSESTRLMLVERMTVNLSTESIFSRKYGLLGKEEAHENAKRIEQLGFTSADEHFKREPDGDGSAAVQLYAKETSKMMLEVLKKGPRITAESEAPVSDTPLGGDSVLDISGGKRAFIEAEEAKELLSPLTKPGNSYKRICFSNRSFGIDAANVAGPILESVKNQLTEVDISDFVAGRPEDEALDVMRIFSKALEGSVLRYLNISDNALGEKGVRAFSELLKSQENLEEFYVMNDGISEDAAKALSELIPSTEKLKVLHFHNNMTGDEGAVYVAEMVKRSPNLESFRCSATRIGSDGGVALSEALGTCTHLKKLDLRDNLFGVDAGIALSKTLPKLPDLVELYLSDLNLENKGAVAIVNALKQLAPQLEVLEMAGNEINAKAAPAIAECLTVMQSLKKLTLAENELKDAGAVIIAKSLEDGHADLKELDVSTNMFQRAGARCFARAVANKPGFVQLNINGNFISDEGIDEVKDILKAGKNSLDVLGSLDENDPEGEPDGGDEEEDDEDAKDDDDEDGLDLKLQNVQVEQDD

SEQ ID NO: 6879 - protein, 551 aa, Panicum virgatum
MDSAAQNFQPRTFSIKLWPPSESTRLMLVERMTKNLSTESIFSRKYGLLGKEEAHENAKRIEQLCFVAADEDFKKEPDGDGSSAVQLYARETSKMMLEVLKKGPRVTAESEVPVADTPLVPGDTVLDISGGKRAFIEADEAKELLSPLTKPGNSYKRICFSNRSFGVDAANVAGSILESVKNQLTEVDISDFVAGRPEDEALDVLRIFSKALEGCVLRYLNISDNALGEKGVRAFSELLKSQDNLEELYVMNDGISEDAAKALSELIPSTEKLKVLHFHNNMTGDEGAVYVAEMVKRSPNLESFRCSATRIGSDGGVALSEALGTCTHLKKLDLRDNLFGVDAGIALSKTLPKLPDLVELYLSDLNLENKGTLAIVNALKLSAPQLEVLELAGNEINAKAAPGIAECLTAMQSLKKLTLAENELKDAGAVIIAKSLEDGHTNLKELDVSTNMFQRAGARCFARAVANKPGFVQLNINGNFISDEGIDEVKDILKAGKNSLDVLGSLDENEPEGEPDDGDEDDGDEDAKDDNVEDGLDSKLQNVQVEQDDEP

SEQ ID NO: 6880 - protein, 548 aa, Panicum virgatum
MDSAPQDFQPRTFSIKLWPPSESTRLKLVERMTKNLSTESIFSRKYGLLGKEEAHENAKRIEQLCFASADEHFKREPDGDGSSAVQMYAKDTSKMMLEVLKKGPRITAESEAPVSDTPLGGDTVLDISGGKRAFIEADEAKELLSPLTKPGNSYKRICFSNRSFGTDAANVAGPILESIKNQLTEVDISDFVAGRSEDEALDVMRIFSKALEGAVLRYLNISDNALGEKGVRAFSELLKSQENLEELYVMNDGISEDAAKALSELIPSTEKLKVLHFHNNMTGDEGAVYVAEMVKRSPNLESFRCSATRIGSDGSVALSEALGTCTHLKKLDLRDNLFGVDAGIALSKTLPKLPDLVELYLSDLNLENKGTVAIVNALKQSAPQLEVLEMAGNEINAEAAPDIAECLTTMQSLKKLTLAENELKDAGAVIIAKSLEDGHADLKELDVSTNMFQRAGARCFARAVANKPGFVQLNINGNFISDEGIEEVKGILKAGKNSLDVLGSLDENDPEGEPDNGDEEEDDEDGKDDDDDDGLDLKLQSVQVEHDD

SEQ ID NO: 6881 - protein, 544 aa, Oryza sativa
MDSTKQDFQPRTFSIKLWPPSESTRLMLVERMTKNLSTESIFSRKYGLLGKEEAHDNAKRIEEVCFASADEHFKEEPDGDGSSAVQLYAKETSKLMLEVLKRGPRTTVEPEVPVADTPLEPADSVFDISGGKRAFIEADEAKELLSPLIKPGNAYKRICFSNRSFGIGAANVAGPILESIKKQLTEVDISDFVAGRPEDEALDVMRIFSKALEGAVLRYLNISDNALGEKGVRAFEELLKSQDNLEELYVMNDGISEEAAQALSELIPSTEKLKILHFHNNMTGDEGAMFIAEMVKRSPNLESFRCSATRIGSDGGVALAEALGTCTRLKKLDLRDNLFGVEAGLALSKTLSKLPDLVELYLSDLNLENKGTVAIINTLKQSAPQLEVLEMAGNEINAKASQALAECLTAMQSLKKLTLAENELKDDGAVVIAKSLEDGHQDLKELDVSTNMLQRVGARCFAQAIANKPGFVQLNINGNFISDEGIDEVKDILKSGENSVEVLGPLDENDPEGEAEDDEEEEEEEEDDGELDSKLQSLKVEQDD

SEQ ID NO: 6882 - protein, 552 aa, Hordeum vulgare
MDSTAQDFQPRTFTIKLWPPSESTRLMLVERMTKNLSDESIFSRKYGILGKEEAHENAKRIEEVCFASADEHFKKEPDGDGSSAVQLYAKETSKLMLEVLKKGPRTTAEPEAPVIDAPLEPAATVFDISGGKRAFIEAEEAKELLSPLTKPGNSYKRICFSNRSFGIGAANVAGPILESIKSQLTEVDISDFVAGRPEDEALDVMRIFSKALAGSVLRYLNISDNALGEKGVRAFTELLKSQGDLEELYVMNDGISGEAAKALSELIPSTEKLKVLHFHNNMTGDEGAMPIAEMVKRSPNLESFRCSATRIGSDGGVALAEALGTCTRLKKLDIRDNLFGVEAGVALSKTLPKLGGLVELYLSDLNLENEGTIAIVDVLKQSAPQLEVLEMAGNEITAKAAKAVAECLTAMQSLKKLTLAENELKDAGAVTIAKSLQEGHPGLEELDVSTNLFQRSGARCFAQAVANKPGFALLNINSNFISDEGIDEVKEILKGGENSLEVLGPLDENDPEGDPEDDEEEEDDEDEEKDGNDNGDGGLGSKLQGLKVEEED

SEQ ID NO: 6883 - protein, 551 aa, Triticum aestivum
MESTAEGLQPRTFSVKLWPPSESTRLMLVERMTKNLSAECIFSRKYGILSKEEAHENAKRIEEVCFASAEEHFKKEPDGDGSSAVQLYAKETSKLMLEVLKKGPRTTEEPEAPVVDTPLEPADTVFDISGGKRAFIEAEEAKELLSPLTKPGNSYKRICFSNRSFGIGAANVAGPILESIKSQLTEVDISDFVAGRPEDEALDVMRIFSKALAGSVLSYLNISDNALGEKGVRAFTELLKSQGDLEELYVMNDGISEEAAKALSELIPSTEKLKVLHFHNNMTGDEGAMPIAEMVKRSPNLESFRCSATRIGSDGGVALAEALGTCTRLKKLDIRDNLFGVEAGVALSKTLPKLGGLVELYLSDLNLENEGTIAIVNVLKQSAPQLEVLEMAGNEITAKAAKAVAECLTAMQSLKKLTLAENELKDDGAVTIAKSLEEGHPSLKELDVSTNLFQRSGARCFAQAVANKPGFVLLNINSNFISDEGVDEVKEILKGGKNSLEVLGPLDENDPEGDPEDGEEEEDGEDDDDEEKDGDDGGLGSKLQGLKVEED

SEQ ID NO: 6884 - protein, 554 aa, Secale cereale
MASAAQDFQPRTFSIKLWPPSESTRLMLVERMTKNLSSESIFSRKYGLLGKEEAHQNAKRIEEMCFASADEHFNKEPDGDGSSAVQLYAKETSKLMLEVLKKGPGATAEPEAPVVDTPIEPAETVFDISGGKRAFIEADEAKELLSPLTEPGNSYSRICLSNRSFGIGAANVAGPILESIKSQLKEVDISDFVAGRPEDEALDVMRIFSKALAGSVLRYLNISDNALGEKGVRAFTELLKSQGDLEELYVMNDGISGEAAKALSELIPSTEKLKVLHFHNNMTGDEGAMFIAEMVKRSPNLESFRCSATRIGSDGGVALAEALGTCTRLKKLDIRDNLFGVEAGVALSETLPKLGDLVELYLSDLNLENEGTIAIVNVLKESAPQLEILEMAGNEITAEAAKPLAECLTAMQSLKKLTLAENELKDAGAAAVAKSLQEGHPDLKELDVSTNLFQRSGARCFAQAVANKPGFVQLNMNANYIPEEGIDEVRKILKAGENSADVLGPLDENEPEGNPDDEDEEEDEDDEAKYGDDNGKDAGLGSKLQDLKVEAEED

SEQ ID NO: 6885 - protein, 554 aa, Triticum aestivum
MASAAQDFQPRTFSIKLWPPSESTRLMLVERMTKNLSSESIFSRKYGLLGKEEAHKNAKRIEEMCFASADEHFKKEPDGDGSSAVQLYAKETSKLMLEVLKKGPVTTAEPEAPVIDTPIEPADTVFDISGGKRAFIEADEAKELLSPLTEPGNSYSRICLSNRSFGIGAANVAGPILESIKSQLKEVDISDFVAGRPEDEALDVMRIFSKALAGSVLRYLNISDNALGEKGVRAFTELLKSQGDLEELYVMNDGISGEAAKALSELIPSTEKLKVLHFHNNMTGDEGAMFIAEMVKRSPNLESFRCSATRIGSDGGVALAEALGTCTRLKKLDIRDNLFGVEAGVALSETLPKLGDLVELYLSDLNLENEGTIAIVNVLKESAPQLEILEMAGNEITAEAAKPLAECLTAMQSLKKLTLAENELKDAGAAAVAKSLQEGHPDLKELDVSTNLFQRSGARCFAQAVANKPGFVLLNMNANYIPDEGIDEVRKILKAGENSADVLGPLDENEPEGNPDDEDEEEDDDDEAKYGDDNGKDAGLGSKLQDLKVEAEED

SEQ ID NO: 6886 - protein, 548 aa, Secale cereale
MESTAEDFQPRTFSVKLWPPSESTRLMLVERMTRNLSAECIFSRKYGILSKEEAHENAKRIEEVCFASAEEHFKKEPDGDGSSAVQLYAKETSKLMLEVLKKGPRTTEEPEAPVVDTPLEPADTVFDISGGKRAFIEAEEAKELLSPLTKPGNSYKRICFSNRSFGIGAANVAGPILESIKSQLTEVDISDFVAGRPEDEALDVMRIFSKALAGSVLSYLNISDNALGEKGVRAFTELLKSQGNLEELYVMNDGISGEAAKALSELIPSTEKLKVLHFHNNMTGDEGAMPIAEMVKRSPNLESFRCSATRIGSDGGVALAEALGTCTRLKKLDIRDNLFGVEAGVALSKTLPKLGGLVELYLSDLNLENEGTIAIVNALKQSAPQLEVLEMAGNEITAKAAKAVAECLTAMQSLKKLTLAENELKDDGAVTVAKSLQEGHPGLKELDVSTNLFQRSGARCFAQAVANKPDFVLLNINSNFISDEGVDEVKEILKGGKNSLEVLGPLDENDPEGDPEDGEEEEDGEMTMTRRRTGMITATVAWARSCRA

SEQ ID NO: 6887 - protein, 554 aa, Secale cereale
MASAAQDFQPRTFSIKLWPPSESTRLMLVERMTKNLSSESIFSRKYGLLGKEEAHANAKRIEEMCFASADEHFNTEPDGDGSSAVQLYAKETSKLMLEVLKKGPGATAEPEAPVVDTPIEPAETVFDISGGKRAFIEADEAKELLSPLTEPGNSYSRICLSNRSFGIGAANVAGPILESIKSQLKEVDISDFVAGRPEDEALDVMRIFSKALAGSVLRYLNISDNALGEKGVRAFTELLKSQGDLEELYVMNDGISGEAARALSELIPSTEKLKVLHFHNNMTGDEGAMFIAEMVKRSPNLESFRCSATRIGSDGGVALAEALGTCTRLKKLDIRDNLFGVEAGVALSETLPKLGDLVELYLSDLNLENEGTIAIVNVLKESAPQLEILEMAGNEITVEAAKPLAECLTAMQSLKKLTLAENELKDAGAAAVAKSLQEGHPDLKELDVSTNLFQRSGARCFAQAVANKPGFVQLNMNANYIPEEGIDEVRKILKAGENSADVLGPLDENEPEGNPDDEDEEEDDDDEAKYGDDNGKDAGLGSKLQDLKVEAEED

SEQ ID NO: 6888 - protein, 554 aa, Secale cereale
MASAAQDFQPRTFSIKLWPPSESTRLMLVERMTKNLSSESIFSRKYGLLGKEEAHANAKRIEEMCFASADEHFNTEPDGDGSSAVQLYAKETSKLMLEVLKKGPGATAEPEAPVVDTPIEPAETVFDISGGKRAFIEADEAKELLSPLTEPGNSYSRICLSNRSFGIGAANVAGPILESIKSQLKEVDISDFVAGRPEDEALDVMRIFSKALAGSVLRYLNISDNALGEKGVRAFTELLKSQGDLEELYVMNDGISGEAARALSELIPSTEKLKVLHFHNNMTGDEGAMFIAQMVKRSPNLESFRCSATRIGSDGGVALAEALGTCTRLKKLDIRDNLFGVEAGVALSETLPKLGDLVELYLSDLNLENEGTIAIVNVLKESAPQLEILEMAGNEITAEAAKPLAECLTAMQSLKKLTLAENELKDAGAAAVAKSLQEGHPDLKELDVSTNLFQRSGARCFAQAVANKPGFVLLNMNANYIPEEGIDEVRKILKAGENSADVLGPLDENEPEGNPDDEDEEEDDDDEAKYGDDNGKDAGLGSKLQDLKVEAEED

SEQ ID NO: 6889 - protein, 554 aa, Hordeum vulgare
MASVVQDFQPRTFSIKLWPPSESTRLMLVERMTKNLCNESIFSRKYGLLGKEEAHENAKRIEEMCFASADEHFKTVPDGDGSSAVQLYAKETSKLMLEVLKKGPRTTAEPEAPVIDTPMEPADTLFDISGGKRAFIEADEAKELLSPLMKPGNSYSRICLSNRSFGIGAANVAGPILESIRTQLKEVDISDFVAGRPEDEALDVMRIFSKALAGSVLRYLNISDNALGEKGVRAFTELLKSQGNLEELYVMNDGISGEAAKALSELIPSTEKLKVLHFHNNMTGDEGAMFIAEMVKRSPNLESFRCSATRIGSDGGVALAEALGTCTRLKKLDIRDNLFGVEAGVALSETLPKLGDLVELYLSDLNLENEGTIAIVNVLKESAPQLEILEMAGNEITADAAKPLAECLTAMQSLKKLTLAENELKDAGAVAVAKSLQEGHPDLKELDVSTNLFQRSGARCFAQAVANKPGFLLLNMNANYIPEEGIDEVRKILKAGENSADVLGPLDENEPEGNPDDEDEEEDEDDEAKYGDGNGKDAGLGSKLQDLQVEAEED

SEQ ID NO: 6890 - protein, 759 aa, Zea mays
MPDLPCDGDGVCMVCRVTSPPEVDLLHCSTCATPWHSPCLSKAPALADAASWSCPDCSLDSATVAAPSAPANTLVAAIRAIESDNTLSDQEKARRRQALLAGDAPDVADDDDAADDTLEIVGKNFSCVFCMKLPERPVTTPCGHNFCLKCFQKWIQSKKRTCGKCRAPIPAKMAEQPRINSALVEVIRMAKISKNHNSAGSAVPYHYMRNDDRPDKAFTTDRAKKAGKANASSGQIFVTIAPDHFGPILAENDPRRNMGVRVGETWEDRLECRQWGAHFPHVAGIAGQSTHGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDEKDGWKWMVPPPVSKRPVLSGDPETDKLIRKATKRAHLSVAERLLKEFGCSICRAVIKEPLTTPCAHNFCKTCLLGAYDSQSSMRERSRGGRTLRAQKIVKTCPSCPTDICDFLENPQINREMMELIESLQRKAVEEGKMAAGDAEESGDGDSEENGGALVKGEDDSNLNEEGQDGVDADGSVKIVVEMEGAKDDKKSKMGAAEVVDVLVEDAAAKQPKKRTADEDAAAKQTKHKADAETGGKRVKSSAAVEEVDVCVTPMKRTRKSGDMHDDGNGSPAVSSGRRVTRSSVNATGADDSPARRTRSRGRAC

SEQ ID NO: 6891 - protein, 761 aa, Panicum virgatum
MPDLPCDGDGVCMVCRVASPPEVDLLRCSTCATPWHSPCLSKPPALADAASWSCPDCSPDSSPAPAPAGPGNDLVAAIRAIEADHTLSDQEKARRRQALLAGSAPAAADDDEDDNAADDALEIVGKNFSCVFCMKLPERPVTTPCGHNFCLKCFQKWIQNGKRTCGKCRAQIPAKMAEQPRINSALVEVIRMAKISKNPNSSGSTAPYHYIRNDDRPDKAFTTDRAKKAGKANASSGQIFVTIAPDHFGPILAENDPRRNIGVRVGETWEDRLECRQWGAHFPHVAGIAGQSTYGAQSVALSGGYEDDEDHGEWFLYTGSGGRDLSGNKRTNKEQSSDQKFEKLNAALRISCLRGYPVRVVRSHKEKRSSYAPESGVRYDGVYRIEKCWRKIGIQGTFKVCRYLFVRCDNEPAPWTSDDHGDRPRPLPKIKELQGATDITERKGRPSWDYVEKEGWKWVVPPPISKKPVLSGDPDTDKQIRRATKRAHMSVAERLLKEFGCSICRAVIKEPLTTPCAHNFCKACLLGAYDSQASMRERSRGGRTLRAQKIVKKCPSCPTDICDFLENPQINREMMELIESLQRKADEGDTKVASDDAEECGDGESEGNDGALVKEEDDSSMNEDEQDSADADANADGSVKIVVEIEEGKDDKKAKMGVTEVADVLVEEKAVKETKKRKGDAETGTDVAPAKRMKKNIAAVEEATCTPVKRISKSGDVDSEGNSSPVVSSGRRVTRSSANASEADDSLARRTRSRARADAGC

SEQ ID NO: 6892 - protein, 730 aa, Zea mays
MPDLPCDGDGVCMVCRVASPPEVDLLTCSTCTTPWHSPCLSKPPALADAASWSCPDCSPDSAAVAAPSGPANTLVAAIRAIEADHTLSDQEKARRRQALLTGDAPDGADDDDDEASDDALEIVGKNFSCVFCMKLPERPVTTPCGHNFCLKCFQKWIQNQKRTCGKCRAQIPAKMAEQPRINSALVEVIRMAKISKNPNSAGSAVPYHYLRNDDRPDKAFTTDRAKRAGKANASSGQIFVTIAPDHFGPILAENDPRRNMGVRVGETWEDRLECRQWGAHFPHVAGIAGQSTHGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDDKDGWKWVVPPPVSRKPVLSGDPETDKQIRRATKRVHLSVAERLLKEFACSICRAVIKEPLTTPCAHNFCKTCLLGAYDSQSSIRERSRGGRTLRAQKIVKTCPSCPTDICDFLENPQINREMMELIETLQRKAVEEAKMTSDDAEECGDGDSEENDGDLVKGEDVSGLNEGEQDSADADANVEGSVKIVVEIKEEGKDDKRSKMGATEVVDVLVDEDAVKQTKKRKVDAEAGTNGGKRMKSSSTVEEVAVCVTPVKRSRKSGDMDDERNGSPAVSSGRR

SEQ ID NO: 6893 - protein, 759 aa, Panicum virgatum
MPDLPCDGDGVCMVCRAASPPEVDLLRCSTCATPWHSPCLSKPPALADAASWSCPDCSPDSSPAPAPAGPGNDLVAAIRAIEADQTLSDQEKARRRQALLAGSAPAAADDDEDDNAADDALEIVGKNFSCVFCMKLPERPVTTPCGHNFCLKCFQKWIQNGKRTCGKCRAQIPAKMAEQPRINSALVEVIRMAKISKNPNSSGSTAPYHYIRNDDRPDKAFTTDRAKKAGKANASSGQIFVTIAPDHFGPILPENDPRRNIGVRVGETWEDRLECRQWGAHFPHVAGIAGQSTYGAQSVALSGGYEDDEDHGEWFLYTGSGGRDLSGNKRTNKEQSSDQKFEKLNAALRISCLRGYPVRVVRSHKEKRSSYAPESGLRYDGIYRIEKCWRKIGIQGKFKVCRYLFVRCDNEPAPWTSDDHGDRPRPLPKIKELQGATDITERKGRPSWDYVEKEGWKWVVPPPISKKPVLSGDPETDKQIRRATKRAHMSVAERLLKEFGCSICRALIKEPLTTPCAHNFCKACLLGAYDSQASMRERSRGGRTLRAQKIVKKCPSCPTDICDFLENPQINREMMELIESLQRKAVEESDTKVASDDAEECGDGESEGNDGALVKEEDDSSMNEDGQDSADAKADGSVKIVVEIEEGKDENAKMGVTEVVDVLIEEKAVKETKKRKGDAETGTDGAPAKRMKKNVAAVEEATSTPVKRIRKSGDVDSEGNGSPVVSSGRRVTRSSANASEADDSPARRTRSRVRADTGC

SEQ ID NO: 6894 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 6895 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 6896 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 6897 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6898 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6899 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 6900 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 6901 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 6902 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 6903 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 6904 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 6905 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 6906 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 6907 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 6908 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 6909 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 6910 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 6911 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 6912 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 6913 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 6914 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 6915 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 6916 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 6917 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 6918 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 6919 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 6920 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 6921 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 6922 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 6923 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 6924 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 6925 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 6926 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 6927 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 6928 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 6929 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 6930 - DNA, 538 bp, 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 6931 - DNA, 32 bp, Artificial Sequence
  Primer
aaaaggcctacatagtctaacactcgcacacg

SEQ ID NO: 6932 - DNA, 31 bp, Artificial Sequence
  Primer
aaaaggcctagcataaacacagctcagcagg

SEQ ID NO: 6933 - DNA, 31 bp, Artificial Sequence
  Primer
aaaaggcctattctttagtgacgcaccgaac

SEQ ID NO: 6934 - DNA, 31 bp, Artificial Sequence
  Primer
aaaaggcctcatatggcaacccatctttctc

SEQ ID NO: 6935 - DNA, 33 bp, Artificial Sequence
  Primer
aaaaggcctctagaaggtggtcaagtcttcagg

SEQ ID NO: 6936 - DNA, 31 bp, Artificial Sequence
  Primer
aaaaggcctgatatttcagccaaccaacacc

SEQ ID NO: 6937 - DNA, 31 bp, Artificial Sequence
  Primer
aaaaggcctgcataaacaatatgcatgcgac

SEQ ID NO: 6938 - DNA, 31 bp, Artificial Sequence
  Primer
aaaaggcctgctgcacgaccatatctaacag

SEQ ID NO: 6939 - DNA, 29 bp, Artificial Sequence
  Primer
aaaaggccttcgtaccagggacagggtag

SEQ ID NO: 6940 - DNA, 31 bp, Artificial Sequence
  Primer
aaacccgggacctccaattccagttgtcttc

SEQ ID NO: 6941 - DNA, 31 bp, Artificial Sequence
  Primer
aaacccgggagttctgaatctgggattgtgg

SEQ ID NO: 6942 - DNA, 30 bp, Artificial Sequence
  Primer
aaacccgggcaggtgtacatcggtacctcg

SEQ ID NO: 6943 - DNA, 26 bp, Artificial Sequence
  Primer
aaacccgggccactcgcctccctctc

SEQ ID NO: 6944 - DNA, 26 bp, Artificial Sequence
  Primer
aaacccgggctttccgtccccaatcc

SEQ ID NO: 6945 - DNA, 31 bp, Artificial Sequence
  Primer
aaacccggggactctgaagattgcttccgtc

SEQ ID NO: 6946 - DNA, 29 bp, Artificial Sequence
  Primer
aaacccgggtccccaatccatttgaaacc

SEQ ID NO: 6947 - DNA, 31 bp, Artificial Sequence
  Primer
aaagaattcaaacttccattctgtgcaaacc

SEQ ID NO: 6948 - DNA, 31 bp, Artificial Sequence
  Primer
aaagaattcaaattacatggcacaccagctc

SEQ ID NO: 6949 - DNA, 31 bp, Artificial Sequence
  Primer
aaagaattcaacaaaggcagttcaagtggag

SEQ ID NO: 6950 - DNA, 31 bp, Artificial Sequence
  Primer
aaagaattcaacagagacttccttccgtctg

SEQ ID NO: 6951 - DNA, 29 bp, Artificial Sequence
  Primer
aaagaattcaagatccaccagctgacgac

SEQ ID NO: 6952 - DNA, 31 bp, Artificial Sequence
  Primer
aaagaattcaattcgcattcgttaccaagag

SEQ ID NO: 6953 - DNA, 31 bp, Artificial Sequence
  Primer
aaagaattcactactgtgtccgagaccatcc

SEQ ID NO: 6954 - DNA, 31 bp, Artificial Sequence
  Primer
aaagaattcacttatgccctcgtagcaacac

SEQ ID NO: 6955 - DNA, 31 bp, Artificial Sequence
  Primer
aaagaattcagatccaacacagggcatctac

SEQ ID NO: 6956 - DNA, 31 bp, Artificial Sequence
  Primer
aaagaattcagcgtatttacaaggcgtcaac

SEQ ID NO: 6957 - DNA, 31 bp, Artificial Sequence
  Primer
aaagaattcaggttcttttggccgataatgt

SEQ ID NO: 6958 - DNA, 31 bp, Artificial Sequence
  Primer
aaagaattcagtccacaaggtcagagattgc

SEQ ID NO: 6959 - DNA, 31 bp, Artificial Sequence
  Primer
aaagaattcagttctctcctgctctcaatgc

SEQ ID NO: 6960 - DNA, 31 bp, Artificial Sequence
  Primer
aaagaattcataacgcgcctaacacaaactc

SEQ ID NO: 6961 - DNA, 29 bp, Artificial Sequence
  Primer
aaagaattcatcaacagggcgcatatcac

SEQ ID NO: 6962 - DNA, 31 bp, Artificial Sequence
  Primer
aaagaattcatcatcccaaggagacaaacac

SEQ ID NO: 6963 - DNA, 31 bp, Artificial Sequence
  Primer
aaagaattcatgagatcactcatgtcgcttc

SEQ ID NO: 6964 - DNA, 31 bp, Artificial Sequence
  Primer
aaagaattccaacacaaacttgaacagggtc

SEQ ID NO: 6965 - DNA, 31 bp, Artificial Sequence
  Primer
aaagaattccaactagccctagaagaggtgg

SEQ ID NO: 6966 - DNA, 31 bp, Artificial Sequence
  Primer
aaagaattccaatgcttgaaatatgtggtgc

SEQ ID NO: 6967 - DNA, 31 bp, Artificial Sequence
  Primer
aaagaattccagcactagttacatgggcaag

SEQ ID NO: 6968 - DNA, 31 bp, Artificial Sequence
  Primer
aaagaattccagctctcaagttctctgcctc

SEQ ID NO: 6969 - DNA, 31 bp, Artificial Sequence
  Primer
aaagaattccaggaacctaagcgtctgtctc

SEQ ID NO: 6970 - DNA, 28 bp, Artificial Sequence
  Primer
aaagaattccaggtcggtgcatgatttg

SEQ ID NO: 6971 - DNA, 31 bp, Artificial Sequence
  Primer
aaagaattccataacacttgcagaaaccgtg

SEQ ID NO: 6972 - DNA, 31 bp, Artificial Sequence
  Primer
aaagaattccatttcctcccttcatgttcag

SEQ ID NO: 6973 - DNA, 31 bp, Artificial Sequence
  Primer
aaagaattcccagtcgaactgactgtctgag

SEQ ID NO: 6974 - DNA, 31 bp, Artificial Sequence
  Primer
aaagaattccccgagcagactggatatagac

SEQ ID NO: 6975 - DNA, 31 bp, Artificial Sequence
  Primer
aaagaattccgccctcaatcaaataaacatc

SEQ ID NO: 6976 - DNA, 27 bp, Artificial Sequence
  Primer
aaagaattccgtcacttgaccagccag

SEQ ID NO: 6977 - DNA, 31 bp, Artificial Sequence
  Primer
aaagaattccgtctcctcaactcagatctcc

SEQ ID NO: 6978 - DNA, 34 bp, Artificial Sequence
  Primer
aaagaattcctaagacacgctttgatgaggaaac

SEQ ID NO: 6979 - DNA, 33 bp, Artificial Sequence
  Primer
aaagaattcctaatggaaatggaaacggctaag

SEQ ID NO: 6980 - DNA, 35 bp, Artificial Sequence
  Primer
aaagaattcctacaggtagcaccacatacaaacag

SEQ ID NO: 6981 - DNA, 34 bp, Artificial Sequence
  Primer
aaagaattcctaccctacaaggcgatcaacatag

SEQ ID NO: 6982 - DNA, 34 bp, Artificial Sequence
  Primer
aaagaattcctagacacaaagaccaggagagtgg

SEQ ID NO: 6983 - DNA, 35 bp, Artificial Sequence
  Primer
aaagaattcctagtaataattcctcctcggctctg

SEQ ID NO: 6984 - DNA, 34 bp, Artificial Sequence
  Primer
aaagaattcctataacagatcctgacgagaaacg

SEQ ID NO: 6985 - DNA, 34 bp, Artificial Sequence
  Primer
aaagaattcctattacatcacatggtccagcaac

SEQ ID NO: 6986 - DNA, 31 bp, Artificial Sequence
  Primer
aaagaattcctcaggctagcacctagcagac

SEQ ID NO: 6987 - DNA, 31 bp, Artificial Sequence
  Primer
aaagaattcctgttccgtatcatggttcctc

SEQ ID NO: 6988 - DNA, 28 bp, Artificial Sequence
  Primer
aaagaattcgaagcactggtcctccgac

SEQ ID NO: 6989 - DNA, 31 bp, Artificial Sequence
  Primer
aaagaattcgacacaaagcttgcatctttcc

SEQ ID NO: 6990 - DNA, 31 bp, Artificial Sequence
  Primer
aaagaattcgaccaagatgtgggcttctatc

SEQ ID NO: 6991 - DNA, 31 bp, Artificial Sequence
  Primer
aaagaattcgatcaatcatcgtagcagcaag

SEQ ID NO: 6992 - DNA, 27 bp, Artificial Sequence
  Primer
aaagaattcgatctgaaggccgtcacc

SEQ ID NO: 6993 - DNA, 31 bp, Artificial Sequence
  Primer
aaagaattcgattaaagactgctggaggctg

SEQ ID NO: 6994 - DNA, 31 bp, Artificial Sequence
  Primer
aaagaattcgcaagatgtaatctgggtctcg

SEQ ID NO: 6995 - DNA, 32 bp, Artificial Sequence
  Primer
aaagaattcggagagagacagactggtagctg

SEQ ID NO: 6996 - DNA, 31 bp, Artificial Sequence
  Primer
aaagaattcgggagaacagttgctttgattc

SEQ ID NO: 6997 - DNA, 32 bp, Artificial Sequence
  Primer
aaagaattcgtaccaacagctgatgagagagg

SEQ ID NO: 6998 - DNA, 31 bp, Artificial Sequence
  Primer
aaagaattcgtcggcagcaggatatagtgac

SEQ ID NO: 6999 - DNA, 28 bp, Artificial Sequence
  Primer
aaagaattcgttccaaacgcagtgatcg

SEQ ID NO: 7000 - DNA, 31 bp, Artificial Sequence
  Primer
aaagaattcgttgcacgtcacactaatgacc

SEQ ID NO: 7001 - DNA, 31 bp, Artificial Sequence
  Primer
aaagaattctacacagatggcacacaacaag

SEQ ID NO: 7002 - DNA, 31 bp, Artificial Sequence
  Primer
aaagaattctatcacacggcgctaacagtag

SEQ ID NO: 7003 - DNA, 31 bp, Artificial Sequence
  Primer
aaagaattctatccacagcgtcactaccttg

SEQ ID NO: 7004 - DNA, 31 bp, Artificial Sequence
  Primer
aaagaattctatgctgctcctgttcatcatc

SEQ ID NO: 7005 - DNA, 31 bp, Artificial Sequence
  Primer
aaagaattctcaccatcactaggcctgaaac

SEQ ID NO: 7006 - DNA, 31 bp, Artificial Sequence
  Primer
aaagaattctcataagccctgtcatgttctg

SEQ ID NO: 7007 - DNA, 31 bp, Artificial Sequence
  Primer
aaagaattctcatccagtaaagcacaacagg

SEQ ID NO: 7008 - DNA, 31 bp, Artificial Sequence
  Primer
aaagaattctcccagtctacgtacaaccacc

SEQ ID NO: 7009 - DNA, 31 bp, Artificial Sequence
  Primer
aaagaattctcgaggctctgaagaaacaaac

SEQ ID NO: 7010 - DNA, 31 bp, Artificial Sequence
  Primer
aaagaattctctgatcgacagtagcagcatc

SEQ ID NO: 7011 - DNA, 31 bp, Artificial Sequence
  Primer
aaagaattctctttgatgctgttacacccac

SEQ ID NO: 7012 - DNA, 32 bp, Artificial Sequence
  Primer
aaagaattctgacacgattaatgttgaaccac

SEQ ID NO: 7013 - DNA, 31 bp, Artificial Sequence
  Primer
aaagaattcttaactatggcctcctcattgc

SEQ ID NO: 7014 - DNA, 31 bp, Artificial Sequence
  Primer
aaagaattcttatgagagcagggtaggcatc

SEQ ID NO: 7015 - DNA, 31 bp, Artificial Sequence
  Primer
aaagaattcttccaggtggtaatggctaaag

SEQ ID NO: 7016 - DNA, 26 bp, Artificial Sequence
  Primer
aaagaattctttgtggcatccggcac

SEQ ID NO: 7017 - DNA, 28 bp, Artificial Sequence
  Primer
aaagatatcacagccaaaccctagcctg

SEQ ID NO: 7018 - DNA, 28 bp, Artificial Sequence
  Primer
aaagatatcagtcgcagagaaggcaagc

SEQ ID NO: 7019 - DNA, 28 bp, Artificial Sequence
  Primer
aaagatatccatattcgccaaacgcatc

SEQ ID NO: 7020 - DNA, 27 bp, Artificial Sequence
  Primer
aaagatatccgtgggtgggtgtagagg

SEQ ID NO: 7021 - DNA, 31 bp, Artificial Sequence
  Primer
aaagatatcgctgtggctggtaataaagctc

SEQ ID NO: 7022 - DNA, 29 bp, Artificial Sequence
  Primer
aaagatatcgtagaggccgagagggagac

SEQ ID NO: 7023 - DNA, 31 bp, Artificial Sequence
  Primer
aaagatatctccaagtctctcttcttgctgc

SEQ ID NO: 7024 - DNA, 31 bp, Artificial Sequence
  Primer
aaaggatccaacaagccaatcaaacaagctg

SEQ ID NO: 7025 - DNA, 28 bp, Artificial Sequence
  Primer
aaaggatccaagctcagtcacccagtcg

SEQ ID NO: 7026 - DNA, 30 bp, Artificial Sequence
  Primer
aaaggatccaatagggtagacgcccaactc

SEQ ID NO: 7027 - DNA, 29 bp, Artificial Sequence
  Primer
aaaggatccaccagacaacggtacccaac

SEQ ID NO: 7028 - DNA, 31 bp, Artificial Sequence
  Primer
aaaggatccacctgatccctattccgatctc

SEQ ID NO: 7029 - DNA, 28 bp, Artificial Sequence
  Primer
aaaggatccacgggaagacaagggtgag

SEQ ID NO: 7030 - DNA, 29 bp, Artificial Sequence
  Primer
aaaggatccactcttctcgcctccgattc

SEQ ID NO: 7031 - DNA, 31 bp, Artificial Sequence
  Primer
aaaggatccactgaccagttgagtcccaaac

SEQ ID NO: 7032 - DNA, 32 bp, Artificial Sequence
  Primer
aaaggatccacttgctactccagttgaagctc

SEQ ID NO: 7033 - DNA, 26 bp, Artificial Sequence
  Primer
aaaggatccagccttggaggggatgg

SEQ ID NO: 7034 - DNA, 28 bp, Artificial Sequence
  Primer
aaaggatccagcgccgagggaggtatag

SEQ ID NO: 7035 - DNA, 29 bp, Artificial Sequence
  Primer
aaaggatccagctgcgagtaaggttggtc

SEQ ID NO: 7036 - DNA, 31 bp, Artificial Sequence
  Primer
aaaggatccaggccgtggatttgatagagag

SEQ ID NO: 7037 - DNA, 31 bp, Artificial Sequence
  Primer
aaaggatccagggagagagatttggtcttgg

SEQ ID NO: 7038 - DNA, 27 bp, Artificial Sequence
  Primer
aaaggatccagggtttcctcccaccac

SEQ ID NO: 7039 - DNA, 29 bp, Artificial Sequence
  Primer
aaaggatccagtcaatcaagctccggatc

SEQ ID NO: 7040 - DNA, 31 bp, Artificial Sequence
  Primer
aaaggatccatatgctgttgcactgctgaag

SEQ ID NO: 7041 - DNA, 29 bp, Artificial Sequence
  Primer
aaaggatccatccatccatcccgagaaag

SEQ ID NO: 7042 - DNA, 31 bp, Artificial Sequence
  Primer
aaaggatccatttgactgagactggtggtgg

SEQ ID NO: 7043 - DNA, 34 bp, Artificial Sequence
  Primer
aaaggatcccaaggaactatattcccagcttgac

SEQ ID NO: 7044 - DNA, 28 bp, Artificial Sequence
  Primer
aaaggatcccacagtcggcatcacagac

SEQ ID NO: 7045 - DNA, 27 bp, Artificial Sequence
  Primer
aaaggatcccaccaacgaaccagccac

SEQ ID NO: 7046 - DNA, 27 bp, Artificial Sequence
  Primer
aaaggatcccagcgatcccgattcaac

SEQ ID NO: 7047 - DNA, 27 bp, Artificial Sequence
  Primer
aaaggatcccaggcaggaagacgatgg

SEQ ID NO: 7048 - DNA, 30 bp, Artificial Sequence
  Primer
aaaggatcccagttcgacgctctctttctc

SEQ ID NO: 7049 - DNA, 31 bp, Artificial Sequence
  Primer
aaaggatcccatagagacgcccaaaccctac

SEQ ID NO: 7050 - DNA, 28 bp, Artificial Sequence
  Primer
aaaggatcccatccagttcgacgctctc

SEQ ID NO: 7051 - DNA, 27 bp, Artificial Sequence
  Primer
aaaggatcccatctctgtccgcccaac

SEQ ID NO: 7052 - DNA, 31 bp, Artificial Sequence
  Primer
aaaggatcccattctgaattgcacatgaacc

SEQ ID NO: 7053 - DNA, 31 bp, Artificial Sequence
  Primer
aaaggatccccaactcgaacctgagtacctg

SEQ ID NO: 7054 - DNA, 30 bp, Artificial Sequence
  Primer
aaaggatccccagactcctcacagcttctc

SEQ ID NO: 7055 - DNA, 30 bp, Artificial Sequence
  Primer
aaaggatcccccgaaagaagagcacatttc

SEQ ID NO: 7056 - DNA, 27 bp, Artificial Sequence
  Primer
aaaggatcccgcagcaagatggtgaag

SEQ ID NO: 7057 - DNA, 32 bp, Artificial Sequence
  Primer
aaaggatcccgtggatttgatagagagagtgc

SEQ ID NO: 7058 - DNA, 35 bp, Artificial Sequence
  Primer
aaaggatcccgttcttcttcttcgagtttgttatc

SEQ ID NO: 7059 - DNA, 30 bp, Artificial Sequence
  Primer
aaaggatccctacaacgatctccatcccac

SEQ ID NO: 7060 - DNA, 29 bp, Artificial Sequence
  Primer
aaaggatccctacgttgagccaggaccag

SEQ ID NO: 7061 - DNA, 30 bp, Artificial Sequence
  Primer
aaaggatccctagattcacgacggagatgg

SEQ ID NO: 7062 - DNA, 29 bp, Artificial Sequence
  Primer
aaaggatccctccagagtcgagatccacc

SEQ ID NO: 7063 - DNA, 30 bp, Artificial Sequence
  Primer
aaaggatccctccctcaggtcagtccaatc

SEQ ID NO: 7064 - DNA, 30 bp, Artificial Sequence
  Primer
aaaggatccctccctctagagagcgagtcc

SEQ ID NO: 7065 - DNA, 29 bp, Artificial Sequence
  Primer
aaaggatccctcgctttcgttgtcatgag

SEQ ID NO: 7066 - DNA, 33 bp, Artificial Sequence
  Primer
aaaggatccctctagagtaaatcccggtgctac

SEQ ID NO: 7067 - DNA, 31 bp, Artificial Sequence
  Primer
aaaggatccctgctcaaatcctccacaaatc

SEQ ID NO: 7068 - DNA, 28 bp, Artificial Sequence
  Primer
aaaggatccctgggtcgtttcctccatc

SEQ ID NO: 7069 - DNA, 32 bp, Artificial Sequence
  Primer
aaaggatccgaagtctccgttctccaagtctc

SEQ ID NO: 7070 - DNA, 33 bp, Artificial Sequence
  Primer
aaaggatccgacttagggtttcctccttctgag

SEQ ID NO: 7071 - DNA, 28 bp, Artificial Sequence
  Primer
aaaggatccgagagaatggcgagcaagg

SEQ ID NO: 7072 - DNA, 31 bp, Artificial Sequence
  Primer
aaaggatccgagctcaatcagcaacaacatc

SEQ ID NO: 7073 - DNA, 31 bp, Artificial Sequence
  Primer
aaaggatccgagctcaggagagacccaaatc

SEQ ID NO: 7074 - DNA, 28 bp, Artificial Sequence
  Primer
aaaggatccgcatcctcctcaggaatgg

SEQ ID NO: 7075 - DNA, 29 bp, Artificial Sequence
  Primer
aaaggatccgccactcccttctcctcatc

SEQ ID NO: 7076 - DNA, 29 bp, Artificial Sequence
  Primer
aaaggatccgccctgtctcagctctcaac

SEQ ID NO: 7077 - DNA, 36 bp, Artificial Sequence
  Primer
aaaggatccgctcgctctccactagtagtattaacc

SEQ ID NO: 7078 - DNA, 26 bp, Artificial Sequence
  Primer
aaaggatccgctggcctatccatggc

SEQ ID NO: 7079 - DNA, 31 bp, Artificial Sequence
  Primer
aaaggatccggggaagaagaagaagatgtcg

SEQ ID NO: 7080 - DNA, 31 bp, Artificial Sequence
  Primer
aaaggatccgtctctatcctcccacttcgac

SEQ ID NO: 7081 - DNA, 30 bp, Artificial Sequence
  Primer
aaaggatccgtgctttggtgaattggtgag

SEQ ID NO: 7082 - DNA, 31 bp, Artificial Sequence
  Primer
aaaggatcctacaaagtagccgatagccacc

SEQ ID NO: 7083 - DNA, 30 bp, Artificial Sequence
  Primer
aaaggatcctagggtttcctccttctgagc

SEQ ID NO: 7084 - DNA, 28 bp, Artificial Sequence
  Primer
aaaggatcctattgctgtccctgcttgg

SEQ ID NO: 7085 - DNA, 31 bp, Artificial Sequence
  Primer
aaaggatcctcactatccgagatttgggttg

SEQ ID NO: 7086 - DNA, 29 bp, Artificial Sequence
  Primer
aaaggatcctctcactccaccaccatcac

SEQ ID NO: 7087 - DNA, 31 bp, Artificial Sequence
  Primer
aaaggatcctctccgttctccaagtctcaac

SEQ ID NO: 7088 - DNA, 30 bp, Artificial Sequence
  Primer
aaaggatcctcttggatttcgattcgtttg

SEQ ID NO: 7089 - DNA, 31 bp, Artificial Sequence
  Primer
aaaggatcctgcttactccgtaaaccaaagc

SEQ ID NO: 7090 - DNA, 28 bp, Artificial Sequence
  Primer
aaaggatcctgtaagcccgcatggtaca

SEQ ID NO: 7091 - DNA, 31 bp, Artificial Sequence
  Primer
aaaggatccttaactctgacgcctgcactac

SEQ ID NO: 7092 - DNA, 31 bp, Artificial Sequence
  Primer
aaaggatccttggagacgctctttctctttc

SEQ ID NO: 7093 - DNA, 31 bp, Artificial Sequence
  Primer
aaaggtaccaaattatgcaagttgggcagac

SEQ ID NO: 7094 - DNA, 31 bp, Artificial Sequence
  Primer
aaaggtacccaagattattgcaacacgcaag

SEQ ID NO: 7095 - DNA, 31 bp, Artificial Sequence
  Primer
aaaggtaccccacctttaatcctggccttac

SEQ ID NO: 7096 - DNA, 36 bp, Artificial Sequence
  Primer
aaaggtaccctaacttgatccaatcatctggaagtc

SEQ ID NO: 7097 - DNA, 31 bp, Artificial Sequence
  Primer
aaaggtaccgcacttgtcacaacaaaccatc

SEQ ID NO: 7098 - DNA, 31 bp, Artificial Sequence
  Primer
aaaggtacctaactggtttccacacaagacg

SEQ ID NO: 7099 - DNA, 32 bp, Artificial Sequence
  Primer
aaaggtacctcaattgggtttcatacatggac

SEQ ID NO: 7100 - DNA, 30 bp, Artificial Sequence
  Primer
aaaggtacctccattccaaaggcgaattac

SEQ ID NO: 7101 - DNA, 31 bp, Artificial Sequence
  Primer
aaaggtacctgcagatgttcgtagaagatgg

SEQ ID NO: 7102 - DNA, 31 bp, Artificial Sequence
  Primer
aaaggtacctgttaccatcgcatctcgttac

SEQ ID NO: 7103 - DNA, 31 bp, Artificial Sequence
  Primer
aaaggtaccttgctctacacatacaggctgc

SEQ ID NO: 7104 - DNA, 32 bp, Artificial Sequence
  Primer
tttaggcctctagggagtgttataggggcatc

SEQ ID NO: 7105 - DNA, 33 bp, Artificial Sequence
  Primer
tttaggcctttacagcgagcgtatgtcttgaag

SEQ ID NO: 7106 - DNA, 39 bp, Artificial Sequence
  Primer
tttaggcctttagtagtagctactgagacacgatccttc

SEQ ID NO: 7107 - DNA, 33 bp, Artificial Sequence
  Primer
tttgaattccctgaatccatcttacaagactcg

SEQ ID NO: 7108 - DNA, 34 bp, Artificial Sequence
  Primer
tttgaattcctaagcaacgaggtagcactagcag

SEQ ID NO: 7109 - DNA, 34 bp, Artificial Sequence
  Primer
tttgaattcgagatggtactactcaggtgcagtc

SEQ ID NO: 7110 - DNA, 36 bp, Artificial Sequence
  Primer
tttgaattctcacaaacagctatacacagaccatgg

SEQ ID NO: 7111 - DNA, 32 bp, Artificial Sequence
  Primer
tttgaattctcatcacttcacggtacgcacac

SEQ ID NO: 7112 - DNA, 35 bp, Artificial Sequence
  Primer
tttgaattctcatcaggagtctgacgtacaattcg

SEQ ID NO: 7113 - DNA, 36 bp, Artificial Sequence
  Primer
tttgagctctcatacccttcaggtttctgaagcttc

SEQ ID NO: 7114 - DNA, 31 bp, Artificial Sequence
  Primer
tttgagctctcatacttcatcactggccatc

SEQ ID NO: 7115 - DNA, 30 bp, Artificial Sequence
  Primer
tttggtaccaagcctgctcaattggttagg

SEQ ID NO: 7116 - DNA, 35 bp, Artificial Sequence
  Primer
tttggtaccacacaccagacatagaagagctactg

SEQ ID NO: 7117 - DNA, 35 bp, Artificial Sequence
  Primer
tttggtaccccaaggatgcaagattactgtatcag

SEQ ID NO: 7118 - DNA, 33 bp, Artificial Sequence
  Primer
tttggtaccctagcctttacccagactaccacc

SEQ ID NO: 7119 - DNA, 31 bp, Artificial Sequence
  Primer
tttggtacctcatcaatcatagcttgggcca

SEQ ID NO: 7120 - DNA, 36 bp, Artificial Sequence
  Primer
tttggtacctgtacaattgtagccttcaatgttatc

SEQ ID NO: 7121 - DNA, 555 bp, Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga
